United States Patent 7,868,149 (PLANT GENOME SEQUENCE AND USES THEREOF) - sequence listing, part 103

SEQ ID NO: 55431 - DNA, 3179 bp, Oryza sativa
ccgcgcggttgcggaatcgcgaattcaattcgattccgctccaccaccaccacctcgcgccgcccagctgctccgattcgcgctgcggagcttcccttttccacccgctgatcgattgattcgttgttttttgggggggatttttttctggtgtgtgtgttttttttcccgatcggatcggtccagatcgggtcgatttgggcggggtggaggaggtggagggaagggggagatgcggatcgaggagcttccgggtgattccggcggaggaggtggggatggtggtggtggtggtggcggcggggcgctgctgcagctgcgtcgtggggcggcggcggcggcggcggcggtggaggaggagggtggggtggtgatgcgtgtggctttcgacgcgaagcgcgcggcggtgggcgtcggcgcgcggatgctgttctacccgacgctggtgtacaacgtcgtcaggaaccgattcgagccgcacttccactggtgggatcaggtcgacgaggtggggaaaatttcctaccccctcttttgatttcggttgtttttggaggttttcccccctcttctggttgttgatcgccgtggctttcgcgttcatcttgtgccgccgacggattttgccctgtaatgtagcttcttacggtggtttgctgaccatcatggcagtttgcactccaaacgtttagggttaggtctttcctactgcatatgcatagtggagaagagattttcttcgtttatagttcttgctgtatttggatttttgtttcaatttcgattcgtttagtgttttggacctgtatgtgggtgattggcactaccttttctgcagtattgatttctcgatctgtttagagttatagtttactctgctctaattgtgtacttttcttttgcttcgatcagcatgttctgctcggtgctgttcctttccccagcgatgttctacggctgaaggagcttggagtttgcggtgttgtgacactgaatgaatcctacgagaggctggttcccaggtgcctgtatgaggtagtcacacggccaaatcattccactaaatgactgatcaaatgtgctgaataatatgtagttctgtaagttttgctgcttctgtttgttaattccttcctgcgagtatggctcctgcatattatttgttgttactctgataacgaggaggtgcacggccttgttgtaaaccacactggcatatagcataatcaggttccagtggtctcagtggtgcaatactgcaatgtgaagagagcaattactggagatttctgtgtttgccatctagatgcccacccatcagatcaagggtttgagaaaaatactagaagcgcccttttgtttagctgatgggaccacaaatcgctgtttgttaggtactatattgttattacctgactgtggtagttaaggtagattgaagatcctaggtcagtgatatgtaaactactcatggtcaacctaaatgacaaggttatagcaaacattgtgttagttcagaaaaaagaaatctaattaggcattgaaatgttcatgcaacatgctccttttttaacattctgctttcttctacgttaaactgtacatttggtgcaatctttacatgtaatctaatcacgctggcgctgtttttttgtaatttacaactgatgtgccatgtccatgctaacttccctaaattttacatatatctgtttctgcctgctggtcatgagcgaatgttcaaataactagcagttctaggtcacacaactgaaatggtctttttgttttttaggctcatggaattgaaaacctggtgttaccaactagagattatctttatgcaccatcatttgagaacctttgccgggctgctgacttcatccacagtaagaatctactcaaattgcatatcctataatacgacggaatcactatgtatattctagtttgtttttgactgtactgttcattgcatgagtagatatcagaacttgtgatttgataccttatgtttggtttggtttgtttgtagtaagagatgttttttatgtttgttggtcccaacaccctgtaataaataatttgtgcattgtacttaactctaccaatataatggccgtcgccatttggttttgcagtatgctactgcagtttcctcttgaaacttgactgaatatgctgctacgttgtggatacaaaaaatttaagaccttttatttactgccttttttgctctgcttgctcttctacatttttacttttcgtgcatgttgtgatattcacttcctctaatggggaggtagacaaaaatttaagttcattaatttcgtagagatcctattgtgctgttgcaattgtgatttttaactaggtttgtctcgtgtatttatttatgttgttttaatcttggaaggaaatgctttgtgtgggaagttgacatatgttcactgcaaagctggacgtggacggagcacaacagttgttctttgctacttggtatgttaggttatttggccatgcagatacgacttaattatataatcgaaatttgatactgaccattaactctgtacttaggtgcaatacaaacaaatgactccggctgaagcttatgaacatgttcgcttgcgcaggccaagggtgctattagcttctgcacagcggcaggtaagctgccacaaaaaaaattctgtgcttgtgggcagaatgatttcatggctgtgtttctcttaaattcagaatgctcttattgtgaaaaaaaatattatgcattcagaattaaataggactgctttcaatatcaactggacccatttatatgacttccatcttgaaaaaaaattgttagacactaatatatgcaacttattattggatatttgaaatgatttttagtggtcaaggagctccttacatttttgctagttccagaaaagagataaggttttgtccactattcatgatagtaatagacactgtggctatcaagctgcccctaccttttgttttgtgaaccggttcaactcaatcttttagatttagatgtttggagatactttacagtatgcaaggaacacctttatgtttttgtctcctttgttcatattcaacagtcagacttcattaacgctgatgtgtcgcatgccatattttgtaggctgttgagcaattctacc

SEQ ID NO: 55432 - DNA, 2263 bp, Oryza sativa
agtggcttgtgggagataagcctagtataccgcgtgcagtttgcgagccaggcggcctttgcagggttctcatacctgtgggtacgatgccgtgccccccgtaagaacaaggaggcactccctgtccctgagagtaacaatagcgtgggagcgagagctgctcccttgaggcagagcaactcgccaaacctcacccatgtttgcttcaaggtgtcatggttaatccatgatcgttcgacttgcattcgccgcgacctttcttttaactttttgtctggcatgtcatccgtatatattaaagccaagaacatgcaaatgcaatgtgaagtccttaactccagtctcctcagcaagcaaagagtgcagttgcttgggtatgtacatatctgtaataagttgacttctacatgtacagaggtaaatgacaaggtatctcaaatcgctgaccatgtgtcccaactagcccacttgattattcggtggaaactatcatatatttttcctcttaacttccacgcaactgctgtgcattgctcgaagagaatattgaatgtgattagtagctaaaagtttctccgatgaagacatggaagtgttggctctcgtctaataggaagaaactccatgaattcatgcccactgtataatgaatggattaacagcatcaaggacatctttgtagtttctaccgtatatagtcatatagggctggtttggtttgagatataaaataggcttaacaatatttgatttgaagccaaattttagcatgcctaagaaaatgggttatttcaatagtgaattttgtctattttggcttcaattcaaacacaactttgccttatcaaaattagtcatatcaaaatttgccaaaatttggcattgacaaaattttggtaagctctatttaggctacaaaccaagccaacccatgtatcttcgttgttacacacacggggaacgcacggaacgtacagttcttcatgggccgtcgcaaaaaaggtcggagttttagtctccgaaacccccttgaatgggatgattggatccaaacgtgagacaacgttacaaacggagctaactgtgattctgtgaacatctatggatagtatcagaaaccggcaatacatgatctttttttttttttgaactagggcatgaagccaccatttctgttactagaaatgagcaaataccagaggagtctggtacagtgcagtttagcggcaatacatcgatcgtatcaacacctcaagctgctgcaagaccaccggcgagcgactccggctggcatcgtcggacatggacgcgatcccggcggccgtcgaccagtgacagacccaggatttttatcatgggtgtgcccatctagttcaaaagggtaaagacaatccaaaaacctcaagcacataacacaattcaagcctaatttatcagaagtgcaatacaaacagtgaaataattcaaataaagtcttatataacaaaacggtgaaatctaagtcgtggcacttttttcattgcatagcaacacccaagcttaattttccatgtttttttttgtttgaacgagctaatagaattgatttgcccatactatttcatagtttcctgtcttggagtttccacattccatcctatttgtctggaggatatcctctgctgtccagtgtccaccccgatggacgacaacttcaggacggtgacgatggaacaatgtatgaggtatccgctctaccgatctgtaattaatgagagggaaacgacggcgtcggcgtcgttgcagaaggagccaccgcgccgcgcctcggaggcgctcgagctcgcgtttgcggttgctgctcatctcggcgacggcgacgagtgaacggaacggactcctcaatctgcttgcatatctgacgcggacatgatgggccaaatgcggcccacatgtcacccacgtcatcctgggccgtgtcggcccacttagatccgtctcgccaccgcacgtccgtctgaatctctctgcgtttcaccatgagaactgcggttaaaacttcttcggaacaaagactgacaaattcttcagagcataaatcagaaaattagactgaagaaaattctctgaagttgggggggtggggtgggtgggctatgacggtgaggttgtcggcgtgagagaggaggacggaaatagtgacgggattggcatggttccgattttaaaaattctcagtggcaccgagccgataacacgaattgtaatgttatatttttctaat

SEQ ID NO: 55433 - DNA, 8634 bp, Oryza sativa
tatgcaaagttgcaaacccaactgaaaaaagaaggggaactatcaattactagtaaatatactaaccactaactacttttttattgactttgactgacaacgttatttttcagcatgatgcctgtagacaaatgtgctgtccaagttgccattttatttgtttttatatcagaggaataatgtattttgtcattatttgtgcttgctttcaagttaagctggcagtttggcattttcactccacatgttttactggatgctttttctgaattttctctgtccaagaatgaatttatgccttctttattcattttgagaagaggcatacaattgcaccaaatattcttcagccgatttagttatctggatttgcattgtgcatgaaagtaacttgatcgacttcttcctgtcctgttcttcagaatttttaatgttgtttcatctagagtttcagagcttcagacaagccattccatgtgttggaaaataacagaatatcttgacttataattctaactggattcatcatttttcctgtcgatttatgcgaactcgaatcttcacaaaacttgaagatattcacccaagaagatcctgacaaatttgtctagaagttttgccaagaaactaccagtgggttctgttctacctgtatttactgctcatgtaagtttgtactgaggttgctgaaatgtgattgtatttagctccagtctccatatgctttatttgcatgtattaaatacagcaacatcactggttatggatttgatgcactaaacatgcttcttctaattgaaatttaacttaatcgacagtttcctgttctgttcttcagaagtacagtttcttccagatgttcagacaagccattccatgtgttggaaaagaaaaacataatatcttgacctgttaattccttctaactggatcaatcatttgtcctgtttattcatgcgaactcgatcctcaacaaacgtgcagaaataaccactaaagatcctaacagatttgtctgaccaagtagctatcgcttctgagaaagttcagtacatcacaaacgcaagtttggcctgtgctactgcttcagatttctcaatgaaggagagatcaggctgcaatgcaggaagagaattcagatgcacacgtgcaatggttgatcgctgcattgatcaaccaaccggtcatgcctcctgaaatggtacatggtgatgagaattcagcagcacacatcatcgtcagttgatttccgggtcaaaatgggcaccatggatgagttttcttcgatctgaacatcctttttttctcctcgtttgacatttctgtagtgtgtgttggttttcagaaagcacaaataagtcagtgacataaagccatcatctgtgtgaagttcagtacagagacgagaccaaccaaaccaacaaattttcgtcttctgaactgcttctgcatgcatcgtgctgtcaaccacacatgcatacggattactgaactgcatcttgttcaggtcaatggcctctatgcatatgatgtcctccctccgtattaaattagatttgttgtaaataaaaaaaattcttatctttgaccattaattcctaaaaaatcacatagtttaacagcgtgcgaataattatatattatgaaagtatttctcatgattattctaaaaatatagatgttaaactatataattattcccacgctgttaaactatacaagtttttaaaaattaatggtaaattatcatgttgaattatacatgtttttaaaaattaatggtaaaaagtaaaagtgtttgatttcgtataaaactatgtgattataatatgaaacagagagagtaataatcacatagtttaacatagtgcgaatattatgaaacggagagagtaatgcatctttgtttgttgagtaaatttcacaaaacccaggttttgaggcacccgtaacgcaaaacccctaggtattaagatttgtttcgaataaccctaggttttggggcaaaatgtttcaagaaaccccatgtttaagctaatatcattgtttttgactaattatatattatgaaagtattttccatgatatacgtgtttggacttattttaacgagcatcggttattggtagtatggctgtttatgtatataagtaactggttaatgtgtcattattaaggggttgtgtacttgtgttgcactttttaaatggtgtaatacaaaagtgaggaagaagataaagtacacgagtggtatatgtattttgagtttactaatgtgaacatatacaataataaaactatgagtatttgatgtaaacatatggctttttgaaacattttgcctcaaaatctagtgttactcgaaacaagtcataatacccgaggttttatgttgtatgtgtctcaaaacctgaggttttgtgatttactcttgtttgtttgtttgtgttaggcctgttttagtttctaaatttttttgcccaaaaacatcacatcgaattcttggacatatgtatggagcattaaatatatattaaaaaaactaattgcgcagttggggagaagtcgtgagacgaatcttttgagcctaattagtccatgattagtcataagtgctacagtaacctacatatgctaatgacggattaattaggctcaaaagattcttctcgcggtttccaggcgagttatgaaattagttttttcattcgtgtccaaaaaccccttccaacatccggtcaaacatccaatgtgacacccaaaaattttcttttcacgaactaaacaggtccttagcgtcatctatgaggtcagaagttcaacccttggacctgaccatggccggagctcgatgtagcttagtgtatttccattggcttgatcacatattcagacagaaggatctacatgcgaattgctgatgaatcagttgagcaacgcgagttggtcttctgaattgcttccattctacgccaaggaaggatcagaattcagaggcagaagcgaacaatgcttcaccgtatcagatcagatgctacgtgcacgcgcaggagctgacctgctggctcaggaacagaaaagaaattcacaactggaatctggatgtcctacctaacccttctgaatatgtattggactgaacagtcgcagcaacagtaaaagtgcagttcctgagtactaatcctgctaataaactcgtattaacctcgctttctctgctctgactaactacactctgctccaggaaagcatgtgaaaaagaaaagagagagaaaaaagaattgaaaagacagtagcattggccccagtaatgaacactacttagtaagcacaacatttcagcctttctaatcagggactttgtgcaggcaatactagcacaatcattgatcaccaagcaactttgcatttgcacaccacaagtccacaactgcacaaaacacaattagtgtacaattaaagtattgtaaactgacaggcatcatcattgattaccagctttgaaaacttcatcaagcaaagcaaggttcagcaaaagaggggtatagtatactgtactaggtgttagcaaaagcagggagcaaaggtgtcccatgaattagcaaattttcttctcatctctgcagcttttgctcccggatttaagctgaggggctccgcgtgggacctgtttgcttcgtgatccctccacatctaagccctgcacacaagagtagtacacctaatgagataattaatcactttggttaaacaatgatgcatcacctccacgcattatgcctctgttggatgatgatgatgccaaatgatttttagtagtttagtggcatcctgcacatggcatgctggctggggaggctaatgatcctgattatgttaggcgcaaatctaaccaagattgcattgcatcaccagaccaaatcatgcgtgcacacctgcacctactactaattaagctatggattacttaactaatagtagcgacaactcacacataatctacgagtactactaattaagccattgcttgcttttctatgttaatcccaagtattagggcatgctattttcagcttatcttttgtctatacaatttctcataaaaaagatcttctactgcattatttagatcacttgttttaagctatttataaatcactgaagtttatttctcaaaatattgatttatcatcaaagtaaacaaaatccgtctcaataatccgtgcaaaaacatgtttagaatatatagggccttattccagtgatactggattggtatgatctgtctggcgcaagttcagtaaggtccaggaaacttcgtcttgttccaatgatctcatcttcagtagctttcatccagatttgatgagatatttcccctgcaatcaccgtactactagtagtagcttcgccaagatggccagagaacatatgagccaaaagttgctgcagattgtgtgttggaagaggtcaaattctgctcatcttttcttgcccggttcagacggcagctaccactaaaccttctgactgattaattgactgcctgtttaacagcgacacacatgttcagagactgattaattgatttgcagagactgttgttattgttgcttcagattcagcttcagtttcttgatctggtccccttttgtttcttgcaagttttgcatctctgaagttagctatagcttagctagatgttcctgtcaggaagcttagaatgcttcaaagataagatcacagggaatggaaagaaaaggagaagatttcctctttggaattcatcctcactgatgcctgcactcggagatgttaataattgcaccgttgacagttcgacccctgttaattaattaattaattactctggtcttatacatatgaggagattaacaaaacaaagcaaggaaaatcagccatcgttatcctgagatctcaagtgccacaagagggatagtaagcatcaatacagtagtaatcatatcattcttttggcagtaattagtagtccaagaacactacagatatgaaggaattaatattgaaaacttttatgatccatttcatgcatcactttatacaaagacaccatattctttgctgagtaaacaacaaacagggtgaagtgagagataggaaaaaaaaagattatgaaactaattaaaaagttcaaaaccagagctaaattatacacgtagtataaacaagaaaactacaggggtccaaccctaattaagtaattaattaataccctgctaattaagaaaaagccactactcatctctaattaactaattaatcagtagtggggtctctacgccgacgacctctgcgccgccgccggcggccacgggcgggtgggcaccggccgcgcgggggcggcgccggagttgttgcgggtggtggtggctgcggaggcgacgcgctcgcaggaggggcacatggtgagggtggtgggcggcgggacgcgggcgccgtagaggtggtgcggcgcggcggcggcggtggcgagcttgagggcgcggagctcctggagctcgcggtggaggcggcggttctcgtcggtgagcgtctcgcagcaggcttgagcagctcgcagtccacctccgtctgcttcagcttcgtcctcgccctcctgttctggaaccacacctccacctgccgcggcttcagattcagctgcctcgccagcgccgccttctgcttctgatcaatccagcaagaacaagtcaatcggattgttctatttcgatttcatggtggattggtaattagtttgattgattgattgttttgcttacgggattgagggtgttgtgctctttgaaggtgtcctcaggacggcggcttggtccttggagaggcggagcttcttgcgggatccgccgccggagtcctcgtcgtcgctggcggcggcggcggcggcggtggggcagatggtgcgccgcgcttgccgctgaggctggagagcgtgctgttgggggaggacgcgccgggctcctcgtcttcctcgctgcagctgggccccctcgccgtcgtcgtggtcgtctctgccgccggcgcacggttcacgtcgatcccccgcaggaacggcatctcgatgacgtcgtggcacgccatcatcgccgacctcccccgatgatctgcacgcaaactaaccttcgtaagatcgatccatgcatccatgcatgcacgcacgacttcgacgtaagtccgtccatctatactcaccggaggaagacgaggagaagagaccgccgccgttccagccgcacagctgctgctgcggcggcggggcggcaccacggcgcggcggcggctgctcgtcgtcggctgcaccaccggcgacgccgaggctgagcccaagcccaagcccgagcctgagcccgccatactgctcgtctctcctcccatgaaccatcatctccattgattcctctcaactctctccacttctcaacactagcgtggtgagttcgttcttgggcttgatggaaatggaggtgagggactgagggtggtggttggcgaggaggaggaggaagcttttaaagcgtgggggagacaggggagcttgattagagggggtaattaaggaggagattagatcaaaagcgatattttgtggggtgcaggaaaagtcaaagaaaatactagtagtagtagtattgtgcatgcatgggctgcgagtattcttttgcgtggaatgggcgcacgcgtcagcgtcgcagcgcaaatgatgagcagcttttcctgttcggagggagcgggggcactcattgacttgtcccccggggttggggccgggtggggcccaccggacatgacttgttgctcctttgaccctggttcctggccatgccttcagttgagcctgcccatagctcgcagcctgaggttttacggctttacgctaaaaaataaaaaaaatatatagagagaaacgccccttcaaatattttttaaaaagaaattataatcgtgttgaggattcttaaggttgaaaccacagtctttttatcactggactatcaagtatatctcctgaggcttatccactttgtctactaatatagtaaaacatttttcctagtgtgtgttatgtttattcacaaatgttaagatttttttatactcccctaaccctatttttctatgtactattatatcttaaatagagagtagtattatttgtctatttgattatctttctttttatcttatccaatcaccctcaattcctccgtaaatgagagataccagcagagtctttccaaacattaatctctaatctccttgtccaaaagaaaatctaattatagtttaaaattttagctcacaaaaaatatttttcttccttaatactatttactatttcatctttttatttatttttttaaccatcgaactaataatactctctcattcccctagttttctcctctccttgttctctccaagtattaatgaatagtatattatttgtttaacctcatgtataatctcacttttgaccactgaaaactatggaccagtttaggggagtttctaactgttgcagcttctcttagaaatcagaagctccccaaacagtctaagttttttctagattctaaagctgtagttgtaaactagaagtcaaaaactggaaaacatatctttttcagattctcagaagttggcttctcagaatcagggtgtgtttggttgcttgcattgttttagcttggcccatctcttccatcaaggctgagtttggcctggctaggtagatacatatgcaaccgtttggttggttgtattggtttagccaggttagcgtgagattctgcttggctgcttgcaccaaagatacggcttgaaagagactttgtttggttggttgtatggatagtaggtataagtattttctttctttgaaggagagattacctcacttagaattaatattgaaaattcttaccatctacgaaataaaaagcgtatttatttatggtatatatatcagatttaatagtacatgcaaaatatacaaagcattgatttcggagctcctgacaacaataattgaaaacagtatcggatgagcatatacagttgcacagcagtacataaaccatatttatcagtggttaatgacattcggtggaaaaaagaaagaaaaaaaaaggagaacagagctcgcagaggaacttgccgccaccggtacctagccgctcgtgccacccagctaggcatgttcgccgccgtcggtgcagcgggtccagcggccgggagggtgttgtggttactcggatctggcaggcccgagcttctaacctctgaatctggcgaaaaaaaaaggtgagtaggagatggatttgaggtagctgtccgtggcggcgagggtgtccgcgcagcgacgagctcaagccggcgaggaaagtggtgccgctggcgacgacgacgagcttaagccaagctcatacttcgacatctccgtgcaggtagatctggcagtggcgagctcatgccctccggatccgccggcggagagctcttggtgagcccttgctgaagaagagagggaggagcaggacttgcagctagcctgatctggccggcgaagatggagatggtcgccgctagtgg

SEQ ID NO: 55434 - DNA, 716 bp, Oryza sativa
agttccaataataggtgcgtgttgattataattatttagctcttgtccacagcattaattacttctttaattgctttagagcacccgcaatggtaaagtaaggtactatctataaaacatgtacacctcaacaatagactagattaatagtaaaccacttcaatggtatgtctacatgggtatctatagctctctaatccattgcctcgtttttctctatagactatctccatgttagtagatagctttgctctctcttcatttaatctcttccaagtaggaaaatatgctgacatagatctcttgtagagagcttatagataaccattgtgggtgccctaagtatatactctactttgttgtttagtcgtgcgtggttaaatcccagcttccatggcgttcgagcatgccacgtcgtgcgcacgtggcgcgaccccggcttccatgcatgcaggtaggtgtgtcgatcatgccggaggtagccgcgaattcatggttgatccaataaataataataatgtaatcatgcacctaatggaaatgataaccaactgattgtttgttaagttaactacatgcacgttgacgtgacgacgtagcagctatgagtaacatgatcaaatgcgtatatgctacgtactcagtcaatcgccaaccattagtattagttaaagtgtgttactatactatgtcaggagataccaagaaagaacaat

SEQ ID NO: 55435 - DNA, 742 bp, Oryza sativa
tcgataataagatgtgacccaaagagaaatttactccaattttaatatccctgatgctattgcacttgattagcttgcgattttcgtaactgtggggttaagaattttttagcttgtctctgttaatcaaccaatcacctcatggtttcttccaaaaatctcagtcacatatttatccgttggatcaatccaatgccatatacctttgtttcttcaacctctcctgacggtgctttccaaccaagaactcaccacggccatgaacgttcaaatcatgctttgatttctgtcgccgacgacgagcttccaccgccatgcgtgctattcttccccggcgacggtagacggctagacgcagtcgaaccaattaaactacgatcggatttaacgactgacaacttttgtatttgacctatctcgtttaatttattgatgctctattcatatattaagcaaacctcttcatattcttagataggagtagatagatagacttaacgactgcacaaaatacaggggcaaaaacaaaagaatcgactcgatcagggtaatcttgctatgaaattttcaacaccactgtaagctagaatctaagattgcttatctagctagtcggtacttttacttactagtcagtttgacttcaaagatgcaagaatttattaagcacataaattgcttaacacaataaacgtaacgcaacaggacaagctatatagattaattagttaattaattaggg

SEQ ID NO: 55436 - DNA, 2208 bp, Oryza sativa
cattttgtcatacagtactaaatttatctgttagtgcaacagaatgtgagcaatcatgcgtgcgtgcaatgcattggccctaataaatgtcactcatggactcgtggcggtggtgacaccaaaccggcatgctgtcgggggactctaccttgcctgatgatgacaccatgatgattataattagtactcctcctcctactcttaaccttcacactatcacaagtgtgccacacttatacttatctagtagtgctaagctagctagctgcatatacacgtgaaagtgtccacgtcatccgtgcttggggcccacacgtcactagcacgtaaccccaaagccccgacaatccggcctcctagctcgtcatgccactgctgctaactcatctctccttaatcatttttcttttcttactggagtagtacttggagtagtttgaacagctgctggcatcatccacttacacgcagctcaagctatgtttttttttcctaagtggtttagttaaacctgatgtgtccaaattattggtcagatatgatcatctcatcacctggagctgatcgagttgaacaaggctacatggatgtacagctgaagaccacatgtccaagtttgctaatactaacagaacatgctaagtacagcaaataccttactctataaatatggttcgtaacaataataatagtactagcaaaacactatgggatacgacgaccacctgctaaccctttactctcagaggtagtttaaatattatcacctccatcccaaaatatacattaacagcttttaattataaatctgataagtgtttatctaaattcataattaaaacttgctatattttgggacggaagaaatactaagtttatagccatcatagtacaacggtaacatggagtctatgccggaaatttgtctcaactcttaaatttatagagtagtcatcacaatactaagataagaaagtaagaggaatttcctatcctttcgatgtatatgtataaactatcacaaagcaatactgtagaagtgtactactgtactttctgctggtccaacctacaaaatgaccttcttgatactcctactctaaacccttcaaaatttatctcagagatggtctatgaaaatgctgcaaaactgctgctttacaagaacattaccgcagtatctacagtattagagattaaggaggccatcaccaaggcaaaaacatgtacatcatcagccttcgagtgccgtatccatgtgaagttagagaagttacctagcacaatcactcaatcagtcccttgcttctgccttccaacttgtaattgcacataacagagcatggttgggaaccaaatccttgttaggaagccgcgattttgtaatcggtgacttgtcattctcgcacaaccacatctcaatagcgacccggtcgtacgagtacccgtcagatgcaatgcatgggtcctgcattatcctctacagggaggaaaaaaagcaaaatgaagtttcacctcagacccttcgaaaaaaatggatacaacaaggtaagagtaaaaagttgaattacagaccaccttgaagtgtaatatagttcaaattctgaaacagaaacattcttacaagacaatgagctacaggtagttgtgatgtaattcacttaaagctgatgtattgcaataagccaaaaaataccttgagtattgggcagataaaatggcttggtggtccagatatcactggccgtacagggtcagagacagcactggcaatttttttcagccgttccagctccacaagaaccttacacttcagatctggtctatgcttgcttcgcatttccaaacagcttaggccaagctgcgctagctcatgtgcttcttgtgcaggccacttcccagcactcttgtccaagatgtcaacaaggtgaccattttctactgcttgctccacaaggtccgctagccccacaggtggctttccagtgagcagctgcaataaaaccatgcccaaggcgtatgtgtcagattttgttgacacttggcctgtcctttggtactctgggtccatgtaaaacagtgtgccaactagatctgtgtccttgaaaattgtgcgcgttgtcgacaaggcatcccccagcggaagcaatgttgaaaggcccacatcgccaatcttgctggtgaaattgctatcagggctgcaggaat

SEQ ID NO: 55437 - DNA, 4082 bp, Oryza sativa
tatcgcaatttacttcttagcctatgaatatatctgaagatccggagatcatgatgatattaggacttgactgctcaacctttaatggttcaaggaatacctcttgtttgaaatgtttgatcctgtggctgtcgtcagaagtgaggacttttatggcaacagatgtctgacgtagattgcccttgtacactgttccgttagatcctgatccaattttaagtgcctctgaaaacgatgatgtagcagattcaatgtcttcccatgtaaatgttgagtatgacatcccatctaattcaagaagtttttccagcctttgcatcttatcagcctccttcgaagtcctcagctgcaaaatctgcttctgcaaagcttcttttcttgcaagatccctcacatgcctgcactgagcctccaaagcgttcagttgttccttctcttgatgtgcttgctcattgactctgttgatcctggagtagacctcgctgagccgggcttcctcttcagcacgttttgcagctaagtcagtcacctaacatatgattgtcaagatgacaattaagttgctgactattggagataaagtaaccaactaattatgttgaaacacagtactcccaaacttacatgctgagaagcattgatggactcatcctgaacaagtttgcacactcctttaatatgcctaagttcaagcctcagcttttcaagctcgctatttacatcatcctgcattgagaaaattaagttactgtatattcagaaaaaaaaggaactattcttatctaagaagtttaaacagtgaaggctcatcctcaattcatcaaagatgtatcatttgcaaaattatactactgtgaaaaaatttattacagttttactgtgaaaaaatcaaatggctcaccatgtcctctgaaagcatcaattcctgcaggggactgcttgtcattggagctttatctgagataagcacgttacttggtcgaggggtttgaccgctagcacatggagaattactgttattatcaccaacagatgctgaagtgctttcagtaagatactcatgtaaggagcgcggtctatcatggtctgcggatgataaactttccagattctcccatgtcaagtttgatctaaagcttctcgaaggtgtggcatctgcattggacaaaagggataaatttcttgcactgtttttttttcttttcttttttgctgaatttcaaaaccaaacgacctcgattccaaattcttattgaatgcaaagaaccaagcaaacatttgaaaaggaagctaggtgctacaaacttctcaaagactagcaaagatccattctatatcagcttcaaagagtaccaaggacgaaaaggttcaaagttggaagcagtcattatgttatcgtctatacagtacacagtgaaaatttccagtgccagttttacggacagataacttcacctgataatgagggcttatcatctgaatggatttcagttttggagctatcactggacaggaatagctcagaactcttgtgaccttcaaatccaggagaataaactgcggataaaccaccttttgagacaacataaactgcacaaaagcttggaacacttctgcaaatttgagaagatgtcctagtacccttggatttcctaagacatttccaccaaattaatcagcattttgatgcatgcagttcaccattatttattacagaacatgttaagtacctaataaagttgccctgagaagagtcaccgacaacaagcttgtggatttcgtacattgaaacaacattggaaatggtttctgccacatcttcacctttgacaaccagtacttcagctttagcctgaacaagatcagaaaatgtatacacatgttcagcaggatgtttaaaactatgagtatcattgctgagttctaacctgttctcataatttctgactctatacgaaagtacaattctgaacaaaattaacattatgaaatgtcctgaataaatactgttgtgaattgtgcttattcagttgtatttcattatatttggctccagtgtgcccttaggaatgttcattttggaacggaaaagaaaaaaaggatggcctgaagtggcaacgtcataccttctcatcacacatgttcttgtagaaaaggagcatcgttcgggccttacattcgacttctttcacatatgcgctggcaatgtcagcccgtactttatcaatcgggatatagttgcccactacaaaagaagcaagaaaaatagatatatttaagtgacaacatgatttacaaacgaaagtatacatctacacagtaggaaacacatcaaatatgcactcactcggtgttggaaccgtggtgatcctctgcagtacatggataagcacgaacctaaccatcccattggtgcagaagtttttcacagcccactgcacggcgtacttactggatttggaactactcacggccaacccaacagtcacagtgggtcgttgttctcaactttatcttggatggccatggctttgcagcttgcagttttgcattgcctatatccctaatacaaaataccctgcataaggaaatatggtgtgatcaacagcacaacaatggtatattaatcctgccatgttacaaatcagcgctaaaaatatcctgcattgtatcagctccagtaatcacgaggaaatacgctactcctaatcatttcctatcatctaaggtaacccttggtcatcaccgattcaccatctacaacacgggacaaattatcggaaccaatcgggggcaaaaacccccacggccggcaggaggatcgagcaagcaacgggacaaggcgccatttactggatctccctccctccctcgcgcgcgcgcgcgcgcaacaaaacgcgcagatgaacggcagccagaaatcgatttctctactcgcaagcattcgcaccgcattccttcgtctgttgctgctgactgcgcggggcggaagacgggaaggggaaagggattcggtcgagaggcctcacctttctgcgccgccgccgccgccgccttcttctccaactccggcgacggcgaggcagtggaatcgccgccgaggagggggaaaaaaacagcagcgcgagacaagtgcggcgcgtagggcctacttgtcaggtgactgtactggatggataattttcggcccaaatcgacaatattacagtatagttcgcatttgattcaggcccattaaggcccacctatctcggcccatttgaaacaccgaaatagagcaagagacgcgcgggctcaaaaaagaagaaaaaaagaggcgcgcgtcgccgtcgggcggcggcgaagccggagatggcggggacgccggggaggcgccctccggcagccggctccgcgccgcagcggaatccgaccggaggcaggtagataagtatcctgctcctcttccctcgcgttccagctcgcgaagtccccgtttaatttgattttgtatgcgtttttgctgggtagggttatggtatgtactagggtgtgttcgttcggggatggcgactagttcttcgagctttcgccggaggggaagatggcggtgcggccctcggggaaagaggggtaaggatttttcagtgcttgcctcttgggctcgtggtgaactggtgatagcttggagtgtgaggggatcgtcgacaaccgtggcgtgtgcttcgattattgcttaatttgttcaggttacgcgcgactctgtcagccagatgtagttggagagccttttgtcatatcctcatactgcctgtagttcgagacaaaaatcatattttcgaatattttacttttttgggatggttgctacgatgcagttgagtggttcagttgtgattggtgattgtctgtgtaggatgcatcaagcggtatttctgatttgggcctctggaagatggatttgagtgatgatgtgtaccaattgctttctgaaggtacttgtctgcttcgccatttctcaacaactgataaatttgtcaaatgtaaccgttcatttttacttggacgttcatcattcagttgatttgatgtcctttccaggg

SEQ ID NO: 55438 - DNA, 4857 bp, Oryza sativa
ccctaatgcagtgcagtcataagtgcaccatttcaagtgtatttgttagttggtactaaatatctgtgcattacagtgtttatatgatactaaaactcttcatgccagaacatttttagtttagtaagaaaccataaggtccaaaatggttggttcagtgttcagactagcagctcggcaaaatcttcttactaatgtttcagattaattatattgctgccatatactgggtgcgtatgattgagaaaattaaatctattaggtaacataaatatggttggttcagtgttcagactagcatctcagcaaaatcttcttactaatgtttcagattaattatattgctgccatatactgggtgcgtatgattgagaaaattaaatctattaggtaacataaatataaggcgtgtaggcttctgggctctggagtaccgttgttttgtgcaatgttcaactgagttgtttttaaactagagaatgagatataaacagaaaacaaatcatgaatcttcttattctttttaatgaactgactgtgtttctttatcattgttgatccagccgagcaacttttttaagtttatcttttatttccatacatcttatctctttgttttattgaaatggatttgtttatcaattcaataccagtgaagcatatgaatctgatgatggaaactgttgcaacggcacattcggaatatgccaatatggaatggctacccttgcctgcaggtatgctatctttttcacaacttttaattcatcaagttctgttctttctttagattatcactcacgtaaacaatatatatccacctgttgatatggtcctgtactccagtgtcagtttttttatatataaaaaaagatatggtccagtcactgctgatggatcctaacttatattttattcgataatttgaagatatatgctagtatcttgcaagggatattttgtccaactgcatcaacaaaattaggcatcaagatttggatgttggtaagcacatcctctctctagatcggtgcaagtgcaacctccgtcttgaatcttgatgacattagatgagaatatctccacacgaaaataatataggccattgctcactcagttgcttactactctgttttactttagattatgatgcctttctacttcaaataggtaaatactctttagtacagaatataaaaaaaaggtaatatctctgtaacaagcaagtcactgtcaaaattatcctaacaccttcaagtttttgctatttttattaactgcgcccttgattgatccgtgactgtcatttttctttgacgcgttccgtgatagtcatggcttaggattaccgtgcataagggataaaggtgcatgctgatcgattgccgactttttgagtgtttagccacgctttttcttaacttatcctctttggtccgttcaaccccatggatgcaattttaattagttgcgagcagaaagcatattgttggcttagataagctgtcactgtttcgtgcttgtagcaatatgataatacagaatgcagtagtagaccgacaacattgtcccccggttttacgagtggtagaccgacaataatccacctctcgcggtggatcccttttgacttgcaggttaattacttcaggttcagatccgttgattgctcgtgttcttgaaaatataatactcctgtttttacatccttgctatagttatcatgatcaccttgccgtacgttcgttggctttgattaatctggtgatttggttcaagatgatgtggtgtatacattttccatgcatttttctttggcttctttcggcatggactgacttgtgtttgtgttggttgttgcagtccgtaggataggatgagctgatgatgagcagctgcagctcgcaggattatttatttgtcgtggaagctggtgtgcaacgtctacgaattcgtgtaccagactacccttatatataagtactccgtatacatacaggtacgaaaaaaacgcgaatagtagagaaaaatttaatattaaataaatagaatagatgagtctttgaatccagatcaattagctaaccacttgtgaagctagccagaaaataaatccatgtacgtttctctactacaggtacgcgcacggtcggccacaccttgagctgcacgaatgttattcgcgttggacgaggcaggtgcgttacatgcttgtgtgtgcaagttgcggcctcatcgcgtttgtgtggctgtctcgttgtcgtccggatttttggatttttggtccgcacgcgcgcgccacgggtccgatcgatgatatcgtcatccctgccgtgctcgtacgggtcacgctcaagtgataccatgctcgccctggttcccaaacctccaatgccaccatgtgtttcaccagttgtgtgcctgcagcccacatggaaaatatatacggagtataaatctagggcctgctcactttgctattatttttaaccttattaagttttggcattatcaaattttggtaaggttatcaaaattttagcaaggttgtcaaattttgacaagattttatatgtacttactaaaatttggcaacaaactaaatgtagctacttttttaagtaactttgccaaaacttgataaggttgaaaatgatagcaaactgaacaagcctcgatttatgcttgcagaaagagtgagtgcacattttaggtcccatgaaatacatacacgtacatagctatcagcgtgtcctcgtaatacacattcaaatagcatcaataattcctttcccttactctataggaagcataattccttatatagagtataggttgatgcatatataaacgaatcatagcataccacatgacactaacttgataaaggttgtataatctttagactcaacatctactataaagacgcatatttatggacctcgtggatggactccaccatcatattaatattgtctctccaataggatcgataggtaaaaatgtcattagcattattgtcttctaatgtgaaacaaagtgagcgttctacaaaaatatttgacatcctcgtgttggagttcaaatttacaatctcaatgctttagcctatacaaaatcacctatgtagaattgtaatctcaccgacctgcttgagatgccattggtgttaattttctccttttgtttcttccttctcttcttcttcggtttcttttcttctcttcttttttcatcaccgagggcttcccgagatcacctcacgaatcctttctagtgcaagttttagggtttaggcaaagagtacgacattcccttctcctttggcttgcatctctttatataggcgctggtggggctcgagggttatctccaatttggttaggaattagttctactgttcacaaaactaactctccgtctttaggaatcagatacgtgtgatttatcttccttatctagctggcatttagctgataaaatcaaccaaaacctggtattgatagttatagtgagacaaacctctaatcctcaactattcaggatttacgttcacccgtggcacattagggttacatggtacaccaagaagcaacacatttagaatccataaactttttggcgtagaataatccgtgcatttttcatctttagttaacgtctgtttagttacgagtagaagagttaaaccagaccatgacatcgctcaaaagaaaaaaaacaagaaaagaaagaaagaccacgacagtttgacgagctagcagcgagagagagtttgttgggggccgtttgctgtggatcgttcaccagtcaccacacgaaacgatcgaagcagaggctgaggctgaggagagcagccgaaggaaggaagcccaaccgcgtggacggatagaaagaaggcgtgacccacaagccgccgctacttgcctccctcgtctcacgtatatccccttcccccgaatatccgccacgtggacggccctcgcctctctccgaccaccttaaccaatcaccacacagcagttaacccctctcctccccttcctcttctcccccctccctctcctcgtcgtctccaccaccaccatctccgtctccactcgatcgatcgatcgatctccataggtgggggaagggaagctttggaaggtggagggacggagggggggatgacgaggcggtgctcgcactgcagccacaacgggcacaactcgcggacgtgccccaaccgcggggtcaagatcttcggggtgcgcctcaccgatggctccatccgcaagagcgccagcatggggaacctctccctcctctcctccgccgccggatccaccagcggcggcgcctcccccgccgacggccccgacgccgcccccaccgccgccgacggctacgcctccgacgacttcgtccagggctcctcctccgccacccgcgaccgcaagaagggtcagcccccccccttcttcttctttcccaaccccttaatttcaatgatttaatcatcccaaaaaccattctggcctgatgcgacttactagatcctctccaacctcaggtttttcttcttcttgtgcttctttttttattattattcctactagtatgttcttcttcctttgctgcttcggcgtgtagatttgggagatttgatggagtactgctactagcagtcactgctagttgtttcttccaagtaggacagacgctagagaaagcatttaatgggcagattgtactgatggtcatggatgagtgatttggtactacttagctcatgcatacgccactccacttcaattaattactctcggtacaaggacggcgtatagatgcctccaactgtttgatgggctgcag

SEQ ID NO: 55439 - DNA, 1600 bp, Oryza sativa
  unsure (1)..(1600): unsure at all n locations
tttatgttctggcatttctcttggaatctcatagaatccttttactttttaagattggagtcctctctctgtgcgccctgtttcttaggaacgggctcttttttgggctggataattttccttgggtgataggcagtactgttattttgtgtagtagtcccaagtttgttggtatttttgtcagtatatgatgggagcttaactattacagttctccagcttcttgtactccagtcattactcgctacctgcgtgcctgcaggccacattctgtgtgccatgtttctgattaagatgactttgacaggtgttccttgactgaagaagaacaccggaggtttttgcttggattgcaaaagcttggcaaaggtgattggcgaggaatctctcgtaatttcgtggtctcaagaacacctactcaagtagccagtcatgctcagaaatattttatacgccaatccaatatgaccagaaggaaaagaaggtctagcctttttgacatggtgccagatgaggtagcttgcttgatcttatttcgattattgtgctgatattggcatgtagcataataagcctgcctgggtctattcttatattgagacgaggagattgctcatttgtgtggtgatagatatcatattgctaaaacttatctttttgaacaaattgtgtagtttatttatgtattgcatgaagacttgagaacacttttatccttgttcgaattagaaaggttgtactgttttctctgtactctaatgggggaactgaactgtgttttggtggttttacagtctatggaccttccaccacttcctggaggtcaagaaccagagacccaagtattaaatcaaccagcactacctccaccgagggaggaggaggaggtagattctatggagtcagatacttctgccgttgcagagagctcttccgcttctgctatcatgccagataatttgcagtcgacctatccagtgattgttccagcttatttctcgccctttttgcaattctcggttcctttctggcaaaatcagaaagatgaagatggtcctgtgcaagaaacacatgagattgtcaagcctgttccagttcattcaaagagcccaatcaacgttgatgagcttgttggcatgtcgaagctcagcataggagagtccaatcaagagacagtgtctacttctctttcattaaatctggtaggaggtcaaaatagacaatcagctttccatgcaaatccaccaacaagggcacaggcatgatctccttctgcacacaactgcatttagatgaatcccaggcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55440 - DNA, 5894 bp, Oryza sativa
attcctgcagcccttagcaatatagacaataggttgaaaataaaggcgtggctggttgaacattataccgataagcatgtgaggtgcacataggaatcttaacagtgaaacaaccttgaggtggcctttacaataaatcgagtcaattccatataagaattaaagatcatgcccttttttaaaattttatgataaattctgctacagtatattgtaaaaatcttgatgcacaccaatctagaaatgtgtgtatttgttataagacactccactttagtgatgattcgctaaacacactatacactatgaccattacttcaatatttcttgagagaattttagaacgcatgcctttaccccatgccatgttatatgcacttatattttcgtcccaaattgcaaaaatcaaatcatttcaaggatgattcatagaatgaaaatctcaaaaagaaaatatgaacatgaaataaattaaaaattaaataaatgttgctagatttaaaacctattctaaatagaaaaattcaaatatcctactgtggagttaaaatatctaaattttcttataggaacaacctcctttgtttcgacacaatattttctcatcaattcaaaaccgcatgttctcaagtaattttatttttgaatttatatgttgcaatggtaattatgagaaaataaccaacgttcaaaggacacaaaataaatttaattttagtttgaatataataaaaatattttagtaaaaagccacccacacataaatatttataataaaatttcatttacattattaagaaggtgcccacgtatacgcgggctacttttctagttgaataaaaaagaatcaacaatttagatttatttgtactactagtagataacactgtactaggattcttcggttaagagtttgttttgaccctgatttttctttgcattttgcaacagacatcgaacatcgataagaggttggtcgactatatcattattaagaaggaataactgttcttcctccaacagctatcaaaattaactagggtaagtgccggagcgagatatgaaaacgaagaatggaacaaagcaatcaagggagtggacaagttattttgatttttgaaacatgttttattccgatctttcctctgtgctgcattaacccgtgactagtattagcagcaagtagcacttaatgccaagtaaacgccaccgtacttaaagttcagatctagatctatcaccgggaaagaacaaaatctccatcccttggtttggatccgccaatcagctgcagaatatgcaacaaatggacaaaaataagaagcaaaaacttcatcgctgagcagtaaacgtaggactaacacttggtgtccaaaagggtcgtttccaaacgaaaaaacttgtcggttaatgtccaatccatgtacacagaagcagaacagttccgtttaaacgacctgctcagtcacgagacgccttacctaacaatgcaacgatatagttgtctccacgtcttaaacaaagccttaaagtacctgaaatgtaaacatccggttggaattgcaccgacctcaatagcctcgaagggtaaagattgatggcgtatctgtattacagtaatagtacaattaacagtatcgaaggtttatgacacgacgagcatataaaaaaacaagatatgtatattgtatagtacaatgctcctgttgttgggagcaatttttccaagatacgaccaacacaactacttcactgctcacaactcaagtgacaaaaccgtcaatgtgactggcgagtattacacttgaccttactcctagacccaccagctcgtgactgttccaagagtcttgtaaacgttcatgaccaaagtacgaaatgaacgtgacaatgatagcaacggctgccggatcatgagacagaacttcttatttgaaacgaaggatcgtgagacagaactagcttgatgcttcacatcagtcgcttgcttggggtctagccaatccgaaggacaacgtagcacgcaactacagattttgtcttcactgaggcagtaaaagaactccacaagtgacaggactactaaggtcatttgttggcttaagtagagaatttcattccctcatatgccataaaacattttcattgattcaaacttgtattatgccttgacctaagcacatttggattagtatgtacgaaattttggagactctagattttgagcactagtaacatgacatccaaggcaaaacagtcttgcatctggtcaccacattctgtccaagtagtaatctctggccgcctcgtcgctgagctcctcggagtagccggggcgggagtcctcggagcactcgaagcagaagccgctgtcctgcgtcgtccgcgagcacgatctcctcgacctcgccggcgcctcggcggcctgtcgctgcctgggcgcgctctggcaccgcgtcctcgccgctgacgaggccgtgccggccatgtagcgcgggctgccgagcgcgtcccggtgcgagagccgcgccctcgccatgccgtcgacgctcttgttggcgggcgagctgccgtacggcggggcgccgaggcgcggggtgttgtgcgccgtcttggcgtgccgggtgtcgcgctcgtggtgctggctccgctggatcgacaggcgtgggggctgcttgatggagatcggcgacgagcacgacagcggcgccggcggcatgggcgccggggtgaggcagtccgacgagtgatcgcgggagtgccggatggctatccgggaggaccgagagcggcggtggcacgtgtccatctcgacgatccgcgggctgcgctcgtagttggagtccgcgctgtcggagagcctccggcggtgccccggcgtcgtcgtcttcaaccgggtctcctccacagagatcctctcctacacgttgcaataaaacgtaccaaacgaaacgatcagattcattctgcattggctgcattgcgagatggaatgcaaaagcttgacatatcggcacgaccatcacctgctccatggatttccggtaggaagctctcgtggcggcgcgggaggaggcctgctgccgcatgagcgcctgcagcctgtgcagagtcgtggcagcctgcttcctcacgaggtagccacggaccagagcctgcagcttgacgagagacctgagagcgcgaagcgctttcctagcctacggtgtaagattcaaaaattaaacaaacacaaatatttcactaaacaatttgcattaaagaatcgcggtttaggtgacaaggcttatgtcacgctacgtaattaactgctctgacagcaaacaggaactttattataggcagaaggtcaccgctaacgcagagtaaacaattgtgtagccgatcaacgtgcagattttgtatgcaatgcaagcagagtaagagagctactccaatagtctagtagactagttctaacgaccggagtatccattattatggaacggaacattagaggtagtgacatcatatacaggcatatagcaatgcctagcctactttacatactagtagccaaatagagtaacaaaaaagaagtagaagaatctaacaaaaatacggtgcaactgtgcgagcagtgtgcaacttctgactgaccaaaacttttcaaagataaaaaaaaaacgatggatctacaccgtcacaactaacttctactgtgcattagaactctgtctctcggtcaaaagaaaaaaaaaatgaagaaagaagactgagcagcagagccaacaagaaaccatgaacagatcaagtttgaagaacatagtctgatattcagtatacgtggatcataccaggtagcctctgtaagctttctggatcaccatggccgccttctcccgccgagctatggcattttccacctcgccacaatggcacggccgcctcacttccgaaggctctactgctactgcggcgacggcggctaaggcggcctccgatggccgcctgccgctgtctaccccactcctcctgtgcttcgcgaagctccacctgctcttctccttctccgccccgtcgctcacggcgtggttctccttgaggcctttgtgtgcttccttccggccagtcagtagcttcttgagccatctaatgatacgacccatgccgctatgattcctctctacaaacaaaaacacgagaaaaaagagttaaggaacgcgtcgcaaccagatgaacaaatgttacagagagagaagctgagcaagtggtgctgtggtggggtagtactaacttcagaagaagcaaatgtgaagaaagagcttctggccggacaagcgaaggagaagaggcctagagcaagaaacgctgcataaagcttttctcttgtaccgtagcccagggctcccggcagaaaaggaatggcgaattgtacgtgcaatccaggaccgagagacttaaaaaagaaatcccaaacgcgattctcggaaaggcacgggattaaagcgagagactttgcaggacaagcagcatgcagcgaaaagaagcaggaaattacaggaaacggcgaagtttacggcgacgaccggaggaggaactctaggagaaaactctgccacctctctgcagcgatcagtacgtcccccaaaccgtcaaaattcaactctagcggcagcggcggcggcgaaagagcggagcggatatgcgggcgaagggattaggcccgggcgaacttgacgcgtgggttgcagcggcgcaccagctcatgagaaagattccccccaagaatcacacggagagggaagccaacaaacgcgctagccaaggagaccaactcatagtcccccccggttactagctagcgtacagcgccgcggccactccaggacgaagcggcggcgcccccactagcagcttagctcgatcccccctccccacccctgcacgagtaaaacgacgatcggtgcaagaaacaacaaagcttgtgcagcagaggcaagtaggtagtacacggcaaccatcggacccccgcaagggatcaagatggatcgggggatatggtagtaagcttttgtacccgtggggtcgtacggcagggcggcgcggcggggacggcggctcgatcagctttacgccgtggcgccgagcggagcgagcagtccagcacgtcgccgacgctgctgacacggatcagcccagcttcttcttattctacaccatgcagtgcctggccccatgtctgtctgaaacctctgatcatgcacagcacagggaagtcctctctgctagagtagagaagatatactgtactgtagatgagtaggagtaaaatattgccgcctgctggatgatcatcgatggcgtggacactgaacaatagtgtacgcaatatttgctgaatacacagtacttgttctcggtaaggtgtggtgcagtactcctactcgtttcttccctggcgtcacgagacagttcgcaggactcggctcaatacgattctctcgttagagtacataatccctccggcctaaaaaaaaaaaaaccctggattttttttccaactttaacagttcgtcttatataaatttttttttataattcgtattttcattgttgttaaatgataaaacatgattaatattttatacgtgacttgtctttttaattttttcataatttttttaaatataagacggacggttaaatgttggacacggaaagcagagtttgtctttttttttttttttgacggagggagtatactcatactacagtacagtacagaggatcctcctaataagaagcaccagaggtaggtaccgggtgctgggcgtgtcctctcggtgctcccttgcgcggtgtcacagtgcaccagaacggagcaggtatcctgccttttgcgggaaaatggg

SEQ ID NO: 55441 - DNA, 8157 bp, Oryza sativa
  unsure (1)..(8157): unsure at all n locations
tcaaaaattagcgcgaagcttctattgataacatgtaaagaaaatactccctccgtcctattttaagtgcaactataagttttcgcattcaacttttatcatccgtcttatttgaaaatttttacaattagtatttttgttgttatgagatgatgaaatatgaatagtactttacttgggacttatgtttttaatttttttcaaaagattttcaaataagacagtcggttaaagttgggcgtggaaaatcgtggctgcacttaaaatgggacggagggagtaataataactagtatggtgacccgcacagattacgtgggtagcattcttttttctcgtataatggcgccggcatatatatttccatattttattattaaaatatattaaaatagcaacataacttttaaattatgcactaactggaccaaactaactaatgtgtactctcttcgtcccaaaaagaaacaacctagtagaggatgtaacccctcttgtccacatacattgtcctaggaggggtcacattccctcctaggttaattctttttggacggaaggagtaatatttatattgtactatatatgtgtgatagttattaattattttttaactccaatcttcttttaaacatctaaaaaagtattaatagtggcggagttgacggtgccatcaagcccgggtgactaataatgtctttcggtgatcgattataggtgccaattgctaacgagagtgaagatggcggagcctgggcggtcgcccaacctggccatgaagtggctccgccaccgagtattaagcttcttcccaaatgaaaaataagtgtgcaagtattacactttgaattggaggaaaaacataggaattttagaggattttaatcctataggaaaatttcctatgaagccctttgaaataaaggattgaatcctatcaaatccttaaaattcctatggaatggacaatcctatagagattttggaggaaatttagcaagagcttcaacctcttggtaaatttcctttgagtctatctctctcatccaattcctgtgtttttcttgcggttcaatcaaacggccattcctgtgttttttctgcgttttgcaatcctctattttacacttacatttctatcaaaatcctacgtttttcctattcctacgttttctcaatcctgccaatcaaaggggtgaaagaactaagggcccctttgaatcacaggaatgaaaaaacagaagaataggaaaaacataggattctgacagaaatgtaagtgtaaaacagaggattgtaaaacacaggaaaaatataggaaggaccgtttgattggaccacaggaaaaacacaggaatttgagagataaagactcaaacgatttattccatgaggttctacctcttgttaaaattcctccaaaacttgtatgggaagaggcattacataggaatttcataggattccatagggttcattcctttgattcaaagggctttgtaggaaaaattcctatagggatgaaatcctctaagggcccctttgaatcgcaggaatgagaaaacataggaataggaaaaacataggattttgataggaatgtaagtgtaaaacagagaattgcaaaacataggaaaaacagaggaatggtcgtttgattggaccgcagaaaaaacataggaattagaggagagataaagactcaaagaaagtttccaagacattttacctcttgttagaattcctctaaaccttgtatggtattaggcaatccataggattttcataggattccataagatccattcattcgattcaaagggctatataggaaaaattcctataggaatgaaatcctctaggcccctttgatttggaggaaaatcataggaattttgaaggatttaaatcctataggaaaatttcctatgaagccctttgaaacaaaggattgaatccaatccaatcctttgaaattcctatggaatggacaatcctatagagattttggaggaaatttagcaagagcttcaacctcttggaacttttctttgagtctatctctctcatccaattcctgcatttttcctgcggttcaatcaaacgttcattcctatgtttttcctgcgttttgcaatcctttgtattcctatcaaaatcctgtgtttttcctattcctacgttttctcaatactgcgattcaaagggggcctaaaatttctatgaatttcctttgaatcaaatggggcctaaaattcctataaatttcctttgaatcaaatggggcctaaaagagggaggagaaattaaatcctgaacgttccttcccagatggatggttggatcagtggctactgccaatccgttgggtacacggctactacacatcagtcttccgtaatcagtcggggtatctaatcaagaggatagagttgcgtggctactccacaagcctacaacgacagtggaaatgtagtagtgctacctcgtttgatccaccagcaccaatgtgggcattctcgatcggttccatgtgggctgttgcctccggacttccatcgatagattgggtaggataacgacctcacctcactatcgtttgtactgtcatttgatccatttattccgataaaatttagtttccgatcaaggtttcccgagattggtctactgttgtcaggacatatcgacgcattgtgccactggccaaccagggggagcctttgattgcacgaaatcttatgagtaactcagcccactgtctcccgaaaatattacaggctgttccaactttcaaccctgatggcgcaaaaatatcagtaaactgcacgtaaaatattcaggtacaaaattgcaaacgtagttgaagattaccaagtgcctgcgtcttttttactactgctgtcagtactgtcagtaacggattaacatccttcaactacaaattagagtgtgtttagttggggaaaaagaatttttgggtgtcacatcgaacgtttgaccggatgtcggaagggattttcggacacgaatgaaaaaactaatttcagaactcgtctggaaaccgtgagacgaatcttttgagactaattaagccgtcattagtacatgtgggttactgtagcacttatggctaatcacggactaattaggcttaaaagatttgtctcgcgatttcccccgtaactgtgcaattagtttttctttttatctatatttaatgtttcatgtatgtgtccaaagattcgacgtgatgtttttggaaaaaaaatttggggaactaaacatgcccttaatggtttgtgttgacttgcctccttgcctgttgtcataccagtatgaagtactactccatatgctagttctaactgccgtatgttacgaatagcatggaatcagtataactgctatactactttcatgttgaaaagtttgtgtagtaagtacaactgtgcaagtacgctgacgactattcggtgttaaatatgccaatccagactccactgtactcctccaatcggcgttcattccaaatggagcagacggtacttaataatgtataatgtttgctaaaattagaacaaacatttctctgggccggtcagagacataaggctttttttaacggttgatgatattaaagaagttataaaaattacaaccctgatgttgcaataaatagaaatacaagatttgccattaaataaaaaaattccacatctgggaatactaaataaatgcgagcaaacgatctaccaagctgacgaactcttgtacgcgaaaaataaaggaaggagtgtcagccaccatttaatcatattggcatgttcctttagcaaataagcaaaccgatgcaaccaaataagtcaggcgacccgaactctaaagacaacgctccgatcactattggggagggtctctttcccgctcagtaaccccttatagttttaggttacaaaccaggacacctatctttagtttcagttaaaataatcaggagtaaaaaaaaatctttaatccagatcagtaacattaaagatggtagcgccatctttactccagttaggctttttttctttttttatccttgttttttttgttgcttgcatttattgtcaccctcaaatcccaacaaatcatccacaatttacaagtccatccacaaaatcatccataatccacaagtcattcacaaaatcatctccaagtctgaaataaactacaacaaaatttacaaattgtttcaaaaatgaaaaaaaaatcacaaaacacaggcggcccgccgtgtgccgnctnccgccacccggcctcccatcccgtcagatctggcggaggggaggccacccggccatgcgccgcctcccatcccaccgccactgccactttagcggtccagccgccgcccggccaccgctagaggagaggccgccgcacgcctgccgcctcgtgcgccgccgcggtggcttccgccgggctgccgcccactgtcgctgttgtcggaggagggagtagggcgaggagagaggggaaggggaggaaggggaggaggtgaaggagagaaaatgataggggaggagatggagaggatgagagggaaggagaggatgagaggggaggaggaggggataaggacgaggcacagctagcgcgcgcagctcggggcagggattttcacaattttttttattttagtcccgagcggtataaataactggactaaagatggatctttagttccagttggtaacaccaaccaggattaaagataaaaaaaaatatccgtcggttttcaaaccatgactaaaaatatttttaatcccggttcttacttaaaccgggactaatgtgatttttgcatgattcagtaaagatcatttttccagtagtggattgatttgtcgaggatcttgccaaagaaataaccacaaagatatatgaagaggaaaaactctaaaaaaccttaattaactccaaataaatcacagacacaaggctgtttaatttgccgtgctcttgtctttgaaagttttctctgagcttggacttcgtcattttttttcagacatcttatacaaaagcaattcattcttgcgttgtaaagaagatatccctttatatttagttttttactgatagattacctagtactacctccgtcccaagataagtgcagccatgaatttacgcgtccaactttaatcgtccgttttatttgaaatttttttataattaatttttttattgttataagatgataaaacataaataatactttactcgtgacttatgtttttattttttttcaactttttttaaataagacgaatgattaaagttgggcgcggaaaaccatggctgtacttattttgagagtagtacccagcgcttaggcctgttagtctccaaatttttttctcaagaacatcacatcgaatctttggacacatgtatagagcattaaatatatatttaaaaaactaattatacagttagaggggaatagcgggaggaatcttttgagactaattagtccatgattagccataagtgctacagtaacccacatgaattaatgacggataaactaggctcaaaagattcgtctcgtggtttccaggcaagtgatgaaattagttttttcattcgtgtccaaaaatccctttcaacatccgaccaaatattgtgacatccaaatattttctttccgcgaactaaatatgcccttacatatataggacaaatgccatgcccttttcgcaaaattacaacgaaatgataatgaaacgtagatatggtcatggtcaccgcctatgatatggtcatatcgcacggtagcactgacacgcatggccgaatctgcagctcgcacacttctttcaattattcttatctacgttcttaatatccgtgctagttaaaatatacctactccctccgcctaaaatatagctatttctagcagtgtcttgtcccaaaataaagctatttcttcacctacctcctctcaaccaatcacaaccattcttcttcacctactttcctttttcaaccaatcacacacttcctccaatcattctcacctactttcttaatacccgtgccaatctcaaaaatggatttattttgggacggaggaagtacattttaagatggatgaagtactgtatactcctaatactccctccgtccaaaaaaagacaaaacctggtttccgtgcccaacgtttggccgtccgtcttatttgaaaaaattataaaaaaaaattaaaaagacaagtcacacataaaatattaatcatgttttatcatataacaacaataaaaatatgaattataaaaaacttcatataagacggacaatcaaagttagacacagaaaagtagggtttgcttttttagacggagggagtactatgtagtaactggccagtgaccactggtacatagtacgtacccagctacagttcatcggacgctggcaagcacgagcgacaagacggccgctgtagaatctacagtacacacttgacaggccagtcgtagtcggtcgcagcaccgccgtgcggttgtgtccgagtccgaacggagaaaccacatgtgcacttgggactggagcacgtctgcacttgcctgctggcatcgtggagcgccgagcgcaacggaaccatcaaccatcacagccgaatgccctgtagctccttcaaaaaaatttcgtctcttggaagctactgtaactctgaaaggcttatagttcagactcccaggccgtctttagttccatgcctattttttttacatatacggatacacatttaaagtattaaaagtagtctaataataaaataaattacataatctacctataaactgcgaggcgaatttagcctaattaatctatcattagtaaatatttactgtaataccatattgtcaaatcatggtgtaattaggctcataatattcgtctcgtaattcacatgcaaactataaaattggtttttttccacatttaatgttccatgtatgtgtctaaatatttgatgtgacagaatgtttgaaagtttgaataaaactaaacacagcctcagtcactcagaacatatactacagttttggtaaaaaaaatgtatactacaattagtccgtccactgtagaccaaacgtactccgtatcatttatccatcagtgacgagctcacaacagaagttatcaatcgtcctgtatgtacatatatcgtacaattcggatcctctaacacatataatactataattttcaactaataatatagttaatactccctccattttaaaatataagacacaaccatcttaacccaaagaccaaaaaaatagttattactcatctcgtactttggatcatcctaataaatataatgcatgcatccaatagagttagagaatgtgagagtaaatgattttaaaaaatagtaatgtaatggagaatatgtcatatttaatgacatgcatgcatgcatgtcttatattatgaaacatatgaaaaaaagtagttgtgtcttatattatggaatggagaaagtacccgctaaaacaagtaaagattaaagattaagattcagtggggagttccgccttcacatccacacttgcactcgatgtatatgctcgcaagaaacttctttctccatttcatattataagactttttagcattgtatatatatatatatatatatatatatatatatatatatatatatatatatatatataaataaatctagacatatatgtgtgcttagatttattaacatctatagaaatatgggcaatgcaagaatgttttataacctgaaaccatatatatgttaataaatctagacatatatgtgtgcttagatttattaatatctatagaaatatgggcaatgctagaaagttttataacctaaaaccatatatatgttaatgaatctagacatatatgtgtgcttagatttattaacatctatagaaatataagcgatgccagcggtgtgcattccctatctcaccgaggtaagtcgtcgaatgggattcgttgtgcagtttatgtatggagcctatttggagctacatttggtgttatagtgtggactactccctccgtttcaaaatgtttgacaccgttgacctt

SEQ ID NO: 55442 - DNA, 3342 bp, Oryza sativa
ccaccgtctcgtcctggagcacctccacatatgtatctgtcttgttgtgtggcaacggtggcgcgggcgtccagcggccgtcttgtcgtgggcgaacggcggcgcggtaccccggcgtggcgccgcgggcgtccagcggcttcggacacgcttggctgggcaccagccgggagctcggaagtgaggaggacgcggatgatgtggatagaggggaatcgagggagaagagagagtgaaagggcaagagggacattgttccttcccggacccacatgtcagagctgccaaacagttaaatccaaacagaatagcgacggaatggggtggaggacgcgataaagttcgacgatggcacagagaaagactcgaactttttagtggcaccgaggcagacaccatctttcttaatagcatatagaaaaaaaacctctgtgccttgtggggtgcagccttgcaggtaaaataccgttccagcgtgcacggcacaagatggccagacactgggtacataccaggtaaattctcgtacacgcatgtggcccttggcacccttcggcagtcagctagagcgctctccgatgataaacttttaacgcacgtagccagttgagttgaatgctcaactgctcatgttggcgtcggcatgcaccaccacccacggcggcctgcattaacgcatgttgcacgcgctccactccaattcttcgctacacggtgtgagccccccaacatgccacaccactgtagaagtgtagagtggactgtagagatctcccaccgtcgccgctccagcacagagatcctgcacatgcggacagaagcggaagcggcaccagtggcagtggcagtaatgggactgaaaggcgcaatgaaaccgatcggccgttacgcatatggtgatatatactgatacggatggccgacccctaccgagccctcccatccgttccgatccgcgccacaaaagcagtcaaacgcaggtgccgacgtgccttacgtaggccgtaggcgacgcgagccatgggtgttgccgtgttgggtgccatgcccatgccctgccctgcgccgctcgccgacgcgtgtgcttggcgtctgcagggaagcgaagcgacggccggaggacgggctgtttctgagccgggcctctgctacctgccgcgtggcatgcagttgcgcagcgcagtacgggttggcgggcgaggtgggcctgttattggcatgttgagagcaagtataataccaactgaaacaccgacgataggactgccacgttggataggatgacgagctggcactgagaaggaatgagagagaaggtaagttggcgattacagtgtcaccggactgcacacacaattcaagaaaaaatgatccttagtgcagcacgttgagagtagacatggttgagaaagaaagaatataatagtatttatatgaaaaatttatagactacttactgtaagtgttggcttttagatcgacggtaaccaaggaaataaatttgagccaccgatgggcgctactattaaacctgctctgatgaatgcacgcgggcctactactccactactcctgatgtgctctcgtaatcgttcgtacgctggttgagtgggcgcttcttctgcagttctgcgtcaggaagtactcccgtacgtgcaccacacgctagcagctggagtgtgcagttgtgcactgcgcctatacgggatggaaacctggagagggcggggccacatatacttctgcctgcagtatcagttctgctggtgttggttacacagtggcacgtacgttcgcgatcgtacgttagccgtgggtgttggttacaccgtgacaccgtcgctcagtggtgttgcaaatgtacagtgaactagtgatacagtggccatcagtgtgtccgtgcgtgcagtactaatgtgacggccttaattagattcgcggtgtgggcaaaatgaactggaaccgatcgaaagaccgaactaaccaagtgtgtaaaaactggttaggagttcgctcttcagttgtaactagtcgaatttaatatggtcatttgagggtgtgtttgcgaaggaggggattgaggagatttgaaagatacgtaaaacgaggtgagccattagcacatgattaattgagtattaattattttaaacttcaaaaatagattaatatgattttttaaagcaactttcctatagattttttttttaaaaaaacacaccgtttagtagttcgggaagtgtgcgcgcggaaaacaaaaatatctttctctctttctcctgcactcgaacgcagccgagtccctgcctcagtcaaacgaaaaaagaaacaaaattgatggcacaacccaacagcagcaagtacatgcatagcccagcaatattaccagattatgaggcacaactctaagggtgtatttggttcacggttaagattggatgggatatggcggtccatattttgttggatatggcgatccagttttttgtttggtggagtgaatatggcgatccaaatttttatttggttgtagggatgaaggtgaatttggtgatctttttttgttagggggagtaggatggatgagtggatgcaatcacccctacaataaaggtggtgagtatacccctttaaattcatcaaaaacacaaaaatataaatcactacaaacaaaaaaaatctcaagggaaatatcagaaattacaaataaatagaacagaaacagaaggggaaaggaaaaaaaagaaaaaaaagaaaaaaaaaaatcatccgcgctcttcttgccggccaccacctctggattctccccctcgcacgccggccgccgcctccggtctcgcctcctcgctcgcacgccggccgccgcctccggtcgccgccccatctcctcgctcgctcgctcgctcgccggttgacggcgatgacgacggaacccgctagatccggtcgccgtcgcctcttcccgctgccgccgccgtcgcctcttcccgccgcgtgtcgcgctcccttctcgcactggccgccgtgctcgtcgccgttgtcgcgtggtggggggtgacgagaccctgctcgcctcgctcgccctgcactcgagcggctgcccggatccctccatccggcatatcagtggaatattccctgttgggccgcccgatcctatccctatccatcaaccaaacacccacaaaaaatgggcgccatctcctatccacccaaatccctccatccaaacacaccctaagcctacaccctcggttcacttccttagcacaacttaaaaagtggatttgtttgattttttaagaaactataacatatattttttaaaaaagattgtgttta

SEQ ID NO: 55443 - DNA, 11210 bp, Oryza sativa
ggtttggctgtggagtggagtcgcccgctgctgaagtcaagcttcccggtttagctcgcttttatcttttccgctgcatttgtaatcttttctatttttgtaaggcgtggatctgtatgtcaacaattgtcgtttgtgtaccctggctggtcctggacagggatttaatgcacattcagcttagaaattctggctcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagttggcggtcgatattatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcagatggagataaggaatggttcacgcgactcgaacaacgccagtggtagcgaagagccgatcaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcgtgagttcaacctcctcgcgcgctacgcccctgaggacgtgcgtaccgatgccgagaggcaggagaagtttctgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacatcacggtggaccttccaccatgattatccggcagcaccgtccctaccacccgggtagattcaacaagaaccaccatagtgacagtcacaacaatagtgagcagcacagcctcaaccctactccgagttcactaaagattccagcccaatcagttcagccagctctgccagaacaacccaagaggttgggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaagctggaggatattcccatggtcagagagtatccagaggtttttccggatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggaaaagaaagacaaaaccaagaggatgtgcgtggactaccgcgcactcaatgaggtcactattaagaacaagtaccctttgccaaggattgatgatctgttcgatcagctgaaaggagctactgtgttctctaagatagaccttcggtcaggctatcaccagttgaggatccgcgaagaggatattccaaagacagcattcatcactcggtacgggttgttcgaatgcacagttatgtctttcggactcactaacgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagtcgttcatgctttaaagatctggcggcactatctcatcggtaaccgttgtgaggtatatacagatcacaaaagtctaaagtacatcttcacccaacctgatctgaatctccgacaacgacgatggttggagctaatcaaagattatgatatgggaatacactatcatcccggcaaggctaatgtggtagcagatgccttgagcaggaagagttactgcaacgtcgcatgggtagaggaactatgctgtgaggttcaacatgatttggaacgtttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagaccttaaagaaaagttctggtgggtcagcatgagaagggaaatagctgagttcgtagcactctgtgacgtctgtcaacgagtaaaggcagaacaccaaaggccagcaggtttgctacagccacttcagattccagaatggaagtgggaagaaatcggaatggatttcatcaccggtttgcccagaacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgactttggtggagcatgggacaaaagcttgccgtatgctgagttttcttacaacaacagttaccaagctagtctacagatggcaccgtttgaagcactgtatggacggaggtgtcatactccgctcttctgggatcagacaggggaacgccagttgtttggtatagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagcccttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcacttaataatcggaaatagcgtggtggaatttttcttgagttccccatgctccaatgcattaacaagatttttagtggaattttcagagccttggaaataattttaaccaattaaaaatgagcaagcgcaatattttaatcccaggaaaatcctttttctctttttcttttcttttccctcctttttctttgttgggccgtcggcccatccctctcccgcggcccctcctccttgtgggccggcccaagccgcccctccctcctctctcgggacgccgacaggtgggccccacctgtcggtcgtctcccacctccggccgctggagccgaagctccaaccgctgccgccgaaaccgccgcgccgccgtcttcttcgttcctcccgcgtccacgtcgcgcctccactccgcgcccgcacctcgcgcccacgtcgccgccctctccccgcatctcccgcgcgcgcgcgcccgcaagtggtgggggatttgaaatccccaacgccctctctctctctcctccacctctccacgttgccggccaaataggggccatccccggccgtttccgcccctccctcgcccataaaaaccctcccctgagtcccctccctcgtttcccccatttgccgtcctctcccacgccccctaccgcgcccacgccgtcacacccgagctccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgtgagccggtgagtttttccctcccctccatctccggccggcaattcaagccgccgtggtcgtcgtctcctctcctaacgcctctccatcttctcctagggtgtcgccgccgcccgtccgtgcctccgcatcaccggtcgccgccgccgctttcttccttcgcgccggccgccgtgctcgaaggtgaggaatcccctctcctccttcctttcctctctctcccatgagcgccgccgccctccgcgcgtgcgccatcgtcttcggccgccgccgccgccttcgcgccggtcgccgccgtctcccgcgccgccggtcaccgccggtgaccacgcgtgccgccgccgccgccccatggctggccggccggcttgagccgtgccgagctgccagccacccactccctcccccttgagccactgcccagtgggcccgcttgccagcggccccctctccctctcttagtgccgctgaccagtggggcccgcctgtcggcgcccgccccccttccgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatagttttgtttcctgcttcagtagtcttatagcctgttttgcttgtgtgctttgtttgtcgcgtagatttcggccgtttcgtcgatccgcagttcctcgaagacgttgctgaggtctcatcagttcgagagcaaggcaagtcatgcaatacgtttgatcatattgtacccaatttacaaatatcccgcatttctattaaatgttgcattcttttacaatatcatgtgggatgggtccgactactcagccatttattgtttaccatatgccattgataacctgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacattgaatggtgggttgtgagtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatgcttcggggcatggcgacatgtgtggaatcgtgtcttgtgggtacagttgtacacctctggccagagtaaaactattcgaatagccgtgcccgcggttatgggcgatccaccagattcaccgtgattagtctcacccctagtttagcttaatgaactggtgtagttcaggtggttggttgggcctgttgcaacatggtgtagcgttggacagtgattggttaatattgattaattactacaactgttttactgctttcaactactgcttttaaatgctagctttatgcaaaagaacctctagcctcctgtggttatatcctgcatcatacctcctcttccggtatgacttgctgagtacagtgggtagtactcagtcttgctctcttttcccccacaccagagttgaagttcttctcagttggagccgtctcagagaggttggtttcgttgctgccgtcaaggtttgcctgtggagtggagtcgcccgctgctgaagtcaagcttcccggtttagctcgcttttatcttttccgctgcatttgtaatcttttctatttttgtaaggcgtggatctgtatgtcaacaattgtcgtttgtgtaccctggctggtcctggacagggatttaatgcacattcagcttagaaattctggctcgagaatttctgggcgtgacacgtcgcgcccgctccgccccggccgccacgcacgctgcccaccgccggcctccctcaccgaagaagagcagagagaagtgagaagaaaagaagaggagaagaaaagaggagaggacggctgacatgtgggccccacatattttttaaatttttctttgctgactaggatgccacatcagcgaaaccacccatatatgtgttaacaaccaaatttggtaatatcggcatcgggaaagaagattagatcgaagcaaagtcggaggcggagatcgggttcggaaacagagcaggaatcggctagagtccagatcagctacgattaggatcggctgggtctgagtcggactaggtaagctgatgcagccgattccggcaatgcgacttgatgtatgatatcgggttgagttgaggcacttcaaggtgattgccgcacatggatagagtcctgagaaggcaattgtatctattaattaggatgttttatgtaatttctttagagatacgcttgggcaaaagtctaccgtaaagacttatggtatcttagagtttgttagagatattagtcgtgtccgttatggacatatattgtaattctcgggtataaatagacccgagccctatgtaacttttaacacacacgttcaatacaatttcggcacatcgccactctttttgctttagttttgtttcgacgagttcttactttcgggttgagctgcatcggtttcaatcttcaacaagaggtaaaacttattatgacggcttgtattctcgggattagggcttccatctttatgacactctaatcttgtttatgtaattcgttgagttatcacatatcttacataatctctggcaatattgttatctaacctacaatcggctaacatttgttagtagagggcagccgattaggttagatttcgacgttagtttagattatataagatatctaccactctatgaaacttctagtggcttgattgtctagatattgttcttcttttcatacttaatgctgcataagtttagtttgatctattaagtcgtgcttagaatattaatctctagcctgccttttggttgccgattaaggtagcatcggagtttcagccgatcttatctgatttaactatatttgctccatatgcttcattgacatgttaaatccgccctttatgtcaagatattgctgtatctaagtatattaagcctttgtttgatacattattcctgttttaatatcctgatatagagtagcatcggagtattagccgatacatgccagatctatctgattggctatgctataaacatatataatcatgttattaatatatatttcgatctaagtgatttatactgtctcggcatggcgaccgatctatcccaatcacttgatttaagtatatatcgatttaaggagtatatgttgttaatatctacagccgatcgagtagatttagttccttcttatttattcatgaatgacgatcgattcacatatgacatcggcccaaagataaatgatatgtcatcggcacctagccgatcgattatcatttatagatttaaccacggtttctttactcctatttcttgttgattacatgatcaaatcgactggcacgctcatacattcgaatgcgagctttggacctgcaccggagttaagcagatctcccaggcctcgtgttttctgtcaacaatatgctgccatgggacctcttttgaacggtttgagtgagtttaggggtacacattaatttctggttttgtggttaaaggacctcagaaaatctcgctgtcaagttgagagacctccggtgaacttattcctaacccaaacgatatagccaattatccaagatcaagggcccaattactcgtaactggacttaatggcccaggccgggctgcaaatgcaaagcctaatagtggtgaaacaaggagaggagagcgttttgggttcaggcccgcgaagcagcaggtatctgccgtgagcatatggcagcggagggatcagagcttggctccccaccggcggcggcggcgccgcctcccaagcgtcggaagatcgagccgtcgcggaggtaccgattctatcttgttcacggcttcttgcgagccttttataattaggtttgatctggtgattcctgcttcgaaccatccccatccaattaggtggatatattacattattacgcctgatttctagcgattgcgctgcgccatctttctagtttcgagcagattggaaagggaggtgtggatgttggttagcggggtggggcgatccagtggtgggggatgactacaagtgtagggttcttttaggcaagattccggactaggtgatcttgtgagcatctctatacgttaggttttggtgttcttataaaggggctttggaatgtggcgttgtgcgtttatctatatttcggcaaaagcctcgatattcccacggaaccttgttgattgaggcgaatctctcgaggccttttgcatttctgccctagacagataat

SEQ ID NO: 55444 - DNA, 2623 bp, Oryza sativa
aaggaattctttctgccgtaacactcatggttcaggcacggtgaacgctgatcctgaagaatctactatgttgtgcgcatactgcagaatggaaaatttctgccttgcttcccccgaatgaatcattatcctgttggtccagttctaaccatatggactgcagagtacagaatgcattgtttcacataaagagaaagaccaaacctattcaattttgtgtttgatacttgatagatcctttgcagatagtttcgataggcttgtgctttgccatttgttgtttgcagcattaaaaccatcaatcaaaattagctacactgtccgctaactttacattggtgtctacatcggattgttagtgttaggttttgtggcattaattgacagcctgaatgggctagaaggacatatttgcctgagttgtgaataacaccagcaatttactggctgataatttgcagttacagtaacaagcacaacgtatttcattttcctattaaaaacaggatattctactctaaatgattctttttcttgaaccacgtttttctgattagtactatataatttggctcaaactattttttgctaatcaataatttaccctgtgattcgaaacacagggacagaccttctcaagttgctctggacagggacaaggacaaggtggcagcatcatccagttcattggtatgccctgacatgtcaatttgcaattgatgccttctcacctgttcttgattttctctaacatactttcttgacgtgaactctgcttttgcaggtttcaggtacaccaccgttgagagtggatctcaacaaagttagagaggcaaagagatatgctgtctttcaagcacagcatgaggggtgccttggaagctataaaagttttgattcctcgtttggtaattatcttgtccccgtcatcccaagcaatgacttctttgtgcaaattacaaataaatgattggcaataaacaaagtgcaattctacgccgtgaatcatgaggatgtagtttctgttctgtcatgttatatgtggaaattgtggtactaatatttcaaactaattctaaccaaccagataacagttgaaagttcagaaaaccaaactgcatgctttcttttacttgttgtaaataccaaaaccttctaatttcttagtaaaaggaactatctagattggtgaaaactgaaaagggtttgtattgtggaagcatttcttagtgtatatctggacctttccctatctttcttttatttttgggtgggaattttatcagcttcatatccttccaatcccatgcctccaatggaatgtatatctggacggcaatcattttattcttgtactcttccatggcctaaacaccttctcaattattgatggggctctttctgacattagttctctcctctggccctctaggctcccagcaaatcaaatatctgtagtactgaagaattttggcaaccaagtatatccatgcgtgcaatgcccccggtgataccgtactgattatttgtcggtcaactaacttgttgaagcgctagcagttaaggtgtccaagctgtactaacatgcttacttctcatatactatctagcagttaaggcttagctttcactgcactcgttttccacaaataatctccatcgttacattataaaactcaagcttatctgattaaaagatatgatcagcaaaccagttgagcctatgactaatggctttagggcctatatcacgttttgcgtgagagtgattgtgcgaaagctgtttctgacattgactaatcaaatcgtggaaggtacccatagatatgcgcctttcaactcttcgtccttgttagcttatcgacagtaaccaaaattttaatcttcacacttaattttagagttatttaatcgtaacacatttcgatatttttaagtattaacttttaaaccactaagaacatagatatagtgttttacctgtaatttatctaaaactgtttttcgttgctttgttcactgctttttgttgcctttgttgttaaatataataatttttaactataaatttagatatatatttgtttagattcgtaattaaaagttgttatattataggatggggatagatgttttattagcagtagctaaaacgatcgtgagttttgggtgtgcggcgacccatccgagcgtcggccacgacgatacgtagtgggccggatggatggatcgctcgctcgctacagtcgtgaattatcgacgcccacgcccaagcgcgagggaagatatgtgctcagagtcgctgagcacgcatctccaggcagccggccgttgcttcatcgacacgtatacttctgagctcatggtcacgtcatcggtactgcaggtgggccccaacgtgcacgtgacccccgtatcataatcacgtcctgccacccttttaactaatcactcccagccttttgctgatcggtgggcctagttgcccgagttctgacaaagtaatcagttggacatttggaactgattactcctactactctagtgaaaattagggaatttgacgggaacacccttcttggctctcctaaatgcacggccggcaggtgccatctgctggtcc

SEQ ID NO: 55445 - DNA, 1080 bp, Oryza sativa
gaaatcctctgtgaaaaaaaatgagaagattaaatttgcggtgagcgtggatcgaacacgcgaccttcagatcttcagtctggcgctctcccaactgagctatccccactaacatggtagattgcgcatttatttgtactgtattatctgagaaaaaacatgcctatggacatcgcacgcaatgctcataactcctttacaacggtactcctgagttctgacaagtatatgagtgaactgatgaaagtgaaagcccaaagttggtaaaatggagtacttctaccgtgactgatgaactgatcctctcattcaacgaaacctgtgcaaccgcaagaataaaggactgacctgacaaaaggacgctaaacctgcctgatttaaagcagttgaaacaaagcaaagcgctttgctgttccagaatatccttaaaaagaacgcagaatgatatttcgaaggtacacagtgtatctacttgcacctctgacacaatgatggctgatgcagcatcatgccttccaccctctccctctttctagctggcatctggctcctcttatcatttccccttttccacaaagaaaaagaagcttaaaatccatggccctacaagaacacaagaactcaagcaccatttctccatgccaacgcgaatcacataagagttcaagccaaagctaagaggccatgagatcagctatggctactgcatcggtggttacctatcttcagaggccgagagagcttccggtgccggagttccgggcaccgccgccgtctccggtcaccggcgtcctcacgagcagtagctccggctctcttgcatacggcgagtgccccgatagcaacgaagacgacgagatcggcaggttcttgcgccgctccgccagagtcccggtgctgcggctgccggagaggccgtcccgcggaagaagaaagcggcgtgggcacctccggtcatcgacgtgcgcctgctggccttgccggaggccggcggtccggtggcggaggcgctgaggtcggcagccgtcgcgtttggctgcttccaggtggtcggccatggggtcgaccggagcttggtct

SEQ ID NO: 55446 - DNA, 6126 bp, Oryza sativa
  unsure (1)..(6126): unsure at all n locations
tataaaaaactcgtaatctagcatgtcgatctacatgcgaggtttgataattttgcagaattcgtcacatagtttagatcaaacagtcgatgtgattgtcagaatttggaccaaaagaacgagctaagatcgttgtataatttgtctagtccaaactcacaacactaaccatttgattttttttgtgcccaggaacacagcagacgctttgttcattcagctggagcaaaccgcaaccaaaataatggacgtcctgcagcgaggcggcgccgttgccacgcaatccatcgccggagctgacacaaacggctcgctcctctgcatccgcaagcaccgccgcaggcaagacgaccgcagcggcggcgcctctggcccgatccgccacgacgacatcctgaggatgctggtccggagctcgcggtgctcgcgggccctcgccctccacctctgccccggcgcctcggcgttccacatcttctcccggcgaggctggtccagattcaggcccatggacggcgccgtcgtcgtcaccgtcggcgaccagctccaggtcacgcgtccgatctcttacagctccaaaccgtttctcaaatcttaagtttctacctgcgacgagttgacgacgcctctattgtctgcaaacaagaaactgactgaactagcagagctgccatgtggacattgcccgccgtcgcgtcgcatctgcaatcatttcgtcgccatgattcgttctctcgttacttacctgtctcctcctccggctgcgtgtatgcaggcatgcaacggtgggctctacaagagcgtggccgggaagccagcgtacagcaatgacgacctccgaggaaacggcggcgacaccggtgtcgcctccgcggagttgttctactgcttcccttcggccggcacggcggctggcaaggcgagcgaggtgttgagcgcggatgccggcaagatcatcccgttgaacctgcagttcatggtggctgcttgccttgtgcttggataccactttctcctgtcaagcttgcattcgacttggttgttgtgatttgtgaaatacaggacctgttctctgaatatgcaactcggctttgtctgtacagtttttgtcagtcactactgctcactataaacttggtgcctggaaaatgatcgatctacctttctggactctgggaatcaaactcaagagtaagatgagttcagtacgcatgtcatgaaaatatcatagatttgaaagctcaaggctttcgtagtccaagccgagatgaaggcatcaaagttaccagtccagtaaaacaaccaaaaaagtgctaaaacttttcccaaaaacatcacatcgaatctttggacacatatataaaacattaaatatagataaaaagaaaagctaattgcacagtttgcatggaaatcgcgagacgaaacttttgagcctaattaggccatgattagccataagtgctacagtaactcatatatgctaatgacggattaattaggctcaaaagattcgtctcgcggtttccaggcgagttataaaattagttttttcattcgtgtccgaaaaccccttccgacatccggtcaaacatctgatgtgacataaaatttttcatttcacgacctaaacaggcccttatgtttcaccgctggagctgctgaaggacgcagattagaccgaagatgtttaacaaataaagtactgtacaggtcctttccctagatggtagattgataatacacggtaacgaccttccgatgttagtaaaactgaatactctagttgattggtggtgcaaggccttgatgcaacatgcataatcgataaaattgtcacgactattcacgagccccaagttcagagggacccagatcctaaatggaaagtactactccgtagttatgttcagtctaatgtagaaattttaaacaacctggcatcccaggttccactagcctagagtatatagtattatgcacggtcgtttgtctcatttggaacataccattttcgaaaaagatttctttaattttgcgaggagaaaatcaattcgatgtagaaagagaacaaaccttttaatctgaagaggttttcggcaagccagcaacagcctagagttacatattatgcatggtcgtttgtctcgtttcgaacacaccattttcaaaaaagatttctttaattttgcgaggagaaaatcaattcaatgttgaaagagaaccttgtattctgaagaggttttcggcaagccagcaatagcgcattgcgcacaggtgaggtgaggagatggtaacagtaagtagctcataaggtggcgagcaggaacctcatgctttcacacgattagataggagttcaatcatatcggacaggtgtacacatctgacaacgccttgcactacaattaacagtacactacatgaacgattacacgaactacaaaaacatttactactgtacaagctcttctataattaagaacgatagccattaaatatcttcacgacagcacgatagtcagggtacgctaagtcgcattcagaacttgccagcatcacataagccgctgcactctgagcagagaccaatgctagaagcctagaactcgaaatggcttcaactagatggccagatttctaggatacagtacgtccatagcatactgatgcaaggtagagattcttggaccatttctcctggaacgagacaagcatcactctgtcagagcaaagtactaacggcaaaaactgccaagtacgttactagtatatgaagcagacgaaccttgacatgttgactagggaaagcagatgttctcagcgtctcttgagtttcatctgtaggcttccttcttgggacgcttaaaacgaatgcagcctgatcccaggttgcagcagttgcagttatccggtaaccattgtcccatctctggtgaattccctcactggggtataggaagtccagttcgacaacctgtaaaataaatgcaaatgcatattgtcaaacaaatgtaaatattgatgaacaccattgcagcagaaagaatgctacctgatcagaaaatccagcattacgcgacataacaactgcccatctacttccagctgttgccatggaagtcacataaaaaccgtccctccatttcttgtttatccatttgaaagggaaagtatcacttactttgtaggattgttgtgtatacattgttcctaaaaaagcatgctaagttagtcaaagaataatttatacattataagacaggaatagcactgaaacagcatgctttaactggttaccttttgacatcactaccagggaactcccattatttgctccagcaagtgcagttatatagtagttcctttcccattggtccataatccattccttcaaatgaccagaaaaccatggaatcacatttgacaatgtatacaagagcttccttatatgtaactttgccttgaaaagttatgtgattagtttgctaagattttccaccagttaaacaaggagcaagctactcaccttgtgaagaaaatgtggtgaaagttcataaacctgggaagtgaacccagtgccagcatccatgattagagcccacagatttgagcaagatgttatgcaactgataaacagaccatcttcattccctttgtcaatgtgttgtacaagccttgaatctgcaacgttgtagtgatacctgcaaaatatagaacatgtatgttgcattgtactgcattaacaaaggtggatcatatagctaactataaactaaaactttcggcctcataagaaaaagtacctttgtttcataggccgtctggcattataaacactaatccactgtgttgcaggcatacccatcctgatcttcttctttggttgttcatctgtctcttccatcaataagcgacctctcttttggccaactagatgtataagctttagagaaattacaaggaagattagtgcaaccaaagtcatgatttttaagcagtataacagattgcaatatatgattgtattgtaccttctgagcaccatcggtgttaattggcctgatatctggatttgggcccactacagtatcgaaaagggatatacactttgcatagttaggttcttcatcaaacttcaagttgaccacatactctacaaactccctaaagggttgtgggcaaaagcagcacaatgattctggagacgtagccattttctttttgcacacaaggaaacccttgttttcaccctgcaggcacacactatcaattatttaaatgtattactacaatcagaataaatggaatggtgggtccggcgaattacctgataaccttgccaaggtagacgcccccgtagaagaaaaactagtgtgtaagctagagattctaaatcatcccttcggctaccgattctccctagatgtgcatgaacactagcatagcgaactgtccccctgaaatagcagcaaaagcaaggcagagttactgatttgctataagcctacaacatgaagaatgagttggcattcaagacagaaattagggctctatttccatgcagaaacagccagtcaccaaacataatagtgaggagtgattgaccagcaccagtgccagccgcatttagtgctgttgagaagtaatgaataatggttgtacaggaacaagcagaatgcggggaaaaaaaagataaaacaaaatttaagtgaatgaaaataattgttggccagaaaccagtacaaagggtgacctgatttggctgcatcctaggactcaaccaaaaacaggaaacagaacctacgaaggaaatgccacagagcattcaatattatccataaaagcactagcgacaatgtaaatgatgcctattgattatcataaaatttccatctggtcacctgaaaacatcaggtcgctggtcatagtcaacgtggaggccagttgaagcatctctccacttggtagctgccatttaaagatagattaaactcaattaattcagactcctcaatctgctgctaccttaaaacaattgaatagacaatgatcgagcagttggttaatctgtgaagatttagttacctaaaccaagatcgacaaggaagagtctcttttcttcaggagttccaataggccctagcaagaaattttcaggtttcacatccccatgaacatatctgcgattgcaaaacattttctattacaacagaggaaataaaatgtattttggtggggaggggataataataattagagagatggcaccaacccttttgaatgcattttctcaagtatggagatagcttcaatagcgatgcacgcaaccatctcaacagacattctgaaaaccaaaacaaactatgttagtgataaattagaagtctacataaatgttagctaaattggaaaactcacgtgtgagaattattattccaaacatcccaaagactgggtcccagcatatccataacctacatttttcataaaccaagttaattaaaattttggaaagggcaaaaagaaaacagtttctctcgtagtagtcaaaatgaggtgtcattactataacatagtattcgccttgacgtcctttatagtggactcgaggaaccccatgaatgccaccgatggcgctgtatatacgatggccatgataaaagtcaggtacctatatatagcatgcaacttgctatgcataatggcagatcatgaggcacatacttgtaaacctgccattcgtaaggaggcccatggttgcatcctttactggttctatgttcaaactttagcgccacctaccattcgaaagcacgatatttattttcaaccgttaataccatccacggttacaagtacagttttacaaataggctggcactaaatacctcagaagcacctggaccgttagctaacatgcggcggccaacatatacttggccaaatcctcctttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55447 - DNA, 1154 bp, Oryza sativa
attcctgcagccccggatggaatttgctgggattgctttgaattcgtgcacgacgccgtcgatctcgatgaggctgcaggcagggaccttgtcgatctcgcttctcctcatctgcctcctcaccttgaccgcctcaccatgccggccattcaacgcgaacgcgtacgtgttcgacatgcgtcagcgtcggccacgcgccgtcgcatcacccgctcggcgcgctcgacgtcgccatgcgcgcggcaggcggcgagcagcgcgatgagctcctctgcctcgtctagtctcccggcgcggctgagcatatcggcgacgcagccgtagtgctcgatgcgaggttccggcatggcgttgagttgctggagcccctcctcgacgagtccggcgtgacagcaccggtgcgtacaaccctaaacacgccgcaggcctgaccggcgcccggccgccacccagccggggcaccgcgccgccgcacctagcctcgtcgccgcgccgacccctttcccctacgccgcagggccacctccaggccgccgccgccccagccagggcaccacggagccgtcgcctcggcccggtcgctggccgtgccgccgcacctcgcctcgccccggttgccgactgcgccgtcgaatggctgccctcggaatggcgaaggaaacaaacttcatcaaatggcatcttcagcttaagggcaactaagtcatttggttgcgccgttatctaccgttaccacaaaaaataccgttaccacaaaaaacagacggaatgatgtggagggcgcgataaagttcgacgatggcataaagagatgctcgaactttttagtggtatagagacaggcaccatattttttaatagcacataggaaaaaacctccaaggcacatggacatcaacatgacaacatcgaccagaaattttggcatgctagtatatatgcaccaccgctggttttacgtaccgaaagggagtgattaattgttggcttttgcatttgtccaccatctctccacgctatgggcaagagcagtgcatgtcatgacacaagctagccagacctcaagtgccatatagacttcaggttctaattaaatactccgtccgtttcgaaatgtttgacgccgttgactttttagcagggctgcaggaatt

SEQ ID NO: 55448 - DNA, 1319 bp, Oryza sativa
aaccctagaggcatcttaccaaccaggactaaagattattttttagtcccgattggtaataccaacccagactaaaaatgtttcgagggacttggagcatcttaagtaccggttcttaatctaaccgggacaatcattagttctccactagtgtcacaagcgcacgatggtttagcacaggagataaaggaaaacaggatgagtacatacgctcgttctgctgatgtttctgaagcaccagcaggagaatactcagtttcccccactgagcaaccatcgtcagatgcattatcttcagcttcagcttcaacggatcctgcaagcccagtatcagctagtggagtcagtgtgaccactattattttcatcgacaagcgtataatttgagtatctggtaagagctctatcactagagttcaacgctacttcacctgatagctgttggttctgttggcttgccacgggaagtgatgacaaaccagtagaggaagtagattgtctcagcaagttactgccatttctgtctgtcattgaattgggagatttggatttaaggagctgaagctgttcgatttccatatcttttcgtgctattgtatctttcaaagatgcaacctggacaataacacaattatgaaatcgaggcaggataatattaataaccaaaggtgaacggagaagctactgacaaaagtatattaacaagttaacaaagtactccttattagcaatacgtgctatcaaaatacataataatggtatttttactccgtataaaagtctaataatgtatgctcaccttttatttcagttcaacagaagaaacgtttcagttctctttgaaactgaatattaagtgcttgctagggattataattcaagtaagtggcacacgaactttatatgattaatcagaggctgatgtgccaaaaaaaatacctgttccagcagctcttttatgtctttcccctctctgttacttctcgcagcacctaactcaactccagaaaccctttcagcaaattttaaagtacttatggtttctgaatatgattcaatatcagggtttatttgaacaaacattagtgtctttgcttgtccacctacaagaaagcgcataagttaggcaaactagtaagcctatccacgtacacatctatcaacaactatatgttacctaaagaactctgaagaacttgagttagcttgctgtttctatatggcacatgggcattcttctgggccaaagaaaaaatgacatctccaagagcagagagagatttgttaatatgctgtgcctcttttaatctgtctcctgt

SEQ ID NO: 55449 - DNA, 12130 bp, Oryza sativa
aatgaagacattttggataccttaactacctcaagccgatttattgccatctgaagaaggaaccacatagttatagtcagtattacaacaaaggattaactctgacaagcatttagaactctcagcaactttggtgtttacctcgttttcttcatttgttccatttactaatgtctcaagtgctttaatttttgaacgatacttatcctcccgtgtcttgatgatgctattttgctgcgacacaagtggtttgattcaggaattaaacacgcgtgggaaaaaagagagatagttcaaaactaatattttttagatcaaatgttgatccgatgatcagcccagctttactaacaaagaccaaaggttcaatcaaaactaatattatccttacatttctaatgtgatctgcttgaataccaatgcggtgctcaatctcctgaataacattccttagtaaatgaacaacacgctgagacaagcaagtcaaaccatcagtaacaaaagataaaaagacactagtatttcattaaaaaaacgaaaatcaaaagaagtacacatacatgtggtatttctcctcttttcctctcaatactttcatccagaatgccattaacaactctaagaagggattgggtaggggcattctgagataagaacatatataatcattaggtaaggagccagtgaaaagaaaaagaaaaaggttgcagtgttaggatacactatgctaaagattttacatctaaactatttgaatgcagcatctctgagatcttagcagcaggaagatctgtgtaggttccatgcttaaattggacaacctcattgatcttttgtcctgcaaaggaaggaaaacataactatatattaacatcacaaggctcctaagtcaaaattggagagaaagagaacttgaaagttataaatgttattcgattcacaaaataacacaagttaagaacattatatgtatggaattataagaaggtatggaagtcagctgaagtcatgggacttgttagataagttttaatcagtatatcaatatgtaaaattcaaggattaatagaatatgctcccattagcaggagaaaaactcatgataatattgtttctttggacttccgaataccaagtcaatacagcattgatgctcaatattatctgacacctgatgcaaaaaaaacaaaggacataatatgtgtacctgaaagaagagggcttctttgctgggacttagggtatcttttccctggtgtggcaactgaaagcaccggtccatcagtttctcgaagttccagtttccttctgattggagtcttagcagtgctgttagaaatatgaccacccaattgtgtagccacattatcctttaaagccaagagacactccactatagaagacattgatccctgtaatcaccaaaaagaccagagttgacaaaaactactggcacaattgacaatcataacatgaatctgattcaatcaaagctttctgtccctgcctcttacgaatatctgagtacatcaataaccataagcactaggagcaagcatctgagaatgaggcacattttagtgaatactcttgcaactttcttcctaggctaaataggactccatagcagagtctaagatccagctatccaaggccactccggttctgcaaatttcttgtactggtgcaacacttttcagcctttctaatagtctcagattcagtgctgatgttcaaatcaacagtcagaaaacttaaaaggacagttcataaaaaaatatgtggaaataatcatcttggtgaagtcatagactcatcatcactattccatgccaacaagattagagtacttattttctttccaataaggcactagtactgacaccaactatgttaattatattgtcctacaccttgacaaggagatgacatcattaagttggaagttggaacatatgctagtatcataattctactgtatactaacaactacttcacattactggagcaacctcacctcctcaagatccttcacgccaaagcctggcagccccatctctgcaacaacagagaggaacttcttcacatttgaccgttggtccgatgcataaccaccccacgtcccctgcaaacgaagccatatcagcaagagcagcttgcagaaacatatgtatcagttcagttagctcacctccagaacaccgggcatgagcttgtccgcaacatagcatagcgcttctccgttaatgaggtaatcccgcagctcctcgtccgaagaatccaacggcaaatcgaactccggcagtaacccgccgagccaatctatcacctccgcacgccgattggctagaatttgaagaaaaaaaaggtgtcaaccaaggaaacaaccgtgagatgcgtagagatctcaaattgagctctcacattacagtttactgtcacaaaacaacattttaggaacaaaagatctcattttgacctcccaggcaaagaaaagaaggcaagcgagatgcagggaaaaaaaaggggggcttcatcacactgcactggcaaaataggcaacccaaaacgatttaaacgccgcgcaaacttgactccataagcgccaaacctggagcataacatgaaccgaatagcaccggcctcccatttcgcgaaatttttcaaaagcattcattaaactctgaaagatccaaactttgtaggtccgcggctcgaattcgagccacttccccgcagcgagaagagaagcgagaaaccccagatcgacggcctcacccgcatcgaagtcctcgtactcgccgttcaccgtccccatgcctcaccgcccggggccggagcgcgcgcggggcggggaatgccggccgatccgggcccagatcgagccctccgaccgggtcagcgtcggcgcgaccccggatcgagcggcgccgaggcaatgcgggaggcgagccggcgcgagctccggggattttggtttgggttttcctcctcctcttcttccccgtgctgctgggtgtactgcgcttttgctcagcttcccctgctgtcgtttttgttctctttctccggtggttagttggggggtttgatttttttggctttcgcttgcgcgttaagcccgggcatgctcgagtactgtactgccatctcacgctttaactcgcgtcaccttaccggtcgtaggagtaacgaggttttttaaccctcgtgattttactgacaagcttttgactagtggaaatggtcaaacttttataacttagactatcaataactttaaaaatatttagttttaaaaaactagaacaacatatatatttgtcttttaaagtactaaacatgtatttatttattatatatattataatagaaaaataaggtcaaagatgtatattgtagaccgtgttattatttaaaacgttaattaaaatgaaaccagagggattatactggatagacgtaatcacatcagagttggtgccgcaggtatgctggagtattgcatgcaagatccaagatccaacatcgcaacgtgtacaaaagagaaaggagggaggcgtatgcagatgacgggcacgctggggaattctgcaagacagcaacagggcacagggcggaggcttttttttggtgctttctcgggacgcggcgctcccaacagacacgagacggacagcatcagtgtactgtctacaccagtacaccgctgccataggattgatgcgatgccgcgatcttaagtttaagatatgacccttttgcccgggtgatggccggcatcgtcagcggctgggtcgtcacgtcgcgcggggcgggggggtggtggggggttgttgtacacgccccactcggtctgcggcgctccccgtgatctcgtcccgctgcgtgcgtgcgtgctcgcacggctctccctgctcggctgctcctcctcgcggtcgcggcccaggtaggccgtgttcctttttaaaaaggatctgttgcgtctggcgtggtcgtgttgatgggcagccactactttttttttcttcaatgaatcagaaagaaagagattgtgctatttcgttatatataggaggaaaatacaatccctataaataaggtgaaaagactgtacagagctataaggatgtcgagaggagctcctgaagcttttttttctcctgtcagtgcctatacgtcattttccaagaaactaagtctacggggatacgtttatatattttttatatattagaaatatagaaaattaaggagtttttgtacgaaaatagcaatataatactagtattagagcagtccgttccatgacaatcttctccaattctctattctatttgacgaagggattataaattgggtgtaatcaagtgtaagactacaaattaatagtacacaaagcacaaattaatagtccaatcatatgtagttgctcctgatgaatgtgcgtcaacattaggagccgcatggggattgctagatgtcctagctgcacagaagcacttggatgtaacaaaaacgagaatatttgtcctaaactaatacaagcattgcagatcaagcaaggtacgttagaacactagagaagtggatttgcctaagataagatggtcaggagaacaaagaaaaatatgctcggtgcttcgatgctggatgttgtgcctgccttgggcggtggtggccctgataacctggccggttggcctccgcctcttaagactagcgatggaggtgctgcgcctgtgtggatgtgcacccatcagcgggaacttaggccggccatctcacggaggaggcctgtgccgccgggcgcggcggtgatgcagctgcacgcctgcacccggcatgtggcggcgacatcgctagggcgcatgatgcaacagtgcccgacggacggcggttctgtgcaacaacggcgaacagtgtagaggacgaggctgcagcgagcaaccgaacatgagttggggaaggtggcactgtgggagcgtagatttggctcggtactgggtggatttgatcgaaggagggttaaaacatatcaaacatgtatctgaattgttttaattatctgaaaatcaggaaattgctcgatacgtatccagacatatccgatatcgtatttggtacgaataaatggcctgtaagccatatccaggtaacgtaggtcagtgcccaagttcttgcttcctcctttatttttgccacaaggctaggtgtcgtaacttccttgtgttcaaacactcattggttcctttctttccagatttcccagaccaccagaagaatcaagctacgcagccctttcttaggaacctctcttttgttagcaagcatctcccaccagccttgtacagataggcaaggctcccattggcttgggtccaactgctggtaagccacccaggaggctaggagcgtccatactcttttggtgtatctacattgggaaagaaggtggagtgccgattcattcgttgttcggcagagggggcaatgggcgctgtgtggccatcctcttgttgcaagtctatatgaggtctagactctattttgaatgactacctaagcagtgggcagccactactcgtacgccgttctctcaatgcctgagaaataggccaatggagaagctcgacgtcacgcgatggacccaagccgtggatccttgtcgtgccgtgatcatctttggcgagcccccaatgcctgacgccacttcgcccctttgctcccttggttttcgatggctcgccatcctccatcctaatatcttcgattttcagtgcatcacctccgggtctctctgtgaatcgagctccctcacgtccgttccactccacggtgattgccatcgttcggcaccgaaagacgtttcggtcttccgggtgacttcgccgggagaattgcacaatttcatagggtcccttttcttagacctgacaaatcaccagttggatcgtaaattaggtggtgtttgaatcacctgaagatgaagatgaagataaagattaaatgtttcacataaaacgaggtggtaataacgtgtgattaattgagttttaattattacaaacttgaaaaatggattaatcttatattttagaacaactttcatatagaaagttgtcacacgaaacacaccgtttagtagtttaaaaaagtgacacttttatccaaaagtttatccagtttttgttggagaaaagaacacggcctgacactagatcctattcagggtcggctatcacggcatagatcgaggtaggaaaatgcacactgcacttttgcaaaagaggccctaattatcgaaggacgtatggcgaaaaaaaactatcaacggccgcgatcctattctctaggttcgcgtgaaccgtcggatctgatctcgatccaaaacggcgcaagggagatgcactttcacaaatactctctccatccataaaagtcacatttgattttttttttataaataagttgtacctatttatagcttttatgcattcaagacttaaatgaagagataaattaaatattttattagaatccaaggagccatctaaatacttattggttgcatatttacattcacttctttattttataacatatgatttaattttaataggtgtaacttggatggagggagtacaatcctcgaacgatagattatcgtatcacgctcatatcatcctcccctcgtctccgtcccgctgtgccaagtgcaaacgccggggcccgggtttcgccgtggcgcaggaacacggcggccgccggcgacgtgacccaagtttcgtcgacgctcaggctcctgcctcctagtacacggataggttgcctcgaaggctctggatcaggccgtgcgccggcgcgtcgcgtgccgttccgggtgttgcgcgcgtggcaggggctcctccgccgcgcgcggcgcatcgcgtcactcatggccgccgccgatcgaaaatccgggatggctcggttcgtagcggagcctttttccatggaatactgacgtgacggcttctttgcgaggcggtcgtcggcaaggatgcctttctgttcttccgcccatgtacacgaacacaactgtgcaaatgaacgatagattgattgaaagatccattttgatcccagaatctgaatgctttgtaaatcgggaaacaatttcagcatgcttcagagaagagaaacagggttggcagaacagaaccagaggcatggccaatatgagccctgaagaaaatgcattatgcacccatcatcactcagaccccgtaattcacagcctagagtgaaaagcttccgcatccgccacatgacgggcataagcaaaagtatcagtccaacacaaaacactggccactcgttatgtgatacgctctctgataaccgaaaaagcaccgaaatacacaggcacacgacgacgacgtttgctcaagactacatagatatcacaattcacacgctcagaacactgaagctatactgtaaaccagtaagtgatatcatgtttcatgctcgtattacttacacgatagtacatccagtctgtcatctcttcttatttcactttaatacttatacaagcgtatttaagtgtggcacatccattggctattgccgtagaggcgtcgggtaccgacaggctacaaacttatatgctggcctagttataatgtcagcaggaccagcatatcgaagatgctggaagagcagcagtgcgccttgcagaatgcgaatagccggttcttacatgacaggcctagtggcagctccagcggggccagcttgtcttagcagctgaaacacatatcaacacattcagagatactacaactatactagaggtaatgataaattttcatggcacagcaacggagcaggtgaagggtgaaggttacctggaaataggattctagtttctgcctcaggacagcatgctcccgcttcactttctggaaagacctcatgcaactgcatcacaaaatatggaaggcgtatagatattaaacagtgactgttttcaccgtgggaacataattgttcaatttcaaaaataacaatagtgtgaagtgacatatataagagagaccctacccttcaacatttccttggccacaactatccctgaacgacatgcactcattcttcatcctagaagcgccgatgctgcaccaagttgtgtaatgtcaatgatagatcaatgatacatcgaattaaaaacagtctcgtgctttctatacatcatgccaaatgagatcagaagcatgagatgcttcaaaaaggtcgatacacttcgagtttttagttggcaacagtatgcatatttagcggtcaattggccgattaaagcagatggatttctctgcagtatgaggtctcctcaaaacattattttaacttcagtggacatgcattaatgcatacagagcttttatgagcaagacacttaactgggtggtttcactttcatataaaccaaaagggagatggaaagctgaccaattaactgtgatatgcaagactttagatagaaagagatggtgcaaaagagagtgccttggcttcccaagatgcttaactaaactctgtatcatgtcagttcccatggttcatgccacaatgaactaaaggttggcgctgctgaatctgacaccctttgtgcatcatatgcactacaacaaagatattacatagaactagaagcaaatcaggaactacctggaacagctgccttttagttgctgcatatatgtatcccacctgttgaaatctcttgggtacttctccctgcagtgttttcaaatctcagttagtcagcccctcttagcaacatttcctgtgtagcctaaaccctacagatcatattttcagaaaaaatgtctcatgctgcatatggaacttcaagtactttttattacttacagagcttgctcaatgtttgacattagcctgcccgagtccttaaaaaacaaagtaacaacttcttccacaaaattaggactagcttcatcctgcaaatcttccacctgacaaaattgctcatctaggtatccctgccatcaaaatataatttgctgaatcagcacatctgtcaaagaattacatgaaagagcagtagaatactgaaaatgggatcagatgtggacacttccagcataagacctaatatggtcgacacaccctgagcacacataagattactgttgaaagggaaaaaaaagaactccagagaataggatactagcctgatcaaagaggctctttttcatggatgcagcctggcgacgcaaattagaataatccatttatatgaatgaatgaggaaatatgtgacaaagtgaagccgttacaggttggaacacacttaatgatgaacatatgacttgtgggagctatggatatacaaagtcgaacatgggatgagtttatatagtagagggaacataagaaaaagtgcagatattctaacttctggatagcaaaggttggcatcttgcatgcacaggtgatttgattgccacggtgtgcataagctatccatatttgttatccatattttggagaatgacttgaatagatacagatacctgtaggctgtagctctttataagatgtatgatgtgtaagtatgcatatgcatgaagaaaccattaacggttctgatatggatcacactcttcataatagtatatgtcactgcatcaactgatcaactgcccaaaggtagttatgttcctaatgtatcacatggaaaaaagtcatggttcagaagtaaattaatcatacacgtgattgttctaccattaaataagatgaaatccctacaattggggaactcataacagaacaatggtttggacataattctgttaccagccaaccacagggcctggaaggctgaatggagtctgtagatggtaggctgaatggagtctgcagatggtagtgttacattaactcctcaaaatgtttttgaagtagggctgttcattcccagttttgaatttaccattcaaaatcggtggtagtctgttttctggcatgctcaactagaagctaaggtaatcactgcctaaactcattgatttccagtttcgagcgggctgagtaaactagtaacacccctatttgatgatttagtacaaccaacgaggtattttgcacaaatgtagaaaaataatgctctcattctgttccaataaatactaaattgtagttcaattaatatctactaggaactgaagttaaaacctacaaataaaactagtaactttacaccaatctcttctttggctattgattaacagctttgtaggtgaagaataccatcagctttaagtgaaaacttatcctaatatttcaaaagaaattatcttatgtaaccagacaaggaggggaaagatagaacaatatatctttttgtgcccctcaaagttcaaacaaaatgtggagataaaatctgagagaacgatggggaattagaataggcccactgatgcttactttgagccccagcaaaagaaaagtagacagagaaacaggcaccaacagttccttccaattgttaaaaaaccaagactctctcaacacattggaccacgtgtcagaaccaacaaactttcacaaaaggagtaaaagagattcattcaatcattgatccgatgattgctcctgacctccaatcaacatcacaacttgataagagaatctgacatggattaaaaaatatcgaaataaccaaaacacctatacagggaatggatcagaaaagacgcattctggatgagtcactgctgaggccacgaatgcgtgaactacatatcttgtctacatacaatctgcacagtcaataccttccctacttgatgtgtacatttataaaaggataaaaaagcatagcggtccatcattcatcactacagaaaaacatgccttctctttctatactgaacattcttatgacaacattgttcctttctgcagatcattcttgtggcaaacatcacaaaacatcctttttacaaagcacggtgagggattgtattctcacataacataagacatatttcagtatttttttaaaatcttaacagcatgcttacaggtaaccatggtaacactctaaaagttgatacagataagacgtaggtatatagatggtaatgtttccctatgagttcatgcgtgacaagtccaatactccaatagtacttatggctccaaagttcatcaaaatgtaaatcagaaaattcctgtggtcattattttaggtataataccatgttgatataaacattagtttcagttgaaaaaaacaaatatgatactcaaactgctatatcatgcatatagatgagtgaggtgcaaataagtctcaagacaaagctataagggatttggcctttctcataaatgaaattatcatactatagcatttgctatagccttatgcccctctgcaaatggattaggcaaatggaaatgggagagatcaaagacaattttatatccatgcatcacatatctgcttccacgcatcaaggttattgacactccatggcttgtgcgtgaccacgttgtcaacaatccttttatagcatcaacacatgcactttcaacaatctaaaaccagtatcgtgtgcccaacatgacctagattttctcccagtaccctccaaaagtgtatatgtagctttatcatctacggttccccaaaaagagagatgcttctatggttgcgttttgtacgtatagtctaatgctccaatgcttttgtcaccttagaattggtttccatacgtgtgcgtctatttgcctcatatcctgctcactttcgaaacacatttggaaatcgcgaaaaatatgcatttaaaaacaaactatgataatcaattagattaacctccgccgtatacctcatagaagctcaggtagatctagaggtcaggctataactgagattatcaactagaaaatctcccaacttctcatgatgtataacatagcactggagtagagccacatgcagtgagctccaatagagcaaggagacactggagtagcttcatcaccagaaccaaaaaccagtgactcctttccataaaggaatacatgatgtgcggggctgcaggaa

SEQ ID NO: 55450 - DNA, 4046 bp, Oryza sativa
  unsure (1)..(4046): unsure at all n locations
gggggggcgagtcggcgcctccgctgagattgggagtgagatgaggggatagcccaggaccgcgagagtgattcgatgatgcgatcagctgtggtgtaaggggagttaccgcgagggagggagagacgacgacgactcgccgggcggaggagacggcggcggcgggggcctcgcgggtggcagcgttgggctggccggcgacgccgccgcgcgcggggaggtttggagagagggcgagctcgcggcgaaggctcgccgtgggtggtggcactggtgcggtggtgcccgtgccgcaggcccgcagtggcaagactggcaactttgcggcgaccgtggttaagtcaagtggctcggctaggcgttcgggccgggcctatggtgtgtggtttggagtcctaggacccgatgggtggaagaggattggcccgtgtaatttctatgcgaagctaggctgaattcagtccggccacccaggccattcaaggcctcttacaaatctcaaagcacgaatctgtcgtgcgacgccccgtaaatttttttttcatttaaggccctttaaatcgtagaattgagaaaacattggaatnnnaaaacatagaattttgatagaaatagaagtgtaaattagaggattgcaaaacataagaaaaaacacatgaatgaccatttgattgaaccgcagaaaaaacgtaggaattggatgagaaagatagactcaaaggaaagttaccaagaagttgaagctcttgctaaattttctctaaaatctctatatggttatccattccataggaattttaaaggattgaatatgattcaatcctttatttcaaagggcatcataggaaattttcctataggattgaaatcctcttaaatttctatgtttttcctccaattcaaaagggccctaaagaaacttaaaattgtgagaagcaaactgtttgatagttaacttgtaagaatttggtttctagttcattttctgaattctacaactataatttatcagaatctaaaccaaaagctgaaagagagtttctggttatgggataagctacaacagttagaagcttcccctctcttcctccccgaacaagccatttgattaccagacaaatagtatatcgtaatgaatcaggttcacagagttaaaatagactgcgggcctgtttagttcataccaaacttcttcccaactcccaactttccatcacatcacatccaaaactttcctacacacataaactcctaactttttttcaaactaccaaatttctccaaacttctccccaattttagaaactaaacacagcctacgtcatatatttggatatagactacgtgtccgtatgttaacagattaggtccatataaatagaaaggaactgtgattatttttcacatacgaacatactgcgcatgttgggatgagaggacggaagaagaactactccacttttaaactagtagatatatccatatctaaacgttaagattatagcaactatttaatctaaaaattgcctgttttgtatctttttatttttattttttatccttttttctataataaagatgaaagtgtaaaaactgaaagtatattgaatggggagagaacaataatgtctttacagtgaactgaaatttataatgaaatttcaacccctttaccttttgtttgttttaacatctcctaaattttactgtcctcgtggagtatctgaacttgaaaattcaaatgcctatgcatgtgaaaaaaaaataagaaaaatcaaccacttgctttttcccaactatatacagtttctaacccttgttttttagcttcatcccatcccaccatagtatccctaaaatttctcaaaccaaaaacactgtatttgaatccgggcgaagcgaaagcccgggaggaggtggaggccggaaaactctttcgccgaccttccccacacggcttcaccctaagccagtgagcccaggcggcggcggcggcggggcggaatggcggagccggactggatcctggagagggagcggaggcaggtggagcagatcctggagcttgacatggaggagctccaggtcgaggaggtcgacgacgccggctcatcctcctcctccgaagtcgacacctttctcaggtccaaacgctaaactcgcttctcctttgccatttccgctatccacccatggtttgcttaaaccgtgccttacactgttacacatttcggtgcgggagttggctttcgcgttgatacggcgagaggattgacgccgcgagagctgctcgttgctagcaactattctgaaatgaaatcaaatgttaagttgcgccttcccaaagtagcctgaatccagacagaggccatggaggttagggttggggaattttccacaggttaggatgaaaacagattagacaaccgcttgctaggatgtagaagttagacccggtttgtttaatgcttgtggctttccccaagttaatttgttcatcccatagggcatttccacactatttgaatagattgcacaaaatctactcagtttggcatcgtatggtacttagattttgctgatataactcagcaattcatgattttgctgacatgttttgggttttatggagtgatgaggtagtttacatgttacttacgttttcgcttaactaccattaatggtattcatgatggaatgtgcctttccccaacataccatacagtctaaatttttcacccctcaagttcgttggtaatcaacagatgtaattttttgccacttatttaattcttatttttacagaaacactcatggggatggaggatctagaacttctgaagcacttgcattcaatacgtctgtggtttcgctgcccacctgtgatggtggaagcattcatgcttatgttagtatatttcctgattctagctgcaacacttacaagtttgtttccgcaccagaggttcatgatgccccaggcagatttgctttcttggatggtggtgtggttctctgtttaccaatgttttatcttcaaggtagcattcctataaccctgtgttccaacataatagtatagagcttatctcaatctaagctttaaacacccaattcaatctcaagtgttgttagctgatccatgtcgtgcctaatattgaatgctgaacttgctaaagttgtgtcctattgcaaaccaacaaagtatacatgacatgtacgcatccttgccattctttcatcttactcttgaacagtcacacatttagttggcatctgtaaacatagctgcctgtattaaaggctaatagtttgcaacttttgcaggtgttgttttgtttcctgaagctatcctgcctattagagtagttcagcctagatctttgacagctgttgacaaggctgtcaatcatgttgacgctccatgcatgataggtgtggtgcgtgtcacttgtccttgttctgctgcctttgttctagctttgtttttaatggcaattctccaatgtcaggttcatgtttatcaacacactaatgatggacaccatgctattgcttcagttgggacaacagcggaggtgtatttttcataaagctcattcaaactagaatgatatctgtgccttgaagtttcatcttgcatatttgctcatttctgaatttctgttgtctgtgttatgtttcccttttgcattttaatcttctgatcctccttttggtttcttttgtgacctattttgctgcaaaaacaccaaactaagatagagtttgcagtggtcaggtagtaaggtcggacaaaaaaaaaactaaaaaagagaaaagttatatgcttgtctgagatagcgtttgcaaatacccatgccattgaaaagatatacatcaattctgcagaaagagacgatgaattatcacaggacctgtccattcatttctagatatcacgtagtatgcacagctatagttgactgcagtcacaaatgtcttactaggacatcatgatcaccatatttgatcttatctgtgcggttatatgttgttccttctag

SEQ ID NO: 55451 - DNA, 2377 bp, Oryza sativa
agaatccagtcaagcatagcaacacaagaggcaagggtgaaccttgctttcaatccccaaaatctttaccaacaaaaaacaaaggtgctgaacaacgcaggcggttctgtgctgcttatagttcaaagctggcattgcaggctccattgtcattttggcctcgctgggcttatgaaatgtacgattcatattcccttgctcgcagagtggcaggtattgaattatttcactacagctatttcaatccgttttgtcttgtattcatgcattctttagccaaataatattctttcccactggctaacatgtcatttgttactatgattaagatgtgatgtatgcatgacattaaattggttttgtggcagatttgtggagacaaatagttgtaaatccaagcatggatgattatgtgagaaaaccagatattttgtcatatcacattggaagcaaacttcccatgtcatgttctgtgagacaagaattgcttgagatcgatggtatctcatatcggctacagaaagagatccagctactcaaggcctttaacatcataagatgcagaaattgcctggtaatgattaattattttttaaaatgtgattccactgaagttctgatcataattcaagcttatttttccaattatccggtgttttaatcttgattgctgcagtttcacacttgcacttggctataacttgtgggcttacctgtctttggttgctgtcgcaaacatatggtagagttgtagttggtttgctacaccataccatggctgcaggataagcaatagtaacgatatttaatcataccgcttcatccagatatctgttggttgttgcctgtgttttaaacaaccatggtaccatactaccaggatttccgagagacagggttttgatcatcaaagcacactagtattctgatttacaggtgatatctaagtcatgattcagttctctgaatcattatgtaaatgacaaagggacatgttcttttaatcgcttcttctctacctctaaagggctggatctcactggttgatttaaactggatttgtaacagaacttcttggaatactttcaagttttgactaatatggcaacaattccatttcttgtcgcaggctcttatctcaagacgtagtgatggccctgtcggtgcttatgtcaagcagttcagctgtgggcaagagatgatgacagtgtacaatgcaactggtcttgcactccgtggcgctccttccaaagctcacagtttgtttccagggtatgattctaatatattctactaaactctattactcaaaaaaggtttgaaatccagcctatcattaacagaagaaatgaacattgttattcgttctgtttgatcccgttgttacttgcaaatcacaggtgttcagttagcagcaatttcctgtgttcttccatacgcaactatcatacctgcactctgttattacctccattctaaaatataaaagttttagggttaggcacatgcattaagaaagtggatgaaattaaatgaggaaagattgtgtttggttaagaaaataaagtaggtggtgatattaaaaggtgaaaagttgtaattggttgataagataatgtagttaaggaattatattttggaataaattttgaatgttagaagttatacttttagatggggagagtatacgctgctaacacaaagacctgtattttttgcagttatacgtggacgattgctctctgtgctgcctgtgagtccaacataggctggctgttcagggcggagaagacaaatctgcttccaaaatccttctggggattacgcagctcccaagtttcagatgacacacaatcaggacataactgaaccttaacagtaagtcagggccccattttgtaattcgtataggtctgcctttaatttccttataagattcttttttttttcaccgggaaggccgaaggaggccaaccgaatatattaacaagaaataaaagttacaagagaaaaaacatcaaaatgcaccaaggtgcattgccacacaccacgcgctaccacccaagcacaaaccgctgagggtgaaacctagcaccaaacgaccctcgctgagcgtggccgaacgccgctaggcctacggcaacaccacagagacgaggcttcgaaaaacgatgccaccatggtggtcacgacatccaggatgccgccatcgcccatctaaaaagatgtggtttttacctagagaagctcgccaagaaagggagagggtaaccctcgacaacgctccaaggagattacgacgcccgaagacgtagccgctgccggcccggtgaaccaccggactaagctttcgcctgggaccctacgaccttgactg

SEQ ID NO: 55452 - DNA, 2433 bp, Oryza sativa
ctgacgagctgccgcctcaatccaacctagaaactccccgcaaagaaggggaggagctccacgaaggctgagggtgccgaccggcaacgaggaagacgacccaccgccgctagctccctttgcactgccacttggccgccagtggtgctgctgcttcggaccggcgccacccgccggcgcccgcgaagtccggccgccgcgcctcacctggccaccgcgacggcatcccggctgcccagccaccacgccgagtcgccaccgaggcctggatgacccaccgcgccatgggctggcgccgggcggccaggccgagcgagtgagcgggggcgccgccgccgctccgggcaggcttagctgcccgccgcctccgagcgcccgccacctccgcgacccggccggccacgacgagccgcggccatccgccgcctgcgcccgccgctgacgaaccgcctctacgccgagccgcagctgtccgccgcctccgcgcccgtgccgggccggcctagccgcagccggccgccgcctcgccgccttgccaccggccgccaccacgaccgcatgccgtcgcgccacctcaggccttctcgcgccgccgccgggcagatccaggcgagggagggccggatccggccatgggggctccggatccgccgcctcctccccaccttgccgccgtagccgccatggaccacaccggtggggagcttcgtcgtcttcgtccttcgcgccgaggagggagacgctacgaagagaagaaagcctcgccgccaccttccctgcccgctgctggcttcgccgctggcgggctccagcggcggcgaggtggggagagggagggagagaaggcgcgggcggctagggtttttcgcccccgagccgcccgacgcgagagcgacgcggggatcaggtttttcccttggctcttttctcccctccttataagattcggtatgctagctttgctaatcgtgcggctttcttgtattagacgcgagagtttgtcaataacatagatgcctgcgtattaccccacttatcgtgccccagctgccatggtccagcatctggcacatgcccagaaaattgtacatatatcacagaatgtgccttgatgctttcgttaaaaaatgcaaaaacaaacatgttcatccgtgtgtggatagtgtatacacctttgttgcaatcgtacgagcaatgccatatacaaagtaaaatcatactgaaccaaattctgcaatagcagacttgggttatttattacatgatgacagggcaaatatgtacaagcacagttcagggataaaatgctactgccgtacgatataggtccaaccgcaaattattactgtaatacaagacagcatgctgtagccaaatgaagctgtacactaaggtgagcatcacttcatctataagaacggtaaatggggctgtacatgcagctctcagcgtacttcaccaagtcttttgggcgagggagatggctagccaatcctgcatacagaagtgcgaaataactgttggtatgcgagcatcttgttttagctagcgtgctaatgaaccacatcaaaaggaacaaatattaccaaggtcataggcttttgcagcaacgcgggctgcgatgttggctgatatcttcctgatgcaggaaaagggtggataaataaggcctttgtcaacatgctctggggtcacctggtcagctaagccttcagctgtccaatgccatgaaggcaaaaacaaaacaagcaagaaaacaacaatagcgtggttagcacattagtaaagtggatgggaaaaaaaactcttgggctcatatagaatgcatttaccagcagcaaggatcatttcatctttcacccttatcgctcctgaaatcactacgcctaggccaaatcctgggaatatatatgcattgtttgcctattcaaagggtaaagagtatgtttaaattgtcaaaaacctgagaactaaaattcaggtggggaatctctcccctccagtgatttatcaaaaaaataataataattgagaactgcacatgtcgtgcgcaaaggtaatatccctaacctgtgcaggcacgaaaagcttgtcattgtatttaactggatcaaatggacttccactcccaaatattgcacggccctgcatgatgtatcatttgataagttataaagcataaatgcttgtgacataatttacagaagtttatagttcatatatgtgttgatctcaatgggatagatcatagatggcgtgaggttgcacatggaatatcaccttactccatgaatatgcctgttcagcagtacattcagattgtgatgttggattggatagtgcgaggatgattggtctctgcattatattggaaccaagctttcagttcttgaatctgtcattaatgtgacttattatgagtcaattatctga

SEQ ID NO: 55453 - DNA, 5674 bp, Oryza sativa
gcttcttaaagggctgaagagaatctttacgtgaactgacaatcaacccctgcaatgcataaatcaactctcaatggtccaattaccaaaggatgcaagttaacactgcgatatcattattatattaacctttgaatcaagtagccagatctttttgcgagcatcttccactggaactttggactgaaaaaaaatcatagctaacgattaattgagccatcatagacaaattaccaaaaatcaaattaggtgaagctagcaatcgagttacctgatttgatatctcgagagccactagttcagcaatgcctgtaccagcctgcaagaacaggtaatctatttggaacaatctataggttttacatgatagaacaaatttttgctcgtcggtgattaagagtcaaatcactaatttactggtggcatgcttagattattcactattcaagcaaaaaaaaaaacttttttgcatctcaactagcaagaaacagaaaaggtttctgaacaactgaagttttgaattgtgataagtcctattcctatggctaaccaactctactgataggataatcagtccaactatttatgttttttttttgttactgactatcttcaattattcattgctacagttatgacaggaatgtaaaagcaatactcaatgtatattcttataatacaatacgcgatgtatagatggatgttcagagttcagacatgttgcagcagtctaaagtaaatgtgagcaatgcagaatgcaccctccatatcactgaaagggaaggtcagcttacctctcctgcgccaaagaataagaatgtgtgatcagctaaagtcccactgacaaatttctgagcagcaatgaggcctgcaagcactacagcagccgttccctgtttacaccacagtttcatggtttactcctattgttgtgaaacccagtataaatgcacattcactagttcgctttcatttaggaactgtaacgagaccaatacgaagagtaaaaaagtgagatctgaacctactacctgaatatcatcattgaagacaagattgtttgcacggtacttctcaagaagggtaaatgcattgtaatttgcgaagtcttcaaactgtaaaataaaacaaattgaacaattgcccataggaacagctcatttacagaccaaagttttcctctttccttttaacatttccatacctggactagcaccttctgtccatagttctgcttaatagcagccatgaattcatccagaagatcactatattcctaattaaagaaataaaaaccaactttcatgactgaaatcacaaccatattgttacatatcattcatgaaaactgaatgagcatatccaagaaataagcatgaaacctggccagtggctcgtttttgtcttaatccaatgtagaactcgtccttcagtaaatcctcattgtttgttcccacatcaatggtgataggtaagcactggaatgcaaaatggtgggaaaatgctacatcaatctgctattctgctcattgctgaagaaaacaattgaaatgaaaataacttacagcagaaggccggacacctccaagggctgtgtatagtgcaagctttcccacagggattcccataccctatatatgttgcaattttcaacgaacatggaaaaaaaagtcatgttaagcagcaaagtaatagcactttaaacaatccaaatgcatgaaggatccttatcaaagcacaaatgtcaggactaatttactgacctggcaaccaagatccccgagacctaaaatgcgctcaccatcagtaacaacaataacctgaatgctcttctctggccagttcctcagtaactccaatattctccccctggtacaaaagcacctcattttagaaaattgaagatgatttacacctcaaacttctgccatcagtttgttcaaaataagtaaaaattaacataaggtgaaggggcaaactaccaacagaaatgagcaacagatacaaatgatggaagaaacatacttctctttaagactgatgtacagaccctgtggtcgtctaaagattgacccgtacttctggcaagcctcgcccaccgtcggcgtgtacacaacggggagcaattcctcaacgttgtcgatcaggagcttgtagaaaagcctctcattctctcctgcaaaccaaccgtccaccggaacaacatgacatccgtgcctagtaaactgcaaccgatatctagttttcttctacccttctgacgctttctctaaacaagatgaagccagagcacacctgaaggtccatcagagccatgtaacgttgcagaggaacctgaaactgccgcacattttgcagaagcctcttctcctgcaggtgatgcacgcttcagtgagaaacgtctaccgacaatgttatcagatgaatcgagcgctggggaagtggaagggagcaaacctgaagttcttgggagagcacgactggaggcagcaaaccccgcaggtagtgggcgtctcgctctttctccgtgaatgatagccccttgttgtgccgtggatccctcagcagagagtgaccgctaaaaaaccaagtagcaatcacaaaattaacaccagatcacatatgtgtagactggtcgtttactttcttagtttagagctggactgggcttatcatggtctggttagtggttgattgctcatagttcaaacgaattcatgaagtaactaggaatatgttgaaatgactatgcgagatcgtgtgataggaaaatctcaaattgagcccagataagctcaaagctactagtactagtgaaatcactaatcacttaatcaataatcattagttcagtactgaaagtctgatacgttggcaaagcttcttcaaatggcgcatgcacacatgtaaaaccattttgtcccgacgcaagaacagaagatcacaaggcacaagccatgcatacctggcgacgcagacggcccacggcgtgatgggctggtcctcggtggcgcggtcctcgccgtaggcgtcctccacgccaccggtggccacccccgccatcgtcgcagcgccgttcccctctcctcgccccgccatgccgctcaccgtcctcgcgccttgcctgcagcgccgccgccaccaccaccaccgcttcgtcgtctctcggaatgcagcgcgagaagccacgacgcgtagtagctggaggcctggaggagccccgtgccagcagcgtacataggagcgcgcccgcgcgccgcgcggcgggcgccgaggccacgatgacgccgccgcccgcttgtccggggacacgtcgcaggagaggtggcgccacgtaacccccgcggttaggccggtttctggagagttacacggggccgggccggccagtccgggccgcacctgtggctggattggcaaaatcgtgggccttttttcctccaccgagccggcccgagcgatctccggcctcaaaacccgaccaacctcagttcggctcgcggctcgtcgtctccttcgtcctccacttccccctcccacccaaagacgcgcagccaaatccgacgcgtgcggcggtgcgacgccggccggggtgggggacgccatgagccgcacgctcctctcccacatcctccaccgcccgccgccgctcctcgcgtacgccgcgcgctccgccgtgctccgagacctagcggctgcttctgctttgcttccgagtccctaactttcctccctgttgtttggcttcgcaggtcgaggggtggtgggcgaggaggagcgctcccgtcccgcctccgcactctccgactcaactgcagcgtggctgaagcgactgcctccggcgacgaggcgcctgctcctccggctaggaagtaagcccctggccgcctagtgttcggcgtaatgcgtctggtaggaagaggattgcggcaggtttctgtggtattttgttgttatgcgatggcgtagcctatgatgtataagtaagcgtttgctctggttcaaggctagtatgcgtgagaagtcacggatgaaattctgtaaggcttgtagcttgactgtggtaggaccagcttgtgatgtaatgcgcctgtagggtgttgtaatgagtgagtacagaattactgaggtgttgggaggggctaagaatggcaatgcaggaattgaattgctgttgaagcctgcagttcacttgctgctcttagtgtatatacttgtttgttagaatacttaactggtgttggatgaagcaagctacccataccatttgatctgaattcatttatttttctctactagacactagttgttaaattaaccgtcacttaatttttttcgtgcttgaaatgactcgatgataaattccacagaaaaattgtacatatcctagtatccaacaggctaaagtgaacttattttttgcgcaccaaggaagagagcatgccatcacagctcgcttctcttggtgtgcacaaaatgaaggtgtactcagttgactgattgtttttgtatttacaacttccacaattggtgcctcatatacaaattcagtgttcatttcatgtagtatcaagaaacaatgacattttttcagtccgatgaatatcttgatcctaagttagtttacactgtcaaattaattagtttcttcatgatcttatatatacacttgtttgcactgctcaaagtcatgaaaatattattgatggctagtgtgaagccagaatagcaaaaatagctattttggatatgtttctcatagggaatatttttagcaagtatgaacatataatgcataaggtaatcaagaacttttgattacattgcatttttttcatgatgcatcttttttcatgttggctgtttaattgtatttggatcaaatttattactcttattttatagttattattatagtcatccgtttgcagtgtgcttccaaagcaattgtttttatgtattataaggtttcatgagaaagaatgcagtttctttgcccaagttccatagtagcatctattcccacggtctactagtcgtagttgtgattttcttcttcttttttttttcagataacaaagttctggcctagtcctgattaaatatttatacgcgtttcactaatttgaacatctatatttatctctactgactgcaggaaaagagtagtttctggtgtacagccaacaggattggtacaccttggaaattatcttggtgctattaagaattgggtttcacttcaggtagtggtttgagaactgcatcttattattctttaattttgatggtaataatctcaaaagaaaatttttcagaaaccatgaagctagtgataaataatcaatctgtagctcagtaacaaggcaacctcaaattctgacattgttcatctaattgagatgcatttgagagctaagctaacttattgactgataatacacactttatctgtgatacttgacatcttatgcatagaaattccttgcaggatctatacgagacattatttttcattgtggacttgcatgcggtaagttctatctgacctcttggcatcctaccaaaaaaataatatttatattgtttgtacaaggtgtcacttattttgtacttttatcttttccttggtcaaattagtatgtttcattttcctttaacacaagctgctaca

SEQ ID NO: 55454 - DNA, 14867 bp, Oryza sativa
cggttagatgttgtgtcattttaagaatttctctaatttattagagtgtcacgtggtggcttatgagcgtttataggatgccacgtggcggcctagtagcgtttataggaagtttaatgattttttattatataatagatagattgattgataagacctattcgtactatcactatatttaacgtaacggtagtagaaacatgagatgataatttttaatttacacatcagttggaaaccctccaagttttgcgcctcgcaagggcgaccatgcggtgcggggtggcgtcactacacagagctaggagcggaggtggctggcatagttgccgctgcccgtcgccgacagctgattagcgatagatagcttatttctttggttggccatctccagcctgcggaaagaatcaggactaaacattataaagccgctcttgtttagattcaaattttttcttcaaatttctaactttttcatcacattaaaacttttctacacacataaacttccaacttttacatcacattgtttcaatttcaaccaaacttttagttttggtgtgaactaaacacacccaaaatttaccaagagataaaggtaaaagtttgaacttgacgtggtaaactgcagcgggtggagctatagcgagaaagaggggttgccacttgtttaatttactctgttttatatcaagtttaagctaatacgggtgtctaaatttatattgagaggggtgtacatatggtaaaaataggtcaggtatagctataattttttcttgacccggttcatgggaatactctagctctgccctttactgctactgctatatcatagcgaagtttctactctcttgctcaacagcttcaattaaatactcccaccgtttcatattataagtcactttattttttattagttaaatttctttagatttgaccatgtttatagaaaaatataataagatttgcaataaaaaacaaacatatttaatgttaattaataaaactaatttggtgttgtagatattgctaattttttttataagtttgatcaaacttagagaattttgactaagaaaaaagtcaaataacttagggcatatttagtttgcgaaaagaatgtttttgggtgtcacatcggatgtttgaccggatgtcggaaggggtttttggacacgaataaaaaaactaatttcataactcgtctgtaaaccgcaagacgaatcttttgagactaattaatccgtcattagcacatgtgggttactgtagcacttatgactaatcatggactaattaggcttaaaagattcgtctcgcgatttcccccaattgtgcaattagtttttttatctatatttaatgctccctgcatatgtccaaagattcgatgtgatgtttttagggaaaaaaattgggaactaaaccaggccttgtaatatgaaaaagatggagcacaactctaaactacgagacatctaatagagtccccactgttataattcaaagcacatgctttacgattaaccaacgacatgggttagcaatctcgaaattgtatttttggcgcggcccgggttgggggtgggggaaccgaagtttcaattttttttttttgaaaatttgatgattttttaatgaatttaaataaactttgatcaaattctggaaaatggaaaaacccgaaattttcgagtgagatatgtgcttgccgataagggacgaaatttcctgccaacgactacatgtcttctatattccctccgttccaaaaaaaaataacttaatgtttagatttgttgtactatattattatatgtttgtttttttagacggagggagtattctctgttcgtatctgaaaccgggcaacaaatagaggcgaagaagaggcgggaagagaacggccttgtgaacgcagccaccggagccgtcggcacccgacgggatgagttgccgaccagcagcggaaggatgcgccgtcgagtagccaagcgatatgatctgaatcgatataaaaacctttttccaatgaacaacggaaaataacctaaatactaactaaccttacctctaatcaggttagtaaagcactaaaatgatcgattttattgattttattggtagtctacagatgattacgctaactgaaatagccaatagagcctgaaaaccagtagctggcagtgtttacgttattgggctattacaaggcccatctgtagcccacaattcttgtcagaggcccatactgtgatacgatctgttacatccatgaatcgactaagggtgagtttgagggataggtgattgagaagattgggaagatacgtaaaacgaggtgagtcattagcgcatgattaattgagtataaactattttaaatttcaaaaatggattaatataattttttaaagcaactttcctatataattttttttatcaaaaacgtaccgtttagtagtttggtaagcgtgcgcacggacttacgatgtgctttctcatcctaactcactagaaagaacgctccctaagcattcaatcgagtcgtgattagttgagttgcaacttgctagttctaatagcagcgttggctttgctcttgtattactttgtcgcgtcaggcagtggtgccagttgagtacttgatttctcaccaacaagggctcgcgagtatagaacggtgcagtcgcgtgtttaggtaagagagtgcgatagtacggcggcgtttataagtccccgattactagcagcctaattaccttctttcggtggagaatcaggaaacgccgtacacgctcaccacatgctgagagcctcgcagctactagctgatagtaaatgcaagccggtgcacccaaactcacaccaaactgaaagaagacaatctccaacgagactgcaaatgaatctgtatatatattcgtctgtttttctttttacatcgtgtgacgctatgatgccgtgtgcggtgtgctacaatgaactcgatcgaccgatggatcgatctctcacaacctgacccattccgtgccgtcgatgaaggtgagcgagatgaagggcttggcctcctcgtcggtgagctcgcgtgaccacgacaccctgccggagaagctcgcgccggggcccgtgcacttgtactgcccgtagaacaccgtcctgcaacagcagcaggagcaatacagcaacaacggtcagtggtgcgtacagcatcaggaaactactgagttttaccgatatatctgtcagactgtcactgccttttgccgatcctgtttagtaacagagcatcgaatctcaaaagctgtatgattcagttccaaagagatcaaaagggggagatgcacccgtgcaacgccatgcaccgagaaggggagagtgctctcccttttcccgtgcactggcaaattattgatatggaagctatgtctacgattcttctctgcgcacacggccatgcgcctagctacaccgagcttttgcaaacagcaacagaccaacagtgcaacaccgatgcggctttcggttggctagggaattaaagtgactttgcttctgtacatacaaaactgtttctacaaacttcactctgatcgcacgtaacaggctagcagcttcacagataagttcggagagagcgatgagatgtcttacagctcgcggttggggtcgccccagttgtaccagccacgggggatgatgatgtcgtccatgtaggtgtaggcgaagacgacgcgggagaaggtgccccaggcgcggccgaggtagagcgcgccggatcccgtcacccggcagttgacgaacgagaaccccgtgtcctccagcatgctctgccggttctgcgctgtcagcgcgccgtagtcccgcgcgatcgcatgcacgtggcaatcctgcagtgcagggcatacacatatacctccgatcaccacatgcatcgaaccgaagccaaaaggaaaaaaaaagtgcaaaataacggaactcaaataacagccaagcctagtaggcatacgacgagaggttgttcattagcgtcccccactctgcacgcccgtgggtgtagggccggcggccagccgcgaggtcggcggcagaaacagaagcggacaccggcaaagagaacgcggttagctgtcgcgtcagttgtggggtgtgctgggccgaacaccgaaccaaaccgcttcgaggtgcacgtgttgctacattggcgttggttgaaacctgacacatggtccagcgtgcacgccaggaaaaccgaggctaaaaatacgtactttgatgtgtttaaacggggatgtacgggaattgacacggtacatcctaatttggtcagcgcataattaacaacgacatgtcaagtcgtcatggcgtacgaaaagaactccagttaagctggttcgtacttcgtgttggtagtatttaaacgtgctggcgtaaatttttttttttaggaaactggcgtaaatttcagatcactcctataaggaacactccttttggatgccactctgacgtgctctgttttggttgctctgtatactctatggcgataaaaaaaaatttaacgcctgggaacctttcccgaaacatttgcatatgaattccatatttgcacctcggcgcatgcatgacatatgacagtatgatacaggatgacataaaacacaacgtagtgatttcgcacaaaatggaggggggggggggggggggagggttcacgggagaacagcagaggagacagtgttacctcaaacagagagagcgcattgccaaagatgaaatccacggagccttcgatgtagcattccttgtagtagtgccggcccgagtgatcgtacagcgtgtcctgcgcgcccaggaacctgcaccccacgaacgccgcgttgtccgccgacacccgcagcgccaccgcctgcttccccgacgcccccggcttcggcaccggcgacgtgttctgctcaatatcatgaccgcgaattgaggagaacgaagccatacagccccgacagaattacggcggtggatttgttaccttgaaagtgatgttcctggcgaggaagtactgcgcgttcacggcgaacgacgcggagctgtatgtgccgagcggccgtcccgcccggccggacggactgtccgcggtgtcaccccactgcacgatcgtcttgtcggcgccggcgccctcgagggtgatgaacgcgcgcatcggcgatatgttcaccttctccctgcgagatcgtcgttgtgcatggtcagtactctctcgtaagcaccaacaagatcagagtcccaatgcgcgcgcgtgcacgtacgtgtaggtgccggcgttgaccttgatgacgacgcggacgaggttgatgatcgggagcgagtcgacggcggcctggatggtggtgaagtcgccgaacgccgggttcttgtcgacgacgagcgagtaggaggggaacgcccgggcgagcgcgtggtggaccgtgctgtgctccagcccgcccatgtaccgtacccactccatgaactgccgctcgatcgcctccacccgcgtcgcgttctccgggaacgacggctgctgcttccccgccgccctccctggccgcacgccccgtgtgtgccccgccactccgcccggcgccacggcggccagggcgacaatgcacgccacgagccggacgggcgccacggccattacgacgccacgcgcctacaggctactcgaacgggcgccgggtagctagagaggcgtgtgtggcggccgggcgggttcggtgatggaggcaggcgaaacgagagggggaaatttaaggagctcgcggctctaccgaccgatcgatcacggttcacggggcaagggagggacaagaggagaacaccaagggatttgagaagcgtgacacaaacaacgtacgccagggcgagacgagagcaaggccgcgggttcacgagctgcggaagtgcggttggtgcgctggtcgctggcgccgcgtgttggcatggcagcgccgcccaagctacgcgagcccgtacccaccacgtacgcgcgcgtgcatgcatgcgttcgtcacagctctcgtgctcttgctcttggcgtcgcgcgactcgagcccgcgcgcatcccggcgactgatggcgacttctgcgcgctaaattcgcagcgtagcagaggattttcttgggctcgcgagtgcggatacggttcgttttgggggcttcggtacgttgtccttgcttcgttttgtgtattagagtgttattttctccttgtgattgaatgggtttattgttttagttggaggggtactcttgtaccgtccccggttcggccatgacgttgggatgaactacgccagcgtgcgtggggaaatgaagtttgcaaatggcgttggttcgaaatctacacggcagggaggaaaagaagtttaatttgttgcaggataatggatatgtatgttccttttccatgtcaccatgtgacgagtgtgatcttttcattcgtaactgtaatttgtcacgtagagaagtgtagtttgacttgtcaaaccttgtttagccagcatacgaaccgtgggtgcatgttgtatacacatgacaagttcataggctgattgatagtttgatactaatgtaaactactaaactggcatggtttgccatccatgctactttcagcttatgcccgtggtccaattttacacttactattccaacttgaaatatgaactgtccaacatatctgacaaaatcgcttccgttcttttctagtagtagtttttttgggacacgttgaagactctacaacactaatagtaaacggtaggtggatcccctgattattcctccatctattgtttctcccgccatcctgtcctggcaaagcgctaatgcgtccgctgcgccgttctgtttctccctgtacgttattttgccgctttgcacgccgccggcccgtgaccgcgactccgtgagcgcccgccttctctgtgctagtactagaacgaaaacggcgcggctcccggagcggcggggcgctctgataacggcagcgctgcgctgccgccgcagctgctcgcggcttttggcgacacggccgcggtaccagccaaaccatctggctttacacgacgccgcgggcctcgcggccggaacggcggcgcgcgtacggcggacgccgtttctacgcccagattccagtacgccacgcgcgtgtgttgtcacactgcgtaagatgatccttttttgttccacatgtgaaaaaggagggaatgaaaaaaaaaagaaaattgcaaaaaccatcacataaagttacttaaaatttggcattccacctcgtaagttattttgttgcaaatgtccatccacctacatatttttgttaaaaaaaccaccccaataaatacatgcgtaaccgaatcaatatgttttcataaagtgtgaacagttaatatggcctttaccaaaattaaatacttacagagtattcttgatactcttttggtgagattccacaaataaaattacagacgagagcttaaacgttgtcacactgagtttcgctatatatgaaaaaaaaagttcaatcaaatatagaaaataagtctaatgcaaacactaggataatattgacttgactaatttaacctgtgataaccgtacatcaacaataaacaaactgatttgattaagtacatgcgtgttagggtggtttttgcaacaaacctaaataggagatgggtatttgcaacaaaatgacttatgggggtggaatgtcaaacttcaaatgatttatgaggcgatttttgcaattttcgcaaaaaaagtctattcttcgcaaatgctataagagatatgcattaattaaacatataggtgagagaaaatagagagagggtggtagaaatcgatataaccgtatactgcgcctgtttgaaaatataataccttttcccctaaagtcaacaactatttatttgactaatctaaatttaaaatatatacgtttgcacacagtgtcactagattcgtatttggaaatattttcatacaacatattagctctaatggtttttttagatacttgtcttcgagtttgcacctaaaaaacgtacctaaatggctaaacatgtaactccagaaaacgtacctaactgtgtggctaatttaatttgcccatgatggtttgaacgctttgtgtttcctgtacttgttttctgcttcatggtttagggccagaatagactggatcctttgtttgtctcttaagcatggagtagcattgctatttcattctattttttattttcgcctgccaatgagtacttgcgttaacttaagagcgttaggactgtttccggacttcgtaagtaccttcccaaccacaagaaaataaaagtgcatcagttcgtggtggcggtgtgatgctatttcacaggttgatcagatcatcagaatccactagagcaaaatgatgacaattagatgatcatcagcttgcacgtaatgaagcgcgcgctctgaatttggtgcaactctagaagtacacaagtggatttggtggctccaacaaaaactgatgtttgctttctgtcatcattcgaatgggtctggatgattagggtaatcaaagccgccatacacctctccgtcttgggtgcttctggtaatgcagatccctccaggactgaaagttgcaagcgattcagtgcgacgtcagtgctgtttttaattgcacgactgacaagaagaagctagcgttgaaagcttgaaacggatggcggcaacaaatcataaatgggcgacggatgacgttgcaaatctttctcctttcgccttcctttatgtctcaccggccatagtgatcggtttcatgaatggagtgcatgagcatgacccatgcagcttttatgtgcgccatggcgaccctggccatgcaatttccgttgcagtagaaaattttcacagcctttctatcttcaagctctcggcaaccgtaatagctgtatacatggttaatgatcggcaaaaccgatctgattatttacggacgaatgatcaaccatatcagttgcgtatagggattagtgtgtggcctgcagaagcgagtatcggacacgcttgttagcaaccttagcaaccaggccgtgcaggccaactaacgtaataaagcccaaataaggcccgtatcaacctactgccagattcgaacgggaataagttcattctaggtccctcaatttgtcgccgagtttgaaattcattccttaagtgcaaaaccaggtacaacacatccttttaacttataaaaccgtgcaaaagaggtccctcggcaatattatgcccggttttggctgacgtggcgcttgcgtggctcttttgactagatcttcgtcctacgtggcattgacgtggtgtttatgtggcaatttaatttagaaaaataaaaaacatgggacccacatatcagctacatacaaaataagagttttgctacggtccaacaagtggtacctcaaggtcctggtaccaccaggtatcaaacgaaatccaaccgttgaataagcaagggcacgataggaaaaaaaaaggaatcaagtgactcgcgacctcctactatcctcgcgcgacggcggcggcaccgccaggacccgactgtggctgcagtcctgcagaggagcagaagccctcgatttcgatttcgtccagcccctgatcatggtctccacgattggcttcttatgattttggatgagaggaagatccaagtcaggaatcacatcgatcaccaagtcaggaatcacatcgtaataagaggcttataacttagctgttgctgatctcggctttgttgctgatggattgagatgaagctggatttgcatctattgctgacctcggttttgttcctaatgggttgagattggatcgggagaagggagaagggaggagggaggaagcaggaacggcgccgttgggagggtatggggagggcagtcaggaggttcccctgaagtcgccgccgtcgcccaacagccgcctcagctgtactagcgccggggagaaggctgcaccgctgcgtctgtggcgctgagcacatcactgtggccgtcttttcgttgtcgtattgaggtcgtcgtcgtggccgcaggttgcagcgagggtggcggaggtgtcccgatagcttagatttggccacgagtttagccgcgccgccgccatggaggaaggatgcagaggaggcgcctcgagggtggcagcttgctggcgattgggaggagcgtgcggtgcggaatcagcgaacgaactatgcgaaatcccagttttacccttccacttgttcgacgaaggggaggtaccatcgagggaattattgtgcctagcagtaccaaggactgatagccgttggatctacctcaatggatggctgtgattgtaggtacctagaggtaccaaaagtcctgatggactgtaaaaaaactcacaaaataataataaatggtgggacctatttggccccacatgtcatccctctcctctccatcctctctctctctcacctgggcggagcaggtctgagcggagtggccggccggcagagctaagcggcggcggctggagcaagccggcacaagcgacgggaaagggcggcggcactgcggcgccgaaaggtggtgggcgcagcagaggggcggcgggcagagagggggcgagtggcaggcgagctcttggagatggcaacgggatgaggctaaaaggacgccaccgtcgtcgtcggtgtcctcaaaccagtatggcttgtccacacccttgaggagggggaaaccgttgaacagcgccgggattgcgtcaatggtggtgtagatatgggtattggccgtgtctttgggtgcttctcctcgcgccacggcaccgcctcacggccgtcgccattgtcgtcgtcgtctcaatccccaccaccgtcgatgaagaggtgggggacgatgtagctaaactccagcaactgcagtgaaacctgcaacacacacacgcttggacgcgagaagaacaaaccaattgggaaagtctttttggcgctgcatattacttgcttgtgacattttctgtttctttcccttttatccatacgcgattacagaacgtgggcacgatgacccaacttacgtggacacgatcctttctcagcggatgccatcccaaatgctaggatcatggccacgcggcgtcttcgacgcctaggccgagctccgccgagtcgccgacgctgatctggggagcgaggctgccgtgtcctccctttggatccacggcgacgagaggagaggggaaaagggagaaggaggtgccgtcgtttgtgggctggccgccggttgctcgacgtcgtccgcggcgccagcgtcgttgtcgtcgtcctccaccgccttgcctctcgcctgtgccgcggcctccgcttgctggagctgcgcgtggagcaccgccgcggtggagagggcgaggagcttgctcgttctagccgctcccttctctcctgtatctcgtcgaccaccgcgcgtcactccctcctctcccaccggtgccgcgccgctgccaactcttccgtctcccaccggcgccgcgcgtcgctccctcctcacccgtcggccgccgcgcgccgcccctcctcactcacgcctggagagaggacaaaggagaggggagagagatgaaggggagtcggggagagagaggaggaagaagaggaggggcgaggatgacatgtgggtcccgtgtgggcccccaccattttttattaatttgcgtgtgaaactgacatgtgggtctcatgagttttattattttttctagatcgaattgccacgtaagcgccacgtcagatgaagaccgagtcaaattagccacgtaggcgccacgtcagccaaaaccacccttaaacccgtcgagggacttaatttacaccggttttgatagtcgagggagggacgaaaatcgaattcgttgacaagttaagggacctcagacgaacttattccattcaaacgagacattgaaagcccaatagttttagaaataagtctattttacctcttttaattcttgctcctgattgaatcgcatccctcgaccacaatttcggtattgccgattgggagatgagattcaataaagagcaagagttaagggatgtaaatatacttatctatagttttatccaagatgctttgcacacgtcacatgaaacccactcccacaaagaaaacgtaaaaaatagcccaactcgaatcaatccacgtctccaccgttcatctaggcccacgccgtcggaaaaggcgaaggataaagcatccaccctggtagtggtaggccccacaccgtcagcggcacacgcgctcagctcctcccagcggccggcctcacggctcacctgacctgtcacctgaatcacctcggctcactctgctcggcgtctccatccaccctggtggtagtcaagcactcaagctagtgtaacggcgagtctaccgccgcgttgcccgacgcggccatgccgccgccgcccgaagacgacgggtcctcctccgcgcggacgccgctcataccccccacacctcctcctcccggccgagcggtggcgcggctccaccctctcccgctcctcgttgcggcggccttcgccgcatcgtaccacctcctcgtcgcgcccgcgccgtcgtacaccgctcgctcttcctctccctcggatccaacgacaccgcggcagcccacctccacgcgctcaccctccgcccccacctcgcgggcaccgaggccaacgcccgcgccgccgagcacgtcgtctccgcgctctcctccctctccttccccacccgcgtcgtgccctactccgtcctcctcgcctacccggtccaccgctccctctccctctcggcgccaggccacgccaccaccccctttgcgctggtgcaggacacataccccggtgatccctatgccgcggtctccgcggaggccgtccccaccttcctcgcatacgccgcgtccggctcggtcgccgccgaggccgtctacgctaactacggccgcccggaggatttcgcctacctcgccgcccgcggcgtagacgtcaccgggaaggtcgtcctcgcgcgctacggcaaggtgtaccgcggcgacatcgtgataaacgcccggaaagctggcgcggcggcggcggtcatatacaccgatgccaaggactacgcggcgggggaggccttcccggatggtccatggatgccgcccaccggtgtgcaggtcgggagcacgttcaagggggtgggggatcccacgacgccgatgtgggcgtcgtccgaagggtgcgagcgcgtgagcatcccggaggcgatggccaccgacgacatgccggggataccggcgctgcctgtgtcgggaagagatggggaggctatactacagcttatcggcggtgatgtcgcgcccaaggattggcaaggcggagatggctcgccggtttaccggctcgggcccgggccggcggtgctcaatctcacctacattgtaagttgctgtcgatgaattggactgtaaaggtgagatgctttataatccttttatggctcgaggtagtgatgatatttgggtggcactgtttgcaggggaacgagacaatggctactattcagaatgtcatctcagtgatcgaagggaaagaagaacctgaacggtaaactttatgctctaatactgtactgcccatattttctgtccggagagttcaatatccccaactcggccactgttcagtgttcgccttgaagagtgtaaagttcatgccctactcatttaataaagcggaaccatagaaactgaaagagaactgttttacatttcgttgttgatcaccattctgaattttcatcaaaaaatcaacatttatttcctacttcttcctattcttcttcttcttattattatttttcttcctcttctttttttcttcttctgtttcctttttccttcttctgtttcctttcattgtcttccgttgtttttccactctaatgtactcttgctgtaacaccttgactaccattaataaaatggttacaaggtagagcctctctaccttcttcagtccaaaaaaaaaaatcaccattctgaataagtgcctagtagtgatgaatttatgagtcaataagaaaacaatgcagtaaaataattatgaaactcacgcagctatataatccttggtaatcatcgtgatgcatggacttttggggcagttgatccgaacagtggaacagcagccttgcttgaggtatgcaatatctggttaccctattgacactttttatttcattgaacttatgatctgtggctatttagttagctcaaaggttctctgagctacaaaagaagggttggaggcctcgacggaccatcatcttgtgtaactgggatgccgaagagtatggactggtacctctctctctctctgtgactattatcagaagtaattcacatgtcaatctatattcttatttcttttgtttgaaaatgaaggttggatccactgaatgggttgaagagaacagggctatgctaacttcaagaactgttgcttacctgaatgttgattctgcagtgtatggtgcagggttttatgcatcagctactcctcaacttgatgagttgcttaaggaggcgagtaaacaggtattccagttttagatgaatttcctttagtcaataacagaatgttgcatgacaaaaagttacaagtgatctttgctgcaattttttttggttactgatacagatatctaatttattttttctgttggtatgaatatcaatcaactatagttttattgttaggctgcaggaat

SEQ ID NO: 55455 - DNA, 704 bp, Oryza sativa
ttactccatggcattcagcatattgctcgttaattacacagctaattaccttgcttcgttcaatctaatggagcccaacacgcatgatcaaccagcgcaaagcaaggttttatatgccaaatctacttgtgtttgtgattaatggtcaaggttttatgtgcatgcttcacccgctgttaggtttgcctaggctcaagaaaatttttagatccgttactgattagatgaatcaaacaagtgtgctgcttgtttgcagaatatgcggtctaccatagcttgtatgatgactttgtgtggatggagaagttcggagatcccttgttccgcaggcacgtcgcaggtacccctgtatggctatatcttactttatgtatatttgtcatggcagctgtgtctgttcttgggggaagcatgatggcatgacattttcatgtacatgttttttcaactttgtatgaagaaacatgaatattgaaacattctctgctttgctgggaattgaacctcatagttttctatgcaattatattcatatcttacctttttggccaaactatatgtagaacttggatatagtacggatgtattgttgtagtgcacatgtactgagaacttgcaatgttccactgcatttatataattgcctaataaattaagtatgcaagtaacttttggtataaaaatttatgtgtgctccatcattt

SEQ ID NO: 55456 - DNA, 6415 bp, Oryza sativa
aaggcaagcatagtggtcaccagatggtacaatcatatactcattcttcatcatatcaaagtaccttttcccttcttcaactaggccagcatgactgcaagctgtcaaaacaactgtgaacgcggcgttatctggggtgatgccctccaagagcatctgagaaaaaagctctacagccttgctagctgaaccatggaggcaatgaccttgcatcattgaacaatatgaaaaaacatctcgaactgacatagattcaaacaaaagagtagctctctccatgttgccacactttgcattcatgttaatgagacccgccatcacatggacattgttcatgtctattggataaatcatgatgtaaccttcaatccatcttgccaatgtgatgttaccaagttgggagcatgctgacatcaaaccaacaataacaagctcatctggacatatttcttgcttttggaactcgttaaaaatcctcaaagcctctccagggtaaccgttctgtgcacaccctgatatcattgttgaccatgcgaacaaatcacggtcctctagcttatcaaacaatgttctcgcagctcccatgttccctgcatttaaatacccgccaatcaatgatgtgtacgctgcaggagttctctcaggcatttcatcaaacagcttccttgcaccctccaagtcaccgcacttcacatacccatcaaccatggcattccaatgcaccacatttcggtgtggaaattggtcgaacaactccctggcagtcaaaatatcaccagagttgacataggcagtgacaatggccgtccaagagacctcgctggggtttgtcagtgaatcgaacagagcccgggcggcggcagcggcgccgcacctcccatagaactggatgagcgccgtgcggacgaagaggtcggcgtcgactccgaggcggatggccgcggcgtgcaaggaagcgccggtggggagggaggaggcgcgcgcgcaggcgcagaggaggggagggaaggagaaggcgtccgggcgggacgcgcccccgcggaggaggttgaactgcgcgagcgcgtcccgcagcggggcgtggcgggcgagggaggcgagcacggcgttccgcaggcgtaccgggacggcgacggagaggagggaggcggcgacggaggggcaggagagggcgtcgcaggcggcggcgaagcgggcgaggagcgcgtggtggttgtggaggccgaggcggacgatgcgggcgtggagctgggcgaggcagcgcgcggtgcggcagcggccgaggagggtggcgaccggtggggatggccggaggacggcggtggtcatgcggcggcggcggcggcgagcggggaggccggccagcgggtggtcgcatttggattcgcctcgcctgggttaccgagtttcgatcgctcgaacccaaagtcgagtcgactatggatgactggatcacgagttgggcttgggcctagccatgttggtgtggtgctagactgctagctagcccagtagcaaacgagcaactaatgtaaaaattcagaatttttttgtacatgtttacgatttttttaaaagaaaatctacacatggttttcatatatccaattgaaatatttgaagattgatggtttgattgagttttggaaattcaacttataaattatgtagaatcaaaacaatatgttgtatcctgaattacgttcgttcaagaatagctcaccggttatgtttcttgtatttgacccaggccagcctgatttagggctattcagattgatgtcattttcaaccatactatttttgagtaaagttgccaaagaaatgtctatgtttagtttgttgttaaatttggtaaatacataaaaaatcctgccaaaattttgacaatattgccaaaatttttgaataagtctatgtctaggtttattttggctataatctgaacagaccttaagtcctactcactccgtccctaaatatttgacgtcgttgacctttttaaatatgtttgaccgttcgttcttattaaaaaatttaagcaattattaattattttcttatcatttgattcattcttaaatatacttttatatatacatatagttttgcatatttcataaaagtttttgaataagatgaacggtcaaacatgttttaaaaagtcaacggcgtcaaatatttaggaaataagagagtatatcacaggtgtttgtaattatggctaattattctttcagtggtagacgagatacctatcgacagcaagatgttcgtgttgacttcatcaatcttaagatatgtcggtccagtcttttgaaaatgctagaaaatcttataatataaaacggaggaagtagtagatatgaggtatcccatacactcatacttactttacggggaatgtagttatctactccctccgtcccaaaaaaaaaaggcaaacctgggttcccgtgccaacgtttgactgtctatcttatatgaattttttttataattagtattttcattgtagttagatgatacaatatgattaatattttatgcgtgacttatctttttaatttttttcataattttttcaaataagatgaacggtcaaacattagacacggaaaccagggtttgtctttttttttagacggagggagtaattgtacacaaaaagatatctatgaataggggtatactaggagtgaatacgcgtcacacaaggaaagattgcatagttcaagtcatagacgttatggcttcatggacaagatctagtgtcctacttgggatcaagatctacttgaaccagggtcgtattccggtataaagacacaccacgtcctaggagaatagggcgtcaaatctcaagccacagccttcatgccaaatccatttaggggaagcccagagctagccgccaattgcattgttgccgcatctttagagttgtaatagtatagcccactactagctctaaattatctatagccaatgtaataaccaattcatacaatagttgcttactatactattaatatctgatcctatatatcatacacacattatgttttggagtccgtgctgcaactggctacagatctgtagcccactgctattctctctatttctttatctttttaaaatatgtttatagttggcttatagcctgctattgtacctgctcttagtcaaggttagttgagtatgctagattagagatcccacctcagacatcatactcagtgtgatactttcggtcaatagatataaacatgaatagaactattactcacattgagggttcgaacttgtaaaaatctaattgcatttcttcttatgacatctacgtgcatatccttataccgatcttatacgctacatccacaaatactatagccaggatcttactcctcaataatgctatttaacaaattctaaaatatttgacaattgtataatcaatgaattatgtaaagagaaaggttatattacaaaccaatcaattttgtgttcttaaatatttgttaaatggcaaaatttgctacatgatatcagatattatggtatttattggtcgataccgttaaacatgggttggttttgtgatactacaaaattttggtggtccagtaattttggtggtctgtgcgagtgtgtaattgtgtacaactgtacatgcagtgtcgtttgtgcgtgcgtctgtgtctaattgcgaaaaagatttagccacaacacatatatttgtcctttaaagttttaaggagttgaggagaattacaacagcgtacatccgcaagaggatcaaatcagagccctatacaaaaggaaggatatgcagcgcacacatccgtccgtacagtcaagctaaccaaaagccactgtggattcattcacttgtcgaagtagccctcggtcctgcccttgaacccgatctggccgaaggtgagcgccaggaacagcccaaggtgccacgtcaccaaccacagcctgcaaattaatcacaaaacccacatgaacaattagacacgtagccactgaacgcttttgctactaattatataggagtactatactgcgtgcctgaagaagatagaggtactgaccagaacggcgagtcgagcgccggcggcgaggggaagtgggagagctcctggccgatgctggagaagaagagccccgtgaggctgttgccgttgatcgccgggacgctcgacggcgcgatccacccgatcagcccgaacccgatcacgttcaggtccctcctaagccagtcctgcggaaacctgcaggcccaacacacaacaccacgtacgcaccgtcagaatctcacgccacgtacgcttgctgctctcagaattcttcttgcaggtgatcctactactgctacttacgtcatgcaggtgatcctgccgttcctctccaggttcctcgtcagcagcgggttcctcgccgacacccgggcgcccgtcgtgaagcctgcacaaaaaaatcgagcattccaagatcaaattaaacacacggttatagcgcgtgagaagatgattgtgactgtgacgcacgcaccggtggagaaggccggccggcgggcgagggtggcgccggcgaggccggagacggtggaggcggccatggcagctaagctagcagatggtctctctctgtctctggtcggcgagctgcgtgtgttgtctccgtggtttgtggcagcgtaggttaggccttattttgtggtggtggctgcggttgcggacgtggcgggaggggatgagcgggcgcggatcgttgtgggggctcgcgtgatgtggatcacttgcagcggatgaaatagattcgtcgcccgtgcagcggcctattgggagactccacttggatatgagtggataaggccagtgccacggctgtttctgccgtccagtatgctgagtactcagctagtagttcctaccgaggcaaacttaatttcgtcagtagaagactatggcagttttgtggagattatggataccccatatttacacggcatgtatatccgactggatatggaatgccatatataggtagaatatctttaagggactcgggttacattccttaacttgtatatcaaggaaatactcgggattctagtcggttacgactgtattttatctttatttgcctattccgttaggaatataggctataccttgtaatacggactcctctccctatataaagaggggtccgagtatctcttgggacataacttttctcccagatcatacgatcaataatatactcggtggattaatccccggacaggagtagggtattacttctcattgagatggcctgaacctgtgtctctaaacccatccacttttctagcttgatagccaccctttttcgtattaccgaaatctttgtttcgacaagtttaactgcacgtagtagtgtacccgcaaatcatactttggtaggcgatggccggcactatgtttttccagatcaggtactctgttttcgtgctactaccttggaatgtgatcgaggtctagactctagactatgcaattggtgaactggagctgtttaacgaggtaaagtggtgaacaggtagataacttgtgtggatgtgatgagccaccggcccgcctagttcgttcacctcacaaggcatgataccgggcttcgctgcagacagcagactttaccaattcaccgttgcacacgatcagaaacagcggctcgtcgtaagttcttaacccagcgggcgggagacgcaaatccgtaaggaataagttcacttcaggtcccctatttgtcgctcagtccgatttttgtcctgaaccacaaaaccgggtacgacccgtcccccaactttcaaaaaccggacaaatgagatccctcggcggtatggagagcggttttggccgacgtgacgcctatgtggctaatttgactcagtcttcatctgacgtggcaattcgatctggaaaaatattaaacactatgggacccacatgtcagtttcacacacaaattaataaaaaatggtggagcccacgtgggccactgggccccacatgtcattctcaccccacctcttctttctccccatctcaccccacatagcagcggcgccggggacaacgacggagcggagtggggggcggcggcaggcggacggcggcgcaaagccgacggggcggagtggggcagcggcgggcggacgcgcgggcgcagtggcggcgcccgaagccggcggggcggtggagccaagcgaacggcgggaacctcgtcgttggcggggtgcggcgctaagtcccgcccgtgtgcggctgcaactcggcggcaacctgctcgccggcctcctcttccccctctcccactggcacagccggccgccgtggtctcctcctcctcctcctcctccacg

SEQ ID NO: 55457 - DNA, 13305 bp, Oryza sativa
ccacgagaggggagggagagggagagggagagggagggaggaggaagaagagaagggtgagaatgatatgtggggctcacgtgggccccactattttttattaatttgtgtgtcaaactgacatgtgggtgccacggggtttaatatttttctggatcgaattgccacgtcagcgccatgtcaatatcacgtcagatgaagatcaagtcaaattagccacatagacgccacgtcggccaaaactgccctccatactgccgagggacctcgtttgtccggttttcgtaagttgggggatgggttgtacccggttttacagttcagggacgaaaatcggactgagcgacgaatagagagacctaaagtgcacttattccaatccgtaaagatcccgaactcccgaaggccagcccattccgcggctaccatacacactagcgtggttacttttcataatatactccctccgtcccaaaataaataatgttttgcattgttcattcaatgtttgactatttgttttatttaatattttttatgattagtatttttattgttattagatgataatacatgaatagtactttatgtgtgactaattttttttatttttctaaataagacgaatggtcaaacgttggacacagatatccacggatgtacatattttgagatggatatagtatatagcaacctaagacaaaatttattgtagtataaaatatcacatcttatcttaaatcactatattatgatgagacggacggagtattactgaatggttcatcgcgatgtctttgctccctgattgcaatcagcttgcacttgcttcctaacaaatttcgcattaagtacaccaactgttcatttataactatgcgtcaagcgactaatgagatactcactccatcttaaaaaaagcaacttagtactgaattggtcttattataatactataaatctgaatatgaatagatatctatctaattcatgatactaggggtgtgtttagtttacgctaaaattgaaagtttggttaaaattagaacgatgcgacggaaaagttgaaagtttgtgtgtaagaaagttttgatgtgatgataaagttggaagtttgaaaaaaaagtttggaactaaactcggcttaggatacatccttatccatattcatggtatttgaatgtgtccaatcgtgtgcaaaattgctactccctcagttccaaaataagcgcaactatgaatttctgtgtctaattttaatcgttgtcttatttaattttttttaaaaaaactaaaaacataattcacgcataaagtattactcatgttttataatttaacaacaatagaaatactaatcataaaaaaaattaaataagacggacgattaaagttggacacaaaaattgatgcgcttattttgggatcgaggaagtatattttagaatgtataataaaaaacaatctagaggatctaagataacgatatccagattattatcctaggttatatcctattattatttatattggtttattttgaagcggggaaagaagctagcattctagcaaaggagtagacgagtagctcggttcattggccgtcgtaccatgggaaggtcgctgaagcacggagccacagagcaagagggtgtggaagtgtttaactggaactttggggcgtaccgacatccaaccaaaattttctccgtcgattccacgcgccaccgatcgcggcgtccgatctgtcctgaacttctgatcgactgatcctgatacatcagcgatcagttcagttttcccatcccgtacacagcttctggcggagagtgtcttacaggataaccgatcatcgcccgttgtcagtcaaacgaagccatgagatgaactgctctgcatcgtactacgtacagtgagcccgtgagatcgagagcgacgccgaccaaacagccttcgtcgacgggattccttcctaacaagacacgtccagagtccaggactcttatcagatccgatcgcaccaaagagcacgtacgcacgcgcggccgctgattcgagccaagtttttccctgggtaacatgctggattagatggatcaatcgatgcaataccgctagaaacgaaaagatggtgacaaaagcaagcaaaccttccaggacagcagcaggtcaacagatatatactacacaagaggaagagccgaatggtttgagtttaggtcatggaattaactcagaatacgggatcacaagcttgaggctggaggtgctgccaaagcactcttctaactcttcacctgtacgccctattcaatgaaaagacactctagtgctgttttcagtttttttttaaaaaaactcttcacctgtactgaatcagaattatagtataattcagtactgcacaacgtgcaaatagaggatcgatgaaggcggcttgaccgctgaagacacggcgacatgcaaaggagaggcttgcgagcgcgcatgagacaacatggggaatcttaacttggatgtcaaatgtggcatttggtccagatgaagttcctacattcattttctttacctaatcgaagctttccacgattccacttctagacttgtcctagttcaatgactaattgtccacaaggaatatgcgcgagtcataaacaagctgcgcagaaaacagcttctctctccgttttacaccctccattttatagggtaagtcattttaacatttttcatatttatattgatgttaataaatctagatagatatatatgtctagattcattaacatcaatataaatgtgaaatggtagaatgatttacattaagaaacggaggaagtatataataatgcagttaaaccgggagacgatgagaaaatggagatgtttctctagagagaaaaaatgttgtaactcgagataatgattaattggcgttaaccaaaataattatctcagtctagaacacaacagaaggttctctgtgagactaaaatgctgagatgcacttgacagtgcagtggagcggtaaggggtatgtaatttcaactccaagattttgtgtttgatcctaacatgctcataattttttcttaaaaaaatgtttgaagggacatttctccctccaaatatcttcttattttttagactgaaaatgttgaatttctgtctgtatgaagttatttttttgaagaatctgtttttactccgaaacatgccttgtgccgagatcactgccacatgttcctgagctgcattctttagctctaattagggcttatatggttctttaccatttgtgatcttaccatttttcttttttacaatggtaattactaattttttggggaaaattgactaggcttttgattggtaagggcttgtttacttttgtgtcacttttaaccctactaattttggtattatcaaatttttgtaaggcaacaaattatacatattcttattaatgttaccctaccaacctttggtagggcctgttcactttgatgctattttcaactttaccaaattttggtaaagttaacaaaaaagtggctacatttagtttgctgctaaattttagtaactatataagaaatcctaccaaaattttggcaagttgtcaaaattttgacaacattgccaaaatttggtaaggttttttttcggcatcaaagggtctattcactttgatgccattttcaaccttaccaaattttggtaaagttgccaaaaaaagtggctacatttagtttactgtcaaattttggtaactatataagaaatcctaccaaaattttggcaatgccaaagtgaacaggcccaaagttaacaggcccgtagttttataagtttccactcgtaaaaattccatcaaaacttgataaggctgcaacaaaacatatctagcactaaaaatttggtaatgtaaaaatgtgttaaaatttagtataaccaaattttggtaaggttaaaagtgactataaagtgaacaagccctaagccaaataatttggcaatatcaacatttattttttgattggttaattttggtctcaaacaaaagaagcctgaagcctgaaatctgcaatctgaaatctttagacagttcccgtgtactatctccatcactaagacttcatttttagcccatttctacccatgccaatacaaaggaaaaaaaaagaatgttcttactttagcaaactccaatataattattctccactttagcaaatctcaatacgtttgtctcccaatactctaatgcaatgatcgctgaaaaagatggcgtctctgtaagacaaatagatggaaaacaaacttattctgagatgaaggaagtaataccatagtagcatccaaatctttggtaaaactatcttttctcttaaaaacatggtaactcaaaacattatactaatgtaaaatcggataacttagtaccatcttaaagatactcgagttgtaacataacatcgtaacatgataatgacatataaaggctggatctctggatctacatactaatgacgtactccctccatcctataatataagacgcacacgtatttaaagatttagcatttaaaatatttcactaacacttagtataatactcccttcatctctaaatgtttgacgtcattggtttttttaaacatggttggtcattcgtcttatttaaaaattttaagtaattattaattcttttcctatcatttgattcattgttaaatatacttttatgtatacatatagttttacatatttcagaaaagtttttgaataagacgaacagtcaaacatgtttaaaaaagtcaacgacatcaaatatttagggacgaatggagtataaaataaattttatttgttaaaaattatatcagattgatatttaaatttactttctatggtagtagttttgtggctaggaaccttatagggcatggaaaattataggttaaagattagttttggagaccgtgtcaattttgaccgcgtcttatattatgggataaagggagtagcatgtattttttagctcgtgatttttacagcggtaataaacaaatttacccatgtaaaatagatccttgccatacatattgcaacgtcatgcagttatatatgaccatatgaggatttgggccccgaaaccctgatgctagttcaggcaacccatgacggccggccgagccaaggcttcagaaaccattatgagaaaagaaatcaaaggatatatatgattatcttattgcggggccaatctgaatctactccaatatgactttatttaatcttcagtttaattgctctggcaatcatgaccgcgactctaccgacatgctcagactgatcgcccaggctttgaaagctgaggaacttcaaaaatggagcgcgagaaaattgcattatgcatataaacagttctaaactctgaatactattgctctgctttccccagctgaagcacaatcacagaacaacagcgtagcattgctgtgcatctaaactactcattccgtctcaaaatacaataacttctctttgaatttgttctaaaatataacaacttcttcaccagcattctctttccaaccaatcacaaacctccatcattcactttttccatctacctccatcttaataactgtgcataactctaaaatttcttatattatgagatggatagagtagtaagcagaaagttaccacatttgtttctcattttgattgcttcaccgaacaccgaacgagagatcatgcagaaaatcgcaagatcaggagaaagctcgtgtgctaaaaagaattattaggagaggcttatcgtgtcaccgcgagaggataggaacgacacacacggacgtacatatccctgtatcaatgcgcctttcttgacgagaaatctgcaagagcaacagcgcagcagcacacggtagctgtacgtacgcaggccaagccgtcgtacacgtaacacgtccagtagccctcgatctcactctcccaggacattaatgccggtgagccgcccccatcgtcagcatctcagcggtatgcagatgccgtgccgatcgttcgacggccttctcccccccgcgaggaaaacgatatccttctaaacgcaattaagaatcagatacacggacacacggtacaccggtgcacaacagatttgctttgccatcaagccagaaaaaccggtcgccgtgaaaggcacagggaaacaaaacctgtttttcttttggttctctgtcacgtcaagtgcaacgaacggcacgtctcgcttgcgtttgcggttgcgcccgaccaaccagccgatcgcacgacgcgtaccgactcaagagtcaggtagacgcgccgcggcgtggcacggaggagacacggcgcgccacgcgttcgcggcctgagatgatacgccgaggcgagccgcgtcgcgccgtaccacgggcgccagcgcggccctggcacgcgccaccgaccccttctcgtcggctgccacgccggcgccctgcactgcaagccgcgcccacacggccacaccggcatgcgggttaaaacgaaagaaaattgtgaaacacaccaacgcactgtacaggtactggaccacgtcgcagccaggacggctgtggttttgaccagagttcaccgcgcttactactagtagggcacacaaggaggagtgctatataaaagccggaccacggcggaggcgcagtagttatcaccggttcatcgtacaaaagaggagagagagggtgatggcgccagggagagaagaagagaaaatggtggcgactactacgatagaggacctgcacgccgacgtgctggcgcgcgcgctgcggcggctggacgggcggtcgctggcggcggcgagctgcgccacggcggggctccgggcgctcgccgcggacccggagacgtggcgcgcgctctgcctcgcggagtggccgtccatggcggggcacccgcggctgctgtccgtggtcccgccgcgccggctcttcgccgacgcgttcccgttcccgcgcccggacgccggggagctcggcggcggcggcggaggtcccctcccgtcggagctcgtctcggcggtggacgtctactacaggggggcgcccctgctctcccgtgtcgtggagacgcccgcgtcgtcgccgtggttcctcggctcgccgttccgggtggaggccgtggagtgcaagaagccggcggcggaggcggcgctgtctccggcggagctggagctgagctgggtggtcgtcgaccctgcccgcggccgagcggtgaacgtgtccagccggcgcgccgtggcggtggaccggcactggtacaccggcgagacgctggtgaggttcgcggtggtgctgggcgggtgcaagttcgagaccaccgtgacctgctccgagggggccggcaacatcagcgaggtcagcctcgccgtgcaggacgccgacggcgccgcggcgagcggcgagcgaagcctccgcctcctcgctgcggcaatggaggaacagaggataggcggggggagagaacgggacgaggcgaagaggaggtatgacgagttcgtgaagagcaggaaggggaggaaggagagcaaggcgcgacgcgaggcgctcatcgacctgtgctgctccgccgccagcgccatggccgtgctgagcttcgtcgccgccgtggtgctccggtgatcggcggctgcggttaggaaaaagagaggacaaaatgtggccttctcttcatcagtgtacaaatcgagcagagaactcgcgtgtatttttcttccaccgtagttacattattcttaaactataaaaattggccaggtgcttatcatccatttaaaataggagataaaacacctgagctgatcctaggatgtgacattaagcctagtagaattgacattgttcgcatgttccaatctcatgtagtagtgcttttttacgtttcaatttgaaaaagaaagagtaatgttttcccttcaaataatacaagaatgcagaaaaaaatgtgccgtctgtccatcgcattacaattcatgttttccgtataatcaaggtactgttccacagttttagggaaatcaaatgaagtttaagttaggagtacttgaaaacaccaattcattattagttccatacagaacactggacagacatggaggaaggacactgttctaccacagcttcatcaagagcatatgcaactatatgaacagcacttttcagatcatttcatggcgacagcattatagatactgtccatgacaaagaaggaaagggcacagtatttgatcggcaagagcatgtgatgttatatcataatctgagctgttgatcgggcacatcttcttttattgcaaaactggaaatccagtattattacgcatgaacttctcaataataataggaagaagtcccaataacctccccataaactttggatgaaaatccattagcacctgaactttaaaactggacattcaacattctaagctttgtaatatcgttcatattactctctatggttttaggtactcccaatctaacaatagactactcgtgcagcagataaaaaggaaagtatgaagatgacacgcatgctatcaacagcggtcaggtggcttaggaggacctgtcgctcttggactggaatctgtagtacgattcattttggccttcgcaatgtcgacatagataactcggccgttcaatacctgttgcaagtttgcgttaatcaaatcaagtaggaaaaacagagtgtgcttctaacttctaaggccttgtttgcaagactgatattctacatgaacttgctaggaaagaaacaaccaacccttaaactggattttggggtttcctgtgaagttcatgtggtaatccaacattccaaacaaggcctaggctgaactaaaaatacactgtttcaaaaagcttgccttgccgttcatctcttcctttgttttattggcggcttcttcggaggcaaatttcacaaagccgaatccttttggtctgttggtcatcttatcggtgacaattgttgttgcatttgaacaagaacagtttccaacttactagtaatgacaagaagtataaaccaaagtgtgctctaggctcggctctggtaagttacaagtaaatgtaccttctagtacctggccatactgagagaaagcttctgccaggctatcctcggtcgcgaattgggacagccctgtaaaaggatagaaactcagggtgaatgcgtctctcgggcatttcgtcgaacactatgcatgcacaggcttgccgacttgccgagccgccaatcacacagatctgcacgcacgagagacggcgagcgagcaaagatctgcagcgctgtgatgacgccatggtggagatgttacacaagcggcatgcgcgagtcaggaaacgggaggagacggagacggggggtgaggtttacctccgatgaagagcctgtaggtgatgccccgggagtgcgtgaggaggaaggggcgcgcgtaggccgccggggactccctcctggagaccagacggcgggaggcctcacgcagcgccgccatcgccatggtcgcgccgggaataagctcttccagaagagagtgagcgcaggaagcacgcgatgagagtgtggaggggacactaggaaagttcggttttttcctcgacgcggtccacgcggaattcgtggttttgggggatttggacctgagcagaagacatactacaatttaaatgtgactttcactctgtgagtgattgtgttatgtgatgcattattctgcacttcctattgtgattgccacaatgagagatcaagatatgcacctcactttgtggcagtaagtacaaactttactcggttttgtgacgaagtgatctgggatgttagttgctaaaattttggattttatctattgttttagaaaaaaaaacacttggaagctcacttagagggatttttatattccgatatatttccgttcccatatccgcgtcattttgtattagctctgtttccgtatccgataatattcgattccatttttgaattcaggattttttttattgtgattcttaaaaagatttgaaaacgaaagcggtaaaggtggtttccatccatttctgagtcgttttcgccccttgaaaaacaacatattaccccaatctacgtagttctactggtaaataattcatacttgagtcatattaagtaaaaaccatcaaataaaacctatgaaaatcaaacataaaagttttttaaaaaaatattagatataggtatagtcataaaatacattatgtctaaatatcaagtctaaatttaacttcgtttgagtgtaaaaaaaaggatgaatagtatcagggtaatattcacatggaatttgtccctttttttcctcttggagatcggatttaagattttgtgtaaaataatttcaaaactataaccatctctgcatttttttttcatgaacttagagaaatttagatatagttttcatgggttttcaattaattggtggtttttattgcacgttttttcttggtaccaccagtcacccaactcaccacgcgaagctccatggccgcctctcctccccaactcgccgccgccgcggcgatcgcccccgactccgtcgacagaattggttggtgacctggtgcaccgtccctttgtaagtatctatctcgtcatggccttcgcatgctcctcccccccaccccggtgccttcggcgggaatagtcaataggtagggtttaacagtggcgccgattgacccgatcggagtttttttgctgccgattgtttgtttaagcctataatccaacttgctacgaagcttagtagctagcagtgctgctctaggttcaattaggagcgcttcgccggcagccacctctagcgccgtcctcgccacgcctcaatccgaccagggaatcccctgcaggctgacatgaccgcctagtgatgcgtttgatttgaggtatcgatgcaaacccctcccgacacaagcgtcccaacttcctaggaagtcaagaccggtgaggcggtgacatggtttttccatcattatggtcatattatgccagtttcagtttaaaaagaagttatattatgccaatccatttacccatattgaagcatacgatctgtgctattaagttgttccaaatatctttgaaatatgttgccatattgaaaatttgatcacttaaatgcagatagcatctgaggtatggagaaggattggctagaaagacatgggattcattacaataagcaagaggatgctatgtatgtcgacagcacaagaatgacccttgtgttgtttttgtccgtaaggcgttctatctgatgctcttcctcgtgtttttttaggggtaaaatcaggagctctgcctatttcatattaggagaagagagaaaaaaaacccagagtttttacaaactaggttacaaaatgatcccatgggatcccccttgaggagctcttcctcgtgttcgttgttgttgttctggctttcgggactccataggcagcaagttccctaataagagcacgtcgctgcacctacatatagtatactgttactgattcttacgttaagtatatcattctatttgtctaatctacaagtagcttacatttgtgattctaaatattggcagtgatgcccacctctccagatcccaaagatgttcccttctgctataccattgtcaagccagtattcattaccttcactgttgatggaacatggaacccctctcctgtatatgcatagtgtgggggtgtttagatggtgctaaaaattttttagcccatgtcacatcggatgtttggacgttaatttagagtattaaacatagactaataaaaaaactaatttcataaatgagagctaatccgcgagacgaattttttaagcctaattaatccataattatcaaaagtttactgtagcatcacactgtcaaaattatggcgtaattagactcaaaagattcgtctcgcgaattagtccaatattatgaaatggattttataattagtgtatatttaatactctaaattagtgttcaaacattcgatgtgacaggaccttaaaataagtctcgaaaaccacacagccccttagctcttcatatagcagtggggcttgcctgtcacatcttgagtgaggcattggtattatgcgcgcttccccacctctgctggtgctaagaacggtctatttggcgtttgagagtggtatattatcccagcgatatttgaacatctgctttgttttactaattttatctttttgctagcatggtcttatgaacatggggcttcgaccggagcttctggttgaaatcacctagtgagcaactggaaaattggtcctctctttaatggtaccaacgaatcttctctgaatcttatttcaaccaaaacagcaaatgcaggttaggccgagtttacttccaaactttttttttcaaacttccaacttttccatcacatcaaaactttcctacacatataaacttccaactttttcgtcacatcgttccaatttaaaccaaacttacaattttgacgtgaactaaacacacatataaatgcatcgttgattcctaacttctggtcagctaaggtagtactagcagcgaacagaagcctttgtatatgtacaggacaatgaagtgggttaccaaatttcaaatgcccggcaggtatcttagtatgcagcaagtcttaggcaaaatcttcaaatgaattaaccaaaaagacctgtgtgacacatggccagccagccagcctgaaataggtgcacaggtaccaggggtccaaatggactcaacaacaacagaaaccaattcaattttaccaagactagaccaaaagatacataggtcaagccagtttttacttagtagtttatccaatctatgggattactactgaattagagcctgattctagttagtttcgccctgttaggcacccccagaaaatgggttgaccaatgtgacgccgaattggtgcacattggagccatgctgctgatgtcaattactatagttctagcctgcacaagttaccttgttcctgaactcatgctagtagcagctccagtattggctcccaggactgtaaacacaccaaactagttataatattttcagaattgccttagaaatcattgacagttggttggtcattgacatcatccatcccgtcatattttccatgtgtaattggctgctaacagttggttggtcttgcagctgca

SEQ ID NO: 55458 - DNA, 10061 bp, Oryza sativa
  unsure (1)..(10061): unsure at all n locations
tccggttttggtgccaatattggtactgactactgactcagaaaccccttagcttggagtaattagttcatttggtgtgttcaatttgatctctgggtgataggctgatgcttagaattcgtcgtaattgagtgaattgggtaaaccatacggggattaatttctgctatctgggtacagttagctggattagagcattagaattggtgctaatatgttactgcattgctgtggaattcagtaccaaatcctcactttcacctttctgaagtgctttgaatattggggatctgaaacaccgtatctactgtttggagatctgaaacaccttgcaagagttgaccaatttcagcaaatcttgcaggatcatactagtaatcctcgtcatattcgatgatatcgctggtgtcctcacctccaagtaagtaataatcacacaaccacaactcatcagctgttcctgtaatctgctccctgtaacctggcaatccccttcattgaatgacaggataccaatgtactctgaactcagactcgccttcctcgtctacctgtggtacccccagacaagggtatgtaatgctatgtctgcaacgcttggtccagcaacaaagctgcagctaactgcatgtcctgatcattgtctgaactaaacaagatttgccacaaaactgcagctgcacataactgcatctcctaatcatatctgaaattctgaactaaaaacgagatttaatctaatttgcaacactgagtccagcaacaaatctgcagctgcacaaaaagtgcatctcctgaccacgtctgaattaaataagattttgctttgtcactctgaaccagggaactgacatcgtgtacgacaccttcctgcggccgctggtgatgcagtaccagcccaacatcgaggagcggctgcgctacctgcgtgccaatgccggcgacattctcatcttctacctcaagaacttcaccgataggggctacgatctcttcctccgggggatggagtacatccggtcccagacgtcacgaggctcaagaacgagggtatgttaccagttactctctgtcccatatcgtaaggtgttttagttttgttctaagttaaaattctctaactttgatcaaatctataagaaaatatattaacatctactctaccaaagaacactatcaagacatatttcatagtgtattttaatgaaactaatatgatattgtagatgttagcactttttcttttacaatcttggtaaagttagaaaagtttacctagcacaaaagtaaaacaccttacaatatgaaaacagaggaagtagtagtacacatgttgggaaccatggtcatcacaggattccggaaatgtaacagtgcagtcaaagaattcaggatatgtaacagtgcaggtgtgtaactatgttggcaatggtttgtttctgctgtgcagcggtggttctcgttcggaggcgaccgggcagagaggtcgagctacgttgatgattatgtcgccggcggtggcgatcggaggagcacggcgaggcaccggcgaccccgcgacgattactaacgggctggaccggcgccatagggattcagtagagagaggtgcacaggattggaaactagttgattaggagtgacaaaatttaaaaggcccaaagcaaaacttctcaaaaacatgatgtgtatatatatatagacaggtgatcactgatccatactctggtatatatnagctcctcacnaatttggcgttgcaggttggctagtttgtggtttctctgttgtgatttgtgcacccgtcttcgatagactacatgattcattttttgaaacctaaggcgaaactttgttccacttttatatttagaagaagagaattaacccagtttataaggaaaaccgggcccaaaaaccacacaattgcacggttaattataggaaaaccggctgaaacccaccgctacacaactgacaacgacggcggagcccaaaagcaggatgtcaccgccaagctaaacacaaaagcgatataacagctcccacatcgcagaagaggtgttatcgttgccgagctagccgcccaagcgacccaacagcgccgacttcacaactgcagcgacactgaagacacgaaagtcgccaaagcgaaaagcagctccgacatccaacaatagacatcagccaagccatcgagaagccacttccttcacgcggccagcaccccaccagaaggaacgaagtggacccaagaagacaaaggcctcaccgagcacaaggtatgaaagcttttgaaccgaaaaagaccatcaacggtcgtcgatgcattggaacttctccgaagcgacgcccccaaggaggacacgacgtgtaacgccgccgtcgctcgtctgaaagccggaacaaggttttcatctggagattgtgggggatatgaaagaatgccatgacaatgcctccaagaagggaaatgacgcccacgagcgccgccgtcgtcgaaccggccaaaggcacggcaaggctttcgccagcatcttcacatcacccacacaagcacccccacattgacggccacagaatagtccatgacgtctcacaagcacccatacctcaaccgtaaccaacggcaaagacggacccttggccaccaactcctacagcaagccgaagcctccgccctccccctagcgttccccacgaccagaacaaggtccggccaaagaagggagggaaaccgaaatgagggagaagactcggtcggcaacgaggaagtcgccaccgcggacgtcaagcccaattcctgcttcacgccagcataagccatcgtcccgccaactccacatccgcacatcgccgcccatccgacgcggaggggacggatccagccgcggacggccagatccagctaggacagcgcaagccggctcgacgtaagcgccgccgcagcaccgttgtcgttgcgaccaccacgccgccacagcctctgcctgcgcagcgctagcgccgtggccccgcgcggacgacgccgaggccaacgccgcgacaggcgcgagcgagccgccgctgcccgcccaccgcgacgccgcccctgcctgtcgccatctcgagccccgtcgccgacttctccctgccgccagccgccacctcaccagtgttgtcctccgctgctcctcgttgcgctgcaccgctctccgccgtcgccggctgcccctcgcgcgcgagccagcctccgccgtcgccggccacacctccgggaacgcggcctcccccgctgccagccgtgcctccgcgagcgctggcctccaccgccgcggccgcgcctctgcgagcgccggcgtccacagccgccggccgcccctccgcgctccttgcgcgcgccgcatccgctcctctcccctccgactgccgtctccggccggatccggcgggggcagcgccggatccgccgcctccacgccgggatgagtcgccgccgccgcgtcctagccgaagacgacgcgccgccccatcgccaccgtcgccaccacctccctcccgcggccatcctccaccgccgcctatgcatcgccgcgtcccctcgccggatccgcttccaggggcgtcggatccgccgcgcccttgccgtcgccggccgccggagccccccaccgtcgcgcgccgctccgtcctcccgcgctgaggaagagctttgccagttctcttggccccgccgccgccttcccgactggccgcacggctttccggcggcgagctccggtggcggcgaggtggttagggtgggcgggggtggcggcgcgggcggctagggttttgcccccgagccgcacgcgcgagagcgacgcggaggaccccactaacaaactagactacatgattcatgcgatgcaacccccactaacaaaccttttgatcattgtgatgaatacataatggaaacaaaccaaagaatattatactgttgatgatggataaaaaaatcaataccatacttgacgatggataaaaaaaggggatttttttttcatgagactccacacaagtggcaagccatccaataagactctccacgagtgacaggtcatacaactagttggagcaaccagctgctatttatagatttcgcatgcaaatctattcatcaagaatacgcatgcaaatctatttgaaagaattatgggaataatagatttcgcatgcaaatctattcaagaattatgagaatcagtaactaactagtgctatttatagatttcgcatgcgaatctatgcaagaactcataggaatatttgactaactaattaataagttaacgctggatattcctcctcgacctgatcaacctgtttcacgccgatgatgccggccacgaaccctaggcaagggcagacgtacctcttgacgaagcggtataccgcgccgccgcgccgggtcccgagcggccccggcgatcgccggcggtggagcgcggggtggggcctcgcgtacagccgcgacgtcgcgcgcaggagcgggtcgctgatgccggccttcggcggccggcgggagctctcctcgaactcctgcgagccgatcacgtcctcgaagctcacgtagccgggcgtcgtgtggcaccgcttgaagtaggcgtcgtgcgcggcggcggcggcggcgtgcaccaggtcgtcgtaggagtgcagccgccgcgagatgggcggcaaccgcgcctccgcccccgccggcgcggccccggaggaggagaagttgtcgctgccattgctgtcgctggtggcggcggcgctggtggagtggtgggagaggaggggctgcgagtaggatgcgcgcatggagaaaactggggcgacgtacgagacttacgagtagccgatcgagggagagattataagaaagaaagtggttaaaagatggagggcggtattagggtttgattatgagagagcatcacacccaactcgtattcggtgaagggggcgtagaaacgtattcggtaaaggggccgtagaaatagtgtatacagttatacgcacccggtttgccgcgcgccgtccagagaagattgaaactcaaaatcgattgaactcactcaactcaacccaaaagatgattgtaaatagatgtcaaatcgaaatagctaggtttcaccaatcatccgcggacggtttgaggaagcatcgatctccatcgaggactcgtgcggagctcgccgccgtcgagccgtccaggtgctcagtttgctgctgccgcggttgacgaggtcgcgctaggattgggagtttgagaggctggctggagagcccggatggccggatctaactaatgaattgttatgggctttggggctgagagatacatgggctgcaggccgaaccaacctgtgggctgagcagctagcggaggcgcttccgcttcggttcgtttgcggcctggaaaccgcgccgaacaggctactgggcgaagtggccaacacctaaaactggatttaaaagaaaaataaagccaagcataacaatactagtatttagattcggtgtaatggatcaatttacggtgaattttggatttttactctgttcggtagaaactggtagtaatataccttaggatttaatttgtcaaatacttttacttatgttatggtgggtttacactcgtcccttgctaatatcttccatagttggcttggtggtttacaacgtagaataaatgttaactttttataggtgccgtagctttgtgttggacggtaagactttgtagtaatgatataatcttcaatggcttaagtactaactcccctctttgtaggtaattttcaggtgaacccactgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgttcttatgcaaggtgtgatgctaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtacaataaatatgaacaaagatatatatttagatttatactagcacactgcacacgacacacacaccagcaacgggggcacacgacacacacacaccagcaacggggattagaagttgacacgactgtctatctggaatcctagctgtgctgcggtagcaactgtcctcagatgctgatactccctgatagccatagccacgacgcgatggggtccccatccatcctcccctcctgctcggttgttttcgcttcaggttcagtgcagtcacgagcgcggacgcccccaaaaaactcgccacgctgtgtgcgcgcgcgcccaccgcgatccccctgatcccattaacgtttcacccgcgcgcgcccacctgccgctgcaatatatttcgccgcgccccgcgccacgccacgccacgccaccttgcgcgcgcgcgcgcacacacaccccagcagcagagatgagggggatgggcgacgacgggatggggccgatggcgatggcgccgccgcgttccggccacgccacggcggcggcaccgccgccgccgcagcacaagatggcgatgatgatgcacatgaccttcttctggagagaccgcgcggttgtccttgatccggggctggcccgggaagcggggcgcggggatgtacgccctctgcctcctcttcgtgctcgcgctcgccgcgctcaccgaggggctctccgtgctctcgcgccgcctcgcccgccgcggcggcggcgccgcctcctcggatggcggccgcccggcgccggcgccggcgtcgtccgcggcgctgctgaccgcggtgcacgcggccaggatggggatggcgtacctggtgatgctggccgtcatgtcgttcaacgtcggggtgctcctcgccgctgtcgccggccacgccctcgggttcctcctcgcgcggagcagggtgcggccggccgcccgtgacggcggcggcggcgtggcctgtgagcacggtggcctccctcccgcggatggatccaagacttagtccccatcgattccgttaaacgagtatgtccaagcgccttagccagtagacactatgcactgtatcggatccaatgtgaaaatttaccttggatatctcgctaaaataattgtattttgtcgacttgcttgatatctgttcccgtgcagtcttctctagtcgtttttcgtttgtactcctatgtttcaagatggaatgatactactactagctagtattgatgtgagttctctactatgctaactttagatgaaccaatgatttgttagtactctccttccaaaaatatcctttttttaaatggaatccttccaaaaatattagatttatttcatattttgaattagctacatttgtagttttcatgtatttaaaacttaaatgaatagataaattaaatgattaatcggaacccgatgagtcatcttaatattcattggctgcgtacatgcatacactaattgatctttgttacaccttatctccacttaaattattattatttaaatccttcacccttaagatttctaattgtattgggtgcatatattgtatttattagagtgataaagatgataataattgtttttgttctttcgattaaatgtagctgtgtcttatattcgtttcatatgttgatgaaaccaaccctctagtatatgtttcatgctcatggtaacatatactagggtattctttttaaattcctattttgtgatagtgttgtcatcaatcaccaaaaagggggagattgaaagatctatgcactagaattgccttgtaaggggagattggaatatctatgatcctaagagcgcggtgattgttttggtgattaatgacaacccattgttggaactaactatttccatgagttggtgagattaggttaagtttcagcatcaagttaaaagattgaagctagaagatggacattataccttgatgaggagcaagtgaaggcattgatgatgcggggtatgaaatggctatctatggcaaaccggtgaagagaaagcaaggctcggctagaagatggacattataccttgatgaggagcaagtgaagacattgatgatgcggggtatgaagtggctatttatggcaaaacggtgaagggcaagcaaggctcggctacaatggaccatgtggggggtgaagggcaagcaagaggcttggcgccgatggactgaatccggtggtgaagggcgagtgaaggctttgtcatgatggtcatgatggaccgtatgaggccatttgaagctatgagtaatccgtatcaattataagaagaccgcaagatggaatgccgaggatcaagaggatgtggttcttcgatgaacatcaagtcaaaatccaaagtgggcattgatcaaggcaaaggtataattgatttgggactaatatgcttaatgagtgtaggtgagaatagtcccaatagtgaaatggtgttgacatagacaaccctcaaggtgaagcaagaagatgttcctagtggtgtattagtcccaggttgcttaggagtgggctaggatgcttggagatcccccaaaacatcaaaatcaaagtggcgagaagactcggagccgagttagactagtttactttttcgctttgagtttaggaaaaaccgtactattaaaaggggttccaagtatggttctaagataacacaagtgctcttagtggtgtccaagtgttgaaatatttttaggagctgtttttgaaaatgactctactcgggacagagagtcccacccggaggttctgtccggaacttcctggcgccgaggtgaggttgaaaattttcctaagtgttgcccggaagttcctggcacccaggtccggaacctcctggcaaccctccagttcaaatatgtgagtaacggctagatgacgtca

SEQ ID NO: 55459 - DNA, 903 bp, Oryza sativa
ccggacaccgtgctaacccgcagcatgcagctcctcctggcaatgggcttcaactacatccaggtcatggaagcctatagcatatttggcgaggacgtcgactcaatgatctactaccttgtggagatgggaggcaccggagcctctgcaggtggtagcaatcgcaggaaaggaaaagctgctgagtgatctgtgtacctttcaccggctatgacgaatcgaaataaaaatagttatgcataagccacaggagagggatggcaagactcgtggattaaatgagctgaaatgtcaatatactttccactgtatggagtgataacaaaataaaattcacttcttccatatgtggcctggcgttttcatggctgtcggcacttgtccacagatgtctacacggaaaaccctaaaacattgtactacctccgtcctatattacttgcttttttgagttttttaagtttttgtttgtcaatgtttgatcattcgtcttattcaaatttttttggaattattattattttgtttgtcatttgctttattatcaaaagtactttacatatgacttatctttttttatatttacactaatttttcaaataaaatgagtttttgtttgtcaatgtttaatcattcgtcttattcaattttttttggaattattatttattttgtttgtcatttgctttattatcaaaattactttacatatgacttatttttttttatatttgcactaatttttcaaataaaacgagtttatgtttgtcaatatttgatcattcgtcttattcaaaattttttagaattattatttattttgtttgtcatttgctttattatcaaaaatactttacatatgacttatctttttttatatttgcactaatttttcaaataaaa

SEQ ID NO: 55460 - DNA, 1265 bp, Oryza sativa
ttgatcatatagaaaactttatatgatcttcatatttaatttgatgcataataccttactcttttaacatctcatgggtagatgttaaatgcttttaagcatgattgcatgagaacatagaaagaagcattggttatcattttatgtaatttactattccaaataactttacaaacttaggaatccggttaaaatgggcatttatgagttgagattatgaatgttgtgattatgaatgttgatgaagtttgtgatgctggtgtggggagtttggaaagtttttgggtggtttaaccggattataattacccccttataccatgggaaatgatatagttgcgtccatccacacaaccaagtaatttgacttagcctagtatattgtcccattatatgaaagactattgggtggctctatgagcggttttggggtgaacttacgtaaggagtttgggcggcagtgtttcacaacagtgggattcatgaaagtgtgacgatatagataccttgcctaggcctagcaagagttgaccactatgatgaaccaagaccccactgtgcagtaactagtagtaagtgggactctcgaacggctatgttgtcctcagccttgcaaactgttgacatcgtgcgggtaaaactggacagtctctgcagaggtgaattaaatcattcgaatgtgccgtactcccggttctggagttgtgccattagggtgattcctactcctgaagtataagtagttttaaaaattaaattgttgaggataaagatgatttatggttttcattactcctttactttattattgtttatttattcatatctattcatctttaattatttataatatgtcttgctgagtacatatgtactcacccttgcataatttgacatatagaggaaacgtgctaataaggagatcagaaggaagcgagatctacgacaagaacgagtttttctaggctagtctacactcgagtttttgcctgtggagttctttgaagttctttggaatttattaattgtagttctagtagttgaagaagtttagcagtttagtactttggattttcttgtatttcaaataaggatattttagtttggatcttttcaccctttaacagttgtataattagcttgtatgaacaaacctgtgtaaataatcgaaagctgttctgtatatcaatctatgcgtgatcgaaatcctgaacgatcacgagtgaatttttggggcaccaagcctaaattgggtgttgccacac

SEQ ID NO: 55461 - DNA, 727 bp, Oryza sativa
ggaagcttttcaatctctagtagaaagcttagtctccaaaagaaagttttcagtaaccagatgaaagttccaggtgaaagttttcagttccagatgaaagttgtccaatcaaaggtttttagtagcatctttttttttttttgcaatgagaagttgaaagtttcccttttcgggatgcagaacaagaagggctacaaattccagggaaaggattaggggagactatgcacgaaaagctataaacaaatgtgccatgcccatgcgtgactgtgactggggagttcaagaaatgagatgcaagctgcacgagttggggacacaagaactggattgaggccttctgggtgctctcgtcttactattcttccagtgatgattttttttttaaaaaaaagtcctgcgtggctgcatcctgtccgtaactgatcatgacttttggcgcaggcgcgaattagacaggtcctaaaaggacagcatgtgttcatctaattattaaagatttacacaaatagggtgaatcccgttaaattgtacagtattgaactaaaatataaactgaattaataaattagagctcttattaaaaactgcactattagaacaattacctcacggccagtaccaccaggctgtggtaaagcagacaatggtacttgaagctggccagttcggactttgtatttttcatactcgagaagtgcctaagttaatgagaaacaaaaattaa

SEQ ID NO: 55462 - DNA, 719 bp, Oryza sativa
cttattccactcctgaattcccaagccctgcagagtttcagtcttgcacttgcacttgcagcaaaggaagctaggcctagctgtgtgggttggtcagaacgtggtgcggcccacaaaagttggttagaaccggattcggaaaaagtacatcgaaggtccctgaacttgtcatcgagttataaaaacgtccccaatctgcaaaaccatatatcacacgtctcttaactaatcaaaaccggtcacaataaatcccttggcggttttgatcccggtcttgtcctacgtggcggctgaatcagcgtagaacctatgtgagccccacatgttagcatgccacgtcagcctcttctctatttcccctcttctctccattcctcctctctctctctcactcctctgtggggctctggacggccggcggtggggaggaggtcgtcggggcatggaggtccgacggccggccggcgatgaggcggcggcgacccagaagggaaggccggcggcggcggcgggagcacggatagcaacaccagcgtcttgtgccgcgtccaccgcggcgtgccagcgccggcggccggcgaggtcgtgttggcggcgccggacattgctgctgctgctgctgcctcccgaactcgatcgagacacatcaagggatccaccagctgggatttatctacggccatcgcagccattaaatcgggaatcaaagcttgcaattt

SEQ ID NO: 55463 - DNA, 1271 bp, Oryza sativa
caggagtggactgacgtgggtggcaagttcattagccaaccccgcgcctgcccctttagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggtagcacgtcgatcattacgccgccgctcgatgctggtgcgggcgtccggccccccacgcagatcttcccgggttgaaggagtcgacgaaggagtggtggccgaatggcgaacggcagctgccgctcgccgcgcccttcgtcttgacgacgcggagccggtggtagcagcaccagaggccttggtggcggaggaccgcccaccagcatctagacgctgccttgcagtcatgaccaatttggccacatcgtccagccaacgttgggctggagactccgggtcatgggcgacgggcgggtgacgtaggagcgcgcccgcagcttggagcgcgccctggggcgtgctgccgtcaccgtagacgaggaggcgacgctccccatctcgccgtttttctccatcgcccgcaatcggtgaagtcgcggatctttcgaccctctcgagtgcctccccccgcttaggactttggcgtggagggggcggtggagtacgagctcgacggcgtgggttcggctccccgtcgtcaccactcggcagggcggctgttccccgggcccctgtcgcgggacccagaagcacgaccccctcccggggtagattgttccccctgcggctcccgcctgcgccgtcgtggccctttggagctcgctcctctgaggccccgaccgccatcataatggtcaggatggagacgcggtctggatcgctgcagagggggaggattccttggggaatgagggacgcctccacggagttgagattcagcacccgttggaccaatatcttgaagtcctcaggagcccagtcccatctcactccctggtgggtcctcatgaagtcttcggacccggtgtactcccaggcgccccgagcgcgccgctggagcggcgcaatccgacgacggaggtagtcgccgtacaccatggcccctgtgagcccctgggatcg

SEQ ID NO: 55464 - DNA, 5270 bp, Oryza sativa
tttctcatatgaaaagtgacaatgcgattatgcgacgtcataatacatgtgtaagttgctatttacagagatacacactaaaatgtggttgaattggacaagatagcacgatgatagacacaacggcactcccaccgatgatgaagaggagaaggtaggcccgagattcagtgtatagtgatcagggactagatgattgccctagtcagctccggatcgatgtgcggtctcaaaggtcgatcatggacgagtgctgctaatagaaacaatgacaacgagtatcacatttggattcggattccatggagtatttggattcgaatgagcttttctccgtatcatgatgactcaacatgttgtgagaaattgtttccttagaaattttattttggaaatagaagtgcatacacgcaatttgagaaattcctaagcaattgttcctacccaccaataacggaacaacatgtgcaactctgcaattcttccatgattatcataattggaaaagacaaccgcgtacaatataacgtaattataaatagaccttccaatgaaaaaaagttgaaagaaatactacttgaaaaacaatacgattgtactatctccgtcccataataagtgtagccatgagtttccgcgtctaactttgatcgtccgtcttatttaaattttttttataatcagcatttttgttgttatgagatgataaaacatgaatagtactttacttgtgacttatgtttttaaattttttcaaaaaattttcaaataagacgaacggtcaaagttgggcgcggaaaactatgactgcacttattttgggacggaggaagtacatcgacagttttagcagatagaacaatatatacgacggatatttattgaagtaaatatttgattctagagacaagggagctgtgttaaaaaaagtagaacttacacaaacggcataattggatcaagacgactagtaacccatatagctaactacaataatgaaagcaatgagagcatactcatgacatgtgaaaaacaggccaaaaccagttccacgatacttggccaccatccctaaatattcgcggtgcaaccccgctaggagaacgaaccggatggtcaagatggcgaaccggatgaggcggcgacgacacccccggcaaaacgcagtgctatcattgttttcttcttgaatcttattcccgcctgccaccaaatctgtcttcgcttcagccttggagccggagccggaatctgcaccaccgtcctcctggagctcatggatggattgcttggagtgctccatgagttatttttcctgaaatctctcaatgctgtgaaagggataagcgaataattataaacgattgtattcttttcaaaaaaataaacaaataagcgattgtatgatatttttcactggttgctgattgcaggaggtggttctcaggtgcgatacttatagtagattaatcgaagaaacgggagtcagcatcggaagtagcttaggttcggttcggttctgtttaggactcgcgtcgcgcgccgagtttggccgctgaacgatttggccctggatgcgctgctcatcgtcatctacctgggatccacggattcacccatcgctgaagatactggagaaccccgcgccctccgtgtctacgcgtcgtggcgaagtcctgtcgatgtcgttgctccttgctcggttcgtgacctccgccgctgccattgctagatcgcgacggcctccatgtcctgtgcggcgaagaggaagcggatgcccaggaagtgcgagtaggcgcgcacgaaggcggagaatccgatcccgacgtcttgtcctggccggcgacgacgagcggttgcggaagtcggcgaggtcgaaagggacgcggcagatcgaggcgcgccgcgcgtggggcgagggtgaggtcggaccgcagccgcaagccgtgcgcgagcacgaggcgctcccctccgcgcgggcggcggtgttgaaggtcagcacctgcttctccaactgctcggctcggccatgcgggtcgcctcggcgtcgcggctctcctcccccactcatgcacgctcgactcgttcatagccggcggctggtcctcgacgttgtagatctcgtcctcctcgtacaccgcggacacgttgcacgggatcagcctgtcaatgaacattgaacaccattgttactgtgcatgaatttcagtgcggtttaacaagatgaaagcaatcaagcgcacaaaagaaacatctcggagaaattcagagttcagggaatgatatgaatttatttttacatccaccggaatggattactatgatgaattattggtcacagttttcttttgtcggaactgttaagcttaagtatataatagagtaaattgcatcggtggtacacgaacttgttaggtgaatgtaatctagtacatgaacatgtaaaatgctcgttttggtacacgaacttatattgcacgtgcgaacgatcagtcttggaaaagtactaaagattgtgagctacagcataatcagtacagatatgaacaaaaaaaaagaactattttgatgatcaaacaagttgatcagcatgacaacatgtcataattctaatggatactacaagtttatgtgctgaaacaattggtttcaaatcacatactcatacggtatgttctaaggtgtggttacagaagctatactgtcaaaaattgatgatcctaaataaactcctaacgtgatccaaaactcagactattcttaatcaaggctcagtagcgtccccgttaatccaatgcattgtgctcaataaagctaagcaaacatttagctagattcaaaaacatttcgtcagaataacatgaaacagaaaatcaaactttctgatcgtgcctatttccctattcgtccacttcatcatagcgaaatcgatgaactaacccagcgcacaattctaaagaattctcaacggtttggcgttagaagtgttcatggattaatttgcaagcagcagaagataaggttgccatgaattcctctgcacatacaactaattcagtgaatgcaaatatctagctagagaatcgtgtgaagtacatgaatgatcagattcgctgcaccaaaaccataaaacacgcgtgaattcacatgaggatgaaattaaatcttgcaacaaaaaactcgatcataataagagatcctacatcgctggccggtctgactgccacataacccacagtctaaccagccacacccggccggtaaacaacaaccgttatttcacaaaaccaatcatctattatactccgaaatctcataacaagaaactaatctttcacacatataatatcacaaaccaccaatattattaacacataaaatctaagtcactacttcattttacatacgtagacgaagagcttgctgaagatggtggcgaagaatgagaaccacataagtaggcggtgcaggatccatgaaaatattgcttgcctcgctttcttactttttttttttgaccggactcttactcttactccaacgatgcagatgtgcaaggggatacaaggaggggtttgtggctatttgcataaaggcagttgtaaaacattttattgagcaaaacagtaaaactgttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagttttactctgatcagaggtgtacaactgtacccacgagacacagccccacgacacgtttccgtacgccgacatgccaccacgacataccggaaagaggccgtgacaggacccttcgcataaccccctctagccaagcacaccacacctcaggtttcaccctcgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatctcgcgaaccggtccttaactgccatgggtgcgaccagcaaaaccatgcacccatagcccaccattcagtcgcattttagttgaataattacgaccatgaagcatggccagatgtctcgagcacgcagctcactctgatactaaaaaggtctaatactgtaattatcccatcaactgagctagtggtaattaagcatggctaagcatatagttctagctaagtcatcaaagtaacacaagctaggcgatttattacccatggttgacaaaggacagatatcaagtaaacatggcacaagcgagcagataggtaaaaccctgaccccatgtgattagcaaaacatgcatatttatttgcaaacagtaaaacatttgtaaattgggatcaacatgctcaaagggaatgtgtgacttgccttgcttcttcaaacaatcttccgaactcctatccttgcgaccgtgatcttccgaaacgacggattctacacgtaggcacgcaaaacgaggaaaaaatctaataaaaaccaaggaaacagtatataaaaagtaaacaaacatgtagagctcaattttagatgaattttgcaagttgaatggctcaattcggagttcgaatgaattagatatgaattttagaagttttgagccatttatatgaatttctagaattattcacgaattattgcgcaattattatttatttttacaaaggaaaaggacctcgctgacgtcagcaaggggcggccggcgccgacatgcgggccccacacgtcagcgagtcaaagggggagggcgcacggtggacatggtccacacgtggcctcgggtgcgcctccaccacgtggacggcccagatcgacctgagccgatcgggcggccgaggggagcggcagccaggggcacaggcgcggcacgaagccggcccggccgagccaaggcgcggcggcggcggcatgcggccaccggcggcagcagccggcgacgtggaacggcggcgggcggccggaggacagcggcgcgcacggggacggcgacgcaccccaagaggcggagatcggcaagaaagggggacgggaaaaaaaaaggaagggaggagaggtcctcaccggaa

SEQ ID NO: 55465 - DNA, 3713 bp, Oryza sativa
gtggagaggggaaatggagcggtggccgagcttgcccgggcggcggcaaagctggcggtggcggcggcgcagcgcggagacggcggtggtggctgaggcacgcggctggagaacgctggcgagcggcggcaatggggaccggcgtggggagagcggggaaaagcgcagggagctcgggatggagtgggaaacgaaagaggggagcacgagggtgctttatatagggctcggggatggagatcgtgcccgggagaggcgggatcggctggcgacgtggggtggcgaagtggagctcgggatggcaacggttttcgcagggcgtgggggaaacggcgcggacgtgggcggcgaccgcgtccacgcatgcgcgggagagggaaccacgcgaggaaggcggcgacgtggggagcacggggtggccatggcggcggttggggcgacgggaggttggggaagaagatgacaggtggggcctcgggtcccacctgtcggggagagagagaagggaaaacgggcgagggaggtaaagcagacttgagggagagagagagccgagcgggccgagggaggaggctggcccgagagggagagaaaaggggcgcgcaggccgtgggagggaaggaagacttgggccgaaaagggcccaaagagaggaaggaggattttatttgttttctttttattttaattgatgcaatgatctttgtgctattaaaactatttctcaagctccgaaaattcacggaaaattccggagagtacattagggcacaaagaatattacaaaatattcccggccaataatttttaaaggaaattttaatttcctctataattcacttgattaagttgatttaacttttatttaatttctagaaaatgtattattaattgatttttattcccgaacgaaaatcagggcgttacactgaacaaggttggtttagtgatcaggttttggatgatctacaggggaaaacatagatgcaatcagattttccagaaaagagtaatcagagggagggaaagcagatagtcattgaggggggacagattggaaatgttgatctcaagtacagtggtgaaccaagcacagaggttcctaagggggggtctattgatgcctgacatgatggtggtggaagacaagataaagtgttcacaaatattaagagacaaagaattggcttttaagttacagtatgaagattcaactatgatacagctgaatgtttgtgaatcaaagaaatcctcaagtgaagaaggggaggtgcttggtcaggtggacaagatacagtcttctcaggaacagttatttggaggagggcagataaatgatcagatagacagcatatctagaaaagttgcagaggggatcctagaattggagatggatgaggaggataaggagaaaagtttttttgaaagacagtgaagattatatggattctcaggaatcagaagaaagttttggccaagagattagatatagacttgaatgaagatgtgacaggaagtcaagaataggagatgaggaggaacaaaagaccgaaggacaaggaggacaagaaaccttatgagatggccattgaaagaaaagaagcccaaaatgcttttatcaacaaaggtcagaaccagatcccttcctttatacatgattcaaatttgtctttagttgacatggctagtattctaggggtaaatcttggttgtgctgtggatgatgtagaatccaatgtgcatttgattaaagagttggacttggctagaattaacctctttatgaaagagggacaaaactctgattgccattttgatgatgtgtccaatagggagataaatcctgtgatacttgaacttaatgattctaaaaattccggagaggaggttgatgactttgaggaaattgagtttatgctcaagcaaatacaatcttcagctagaaaaatgaaacaaaaaaagggaaaccttgagattttcaaggtcactcctaaacttaagaaaaggaaaaagaaaccaaaagaattatgaaaaggcatattctggaatattagaggcatggggaacccgaaaaaatagatcatttgcaggacctaattagggattcaaatgtagactttgtgggaattcttgaaactataaagcatgatttctctgctggcttacttcatagcttaagtggacaaaaaaaaattaaaatgggaatggctactctcatgtggcaggtcaggggggattctagtgggtgtaaacatatacaagttatcatttgtaaatgttactatggagaattttcatatcaggttaaagttgtagaatatttgagacaaaaaaacatgggatctgttagtaatatatggggctgctcaaccagagcataaggctgtcttcctagctgaattggctaaggagttccaaaaatctaagggaccctttgtggctggtggagactttaacattctgaggaaagaaagtgagagaaacaaaagttgggggttataataagtggaccttcctctttaatgcaataattaagcagaacaatttgagggaggttcaaatgggaggaagacaatttacttggtgtaataaccaagataacccaactttagaaaaattggatagagtgttcatcaacaatgaatgggaatttgtttaccctctcacctctgttcaatctttggtaagagccttctctgatcacaatcccatgttgttggacactagggaattagttaaaaaaaagagtatgctcagatttgaatttagttggtttatgagagaggatctagggactttggtgcaggaagcttggaacaaatccttttcaggtaatagcattgaaaaatggcaaaagagacttagctatctaaggaggaaattaaaaggtttgaataagaattggtaaggagaatataggaggagaaaaactgaaattttgaacaaaattgatgcaattgacttaaaagctgaaaatgttggcttgagttgtagagatagagaagatagaagagcctggaattgcagctgaaattcactattagggaggaaaaaacgaagtggttccagaggagcaaagaaagggaaatcatggagggagattgtaatacctaatattaccatgccaaagctaatgtaggaagaggaaaattctgattcactctttatctcaataggaaggtatcattactgggcaagccgagcttttgacatacattactcacttttacaatgagctctttggtaatcccaaacagaataacttgtttttaaacctagaggggatcacaaaggtaagaagatgcagaaatgttaataaaacgtttcactctggaagaagtgaaacaggtagtttttgagctaaaacagaataaggctcctggtcctgatggtttccttggtgatttttatattaaattttgggatttaataaaaggtgatttactggatctggttaatgacttccatagaggtgtgctagacattgagagactaaattatgtcataattactaaagacgctgctcaaatacaaaaatttagaccaatatgtttgctgaatgttagtttcaaaatcataacaaaagtgttgatgaatagattggatagggttatggcttctatcatttcaaagaaccagaatgcttttctcaaaaataggtttatcatggaagggattgtgattctacatgaggtgttgaatacttcacacaa

SEQ ID NO: 55466 - DNA, 918 bp, Oryza sativa
atgcagcatgctcacttgtgtgagggagctgtagtcagtagtacttgttgatggctgcccggcaggatacaccggcggagacgccgacgagatcaccggcgctccggccaactcttgcccttgcccgccggcgtccgccactgacaccacgtccctcgcgtgcatcgatggaggaggaggaggagcggcgaagccggcggtgatatggacttggacgtcgtccatgaggccggtggcggcgccggcctgccggtacctgcgcttgaagatctcggccctgaccgcttccagctcggcctccagcgcgttcacctgctgctgcagcatcgagatggcgcccatgcagccgtacacggggtcgcgcagccgcagattcgcctcgtacaccaggctgctcgccgcgtcggctctctccgcctcgccgacctcctgaaaccgcattgcaccgacgaagccattaatgcacaagctagcgaaaggtacaatttaaggaatgctttgacctgtaatggtatcgtaccaggagcatcttggagacgttgctggcgccgaagaccttgtggacggcggcgaacttgtggggctcgtgcggcgagaagtagggggcgaaggggcactcctgcgcgcagcgccggcggaggagcttgcacgcggcgcacggggtcacggtgttcacggcgccgccgaggccgaggcgatgggggacgcggtgctcgatcggcgtggctgtaccggtgccggtgcctgcgacggcggcgactacgacgccggcggtgtccggctctcgcttgatcttcttgccgatctcatcgagtctttccctggcggaaattggaaagggccgaagaaggtttttagggtttcttgcatggattcaggagagggaccagatgcaaaacacaatgcgggctgcaggaa

SEQ ID NO: 55467 - DNA, 1335 bp, Oryza sativa
atctgaatgatgtgctcatacaatatcgatattaaaatataatgatacccattttaaaaataatgacattaaagtagttctcgtgacaaatatactcttataattttttgcatgacatatttgaatatttttatgtatataataatggccaaaatttctaagtctgactgtatgcattctagaatgaaatctatttgagaatagtatatgtttaattcaaattggtgatgttcatgcatcttctgaaatatcgggcatgttttagtttgatgccgaaaccagccttatcaaattttgttaatgccacaccttatttatttatttttttgggtaaggtaggtatgtggtggtacgtttagtttgaaacctcatctatttgggtgtgatgttaggtcaggaagtttattagctaccaaatattggtatggaaaggtaggtatggttggtttgttgccttgctaaaattggtaaggttagaaatggtagcaaaccaagcatgcccattatccgtgattttgtcttatagttcaattgcttttatccaatagaggttcactaattttccttttactctctctgtcattttaatgtaatcatatgtttctataggctgcatctggtaccaaaagtggctctagtggttcccctgttgttgattgtcaaggaagagctgtcgccctgaatgctggaagtaaatcttccagtgcttctgcgtttttccttccattagaacgtgtaagttgtttacaaaatgttcattgaaactagctaaatgcatgtgctttgctacggataaaagaaaacgtataatgtgttacccatcttttttgctatagggaatattcatcttactctaatttaatgtggctatccatttagatttgatattttttaatattaagaagttcagggattaacttgcaaaatttacaatgggagtaggtggggtgacagattcattgccaccaccactaccttcttttaaaggagtatagatatactacttttagcccaggaagcttatgcttttgttctaaaattgcaaggtctcttatttaataagaccaacgaagtggtcctgctagttgaaattgatacgagtcataaaagcacacatgcaattaggttaacatctatactagacatcacaagaagagagagagagagatagaaagaaaaatataatttggcattgaccgacatccgagttcatacaaaaaggaatagcattgctgtttaatattgattaattgtaaggtctcttattgacaggaacaacgaagtggtcctgctagttcaaaatgatgtcattataaagcgcagggctgcaggaat

SEQ ID NO: 55468 - DNA, 1079 bp, Oryza sativa
tacacggcatggattttctatggtctgacaagttaatttgatttgcaatgaagtatggagcacttcggaggaagatcggtggcacctacaaggatttcttcaagtcatatgtggatggtactacctcatatatgctttacttgcagaatcctaaaattacttctgatccaaaaagattatactagtaggagtatcgcacagtcctaactgtttctgaattctgcttgcagttgacggggaatacgtagaggaaggttgggtggataagacctgcaaagtttgcaagaaggacactagaggggaacccaggcaggtcgacaagctaggaagatatgcacatgtcgcatgcttggagaacccaaaaccgaccaacatcttcgccaaattgttcgccagatgaacttcaattgtacaatcaaagacatatttttactcatgcttagatacatagatggtgttgtagccccaagaatttgaacaatattatgtgttcagttttgccatataaaatggtatacagggagcatgtcacacattttccttcttcaattgatccatttactcacgaacaaagcaatgacttaacagacctgaacgactgaaaatgttaaatattacatcaagtattacagagcaagttaatacactaatctatctattagcttatgcccctggtctaatataagaggagctcagcacaaactcaagtcaaaagaaatgctatatagagctaactggttatatgatgctgcttacctaattctgtagctatatgacgtgttcagaagtttctttcgttgaccatggacagatacaccctgcatctgatgtcagtgcatccaatcttaaaccccggcattactgtaaacccaacactgaccttgtctccttctttggttatcttggatggaacacattccatgtgtttatcgtaattcagtaccacccttgacatagaacatctctgctcttggattcagagaacgtgctacggttagggacgcccatacatatcttgacattgtcacaaatgcctgataggatggtgttgttgcgatgaccgccattctcaacaaatg

SEQ ID NO: 55469 - DNA, 793 bp, Oryza sativa
aagaaatgtcatcgccgtcggttttccattaatagccaatcgtgtttactgtcggtcaacacggtcaaaatccgccgtaacaaaggggagctagatgcatctgaagaatgccgtaaacgctgagatcgactgcatcctctccatgtctggccgaacgcgagtttgccgattgctttgcagctggtgatctagcggccgattcctcgcacgttgcatcgacatggaggagccccattgccggcaacgagaggagggtgggaggagaaagggaaggagagatttgtacacagctgcagccaggtgagacccaccatggtacgttgcgccgcgccggcttccgcgcggcggcaacatgccgtggcggtggccgcagatgcctcgactgcaaagcatgtcggcgcggggtgcagcggccagctgcagccgtggtcgtcttaccgcgcgcggtccgcggtgcttgccgtgccaagacgtggagctatgccagtatgcctctcgtgcgtgctatgttatgagcaaacaccacgtagcatcaatataatccctccattttatattataaaactttctagtattatccatatttatataaatatttataaatctagacatacatatatatatatacatatatacatatacatatatatatacatatatatatatatacatatacatatacatatatattcattaacatctatatgaatgtgggcaatgttaaaaagtcttataatatgaaaaaggggaagtatgtcgcaaacaccacatagcatcaatatatgtcgcagag

SEQ ID NO: 55470 - DNA, 1228 bp, Oryza sativa
tggagattaaacacgagacattggggttgacaccatatacctcttgccaccgcaacatcaagtgcatctcaaaagcttttatctatggtatgttccttaaaaatgttttaaaaatacagtcaattgcaagatgtagtgatggcttattttgtgatggaggcggagagattacacaccaaagcggcacaaaatattgaaaaaaaggtatatattgaaaaaaatccaaatagtttgagcttggagcctaaaatatgaggttcactgcttcagttttgtttaccacgattttgaataagaaatggatgaaaatgatcaaaaacttcttctataaaaaactgaactctggattatgaattttggtgtagcatcagcctatttgtcgcaaagcacaaacattccaaataagggcctataccacatatgaaaattactacattcataatttaattccgggtgtgtttggcgctacctttcccaacctcaacattaacagcttttcacacgcacgcttaccaaactattaaacggtatatttttataaaaaatatagaaaaaaatactttaaaatcattttaattatttttcaactttttagctaatacttaattaataatacgttaatgagctattttgttttcaatgcggggagaatgagttacaaaactgcactatcgagcatacccttagaaatcccactgctttagtaggattgttggagaatttttaaagtttattgttacattcgttctcaataaatgatgtcctaaaatatgtgcgatcaaatcttgaaatcttatatcatttataaatagaaaaagcattagaattcaatatgcctagcaatgctaatagctaggggtgggcattcggtccgatagaaaatttcggtttcggttttcagtttttgggtcattggaaagtgtagaccgaatttcaacgcaaaaatttcaggaccaacaaattcggtctcggtcttggtcctgaccgaaatttaacaacattttcatatatgcaaagaaataatcgaaattttcaacacaaaatcaaaaaaaaattataagcacgtatgagtaaagactcttattaggttgcatgcctagaagaagtaggaatgtgaaaattagagtttaatattattgaacttagtggattataggttgcatttaattttttttttattaattcggtttttgcgatctattcgattaaccaaggagactaaccgaat

SEQ ID NO: 55471 - DNA, 1670 bp, Oryza sativa
tcctgcacccctatggattctagactcgtcttccaatatttcttatttttaattcggaaatttcattgtttgtaaattgtattactatatagactctaggctcttcttcctatattatttatttttaattctgaatttttattatttctaattgtatttctatgtggactctaaactcatctttcaatattctttaatttttaatttcgaattacagttacatctaaatggtattcttatatggattctctacttttaattttattatgtttatttcgaattttagttagttttaaattcctatatggactctatactctatttctaatattccttatttttaattccgaatttatattattttttaattgtatttctataagtatttcttatttttaattccaaatttctattatttcttaattgtatttctatatggactctatacccttcttctaatattctttattttttaattccgaatttcagttatttataaattgtatttctatatggagtctagtctcctctttcaatattccttattttttaattccgaatttcaactatttaaaaattgtatttctacatggactctgtttttctatttcttcaattaatatgataatttctaggccgtgagagcgaacatggatgctcctttttctgttcctttaataagttaatagatttaaaatgtatgtatcacggagcaaatgtagattgttattacatgagaacaacgctctacatttttagttgcttcctccatcccagaatataagaaattttagagttagacacggttattaaaaaagtagatagaagtgaatggtggagggttgtgattgaatgagtagtgaagataggtgggaaaagtgaatggtgaaggttgtgattgagtgggaagagaatattgctagaaaagttgttatattttgggacaaatccggagagctaaaagttattatattttgagacggagggagtatgtcttgctaatgttatccttgctctatgtccgaacagcaagcagatgggaaacctcacggcctcaccaaacctagtaacctaatccctccgtcccataatataatgattttgagttttttattgcactctttgaccactcatcttatttaaaaaatttatgtaaatataaaacccgaaaaattgtgcttaaaatactctggataataaagtaagtcacaaaaaataaataataaatctaaaattttttgaataagacgagcggtcaaacagttcaaacaaaaactcaaaatcctttatattatgggctggagggagtaccatggttccacccacctccttggttcaaagagaactatgatgaatatataggtcaacgaagaccttaagcaccaagggacaagcaaccagaagcgacacggcggggaaggcgagcgccacgccggcgacgcagaactcaaggagagctccgtcgatctcgggcatgtaaaccgggttcgccagacggctgaggctcgagagaactgccatcaggagcacgagcatggcggccttgaggtacacgctgtagtggttggtcccgaggaacgccgcgtacagcccggccatgagcgtgaacccggcggtggcgacaatccggaagacaaattcgatccatggccggctcccgactcctcccc

SEQ ID NO: 55472 - DNA, 877 bp, Oryza sativa
cagtggaagacgatgtcatgatcgccaatgtctcggtcacagatgacatagcgctcagcgctgccttgagaacatcctgcgagcacccaggcttcacgatgcttttcacctgcgcagcaacaacagttagaatagacaccaacatgtgccatttgtccacaggaattcagattgttcgatacgaagatcgatcaattattgggattatggaaagtaccttctccaagtattcctggagtttcttgatcctgcccatatagtcttgatcttccacgcacagtgaaataggctttgaatcagcacctgctccttcgaattggagtggtcctgggtttctgtagatgtcgtcgattaagaagctggtagaattgttcctcaatagcctgtaaacacaagtttgttattgtcaatgagattatgcatcttctttagaccaatgacagcaactgtacagcgatcgaatataagatgggattaatagattgtgtacacacttactcgaatgctttgcctttcaagtcgacagtagccatatggacagcaggtttccctatttgagtagccgcaggaccacgtgaccatctcttcacggtcatcatagactaaagggaaaagaattgtgggttaggtgttcccttcattcatatcatactcatctaattttgccaaaagggggtgcacagtagtaatctcaccgaaatcggagccgcaccacatcgccatttgttcgcaggactcttaagatttgtcacagtagccatgtaaccattcaaaccagcagctaagatgtggtagcacacgtgcccaagaacctgaagccaaacaacatacatataattaatcaacagcaaaataaattgctttgtccaagtagaaa

SEQ ID NO: 55473 - DNA, 781 bp, Oryza sativa
ttcctgcagccccgaataaagtagtaatactgccagaaagaatacaaccacaaggcatataaaattgttacttttgtaatgtgaatttgtaaacaggaaggctcagcaggccttgctggaaaagtatgtctactgaataaccacgctgagagaaatactgaagaacaaatggaccatggaaccccaagaaaaaggataattcagttgtctaatggacctaggcgaatttgcattgttatcaatcagtattggcatcctttattgcctatacaaagattgtgtacacctgtgtgtgaagtgtgaacctcccacataggccgaattaaggagtgaaccgcaaattatagcccgtgttctatatttgtttagctctttctgtactgggacttaacagtatcaattcagagttttttttactgtctcaattcaatttgattatttaattctgagaaaaaaataaaggaattgaccatagctaaatagtatcacagacacgaaagtacatccaactaaagaagaagcggatcaaccatattagatattaccttctcagccgaaagagcatcggtgcatacattgcttataagttgtgagttcacctgttataataataaataagttcaacaataaataaaaattgcaaagtggtaaattaaatgcgtagtatttttgaatgggcaacttggaaagttatccatagcacaaaaaacacactttcgcatacataaacaacctcaattgacaaaaccaaacatgcctaacaggtcaggggctgcaggaa

SEQ ID NO: 55474 - DNA, 1095 bp, Oryza sativa
agtgcgtgcaacccaccgtgtcgcgaatcatgtccgcttcgccagcggggggcgagtctggccgctggtcccaatcgtcgcaatcactccggggggcgcccatgggccagtgctggcggctgctcctgccccgggacccatcaaccaccccctatgatagcaaaagtgccaaactgcgcgtcccagttgcttgcttctgttacattggatcatggagtagtagacgaccatggacgggggtccattcggtaagttaaatcggaacaaaggcgttgctttccttcccataccaaatacgagtagtggttcagacgtcataaaggtgaaggaaaaatccgggtatccttacgaatggcagtacagaaatgtgcatgtgaaaaatactttctatcttcgtttatctttcgagaaaagaaagggcgcaatttgagttggaattggaggggattacattggactgaagctcgtatgcacagttgatcaaacactcaccattatctctcggagcaaagaatcttgacagcctaaaaaagactctgtacagcaagaaggggggaaaaattatgtttctgaacttatcctacgaggcaagttgtgattggttttcacgaagccatcatggcagggggcaccacggtggcaacggggcaaccgccgcctcgctccccgtcggcggcggaggcggctgcccaccgccggcatatccggccgagcgaggcggccttccgccgggcgcgctccgtgccgatgctcatcagctcccagatcgcccattccacgccgggcacggccatgacctgggtcaccgccggcgcgcccaggcgccggcagagcagcacgagcgccgccgtggcgttctccctggcccagtccgtgccgcgcctcatttccgccacgagacgcgccacggcgccgtcgatgttgacgatcgcctccgcaccgccgcgcttggccagcgcggcgagcaccgccgcggcggtctcctccttgctaatcgctgacagcgccacctcggcgacgcctgcgtcaacgagcttgccgacgttctccctctcgccggccagcgtcagcagcgcggccaatgcgtccttcttt

SEQ ID NO: 55475 - DNA, 1569 bp, Oryza sativa
ttaccgtacaaatattttgttagtgccaaaatataagcaagttttggcactaccaaatatttggtaaggtaaaattgcatttgatcatatttggtttgctgcaaaatgtaaaattgtagtgaagaatgttctacataatcttaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatccctgcacccacactttggacgctcggaccatttatgtaaccctaatggattgttcctccagtctaagcttgcaatttccacccgacgttcgtactccatccaagtatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtgatgtgcaccgtgcaagtcgtcgtcgtagaactggctagtaggaccagtcctaccggcgtgagacgaagaggccccagtaccgaagatcccggctgcaaatcctactggacaaggaccatcagtttcatacatgtatttaatagtattaataaaaagtaaagtaccttgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggagggctgcaggaat

SEQ ID NO: 55476 - DNA, 1295 bp, Oryza sativa
  unsure (1)..(1295): unsure at all n locations
tcgtataacctcgcgctgagagcgaagcggaatcgaaagatcccgaggggtcaagccacaaaagttcggcgccaaccgtgaggaagaaatctgagagcgccgggcaggcggagcagcataaactagaacggaggaagctcccgcggcggagaggaagcggcgtccatttgctgtccgcgaggtcgtgcctgatcggttcagatgggttcgtctgcggttcgctgcccgtcttcgtccagttcctgatcaggtatggtccttctcccccccgaagagatctgcttgtcgtcagatttcgattccactgcgactgggtggaatttgtgcgatttagtgtttcctattgagtgtaggcaactgatgatctgtcagaacgtagtctctgttaacatcaagtaggaattcgccactacttttatttttcagaatccaaatggggacatttcgtcgcaatccaatcgttcaacgtgtactttgatcgccgatatgtgcttcccgcatttttaggttgattgacagcattagggcatccgtccgatagtctgtctgggttggtgctgaagtcatataatgaaattgggggtgacatacctgtgatgtttgccggtggctcttataacagtactaaattaccgtgtagcatttgagattttaacatccatttggatttggattacatttcctgtgtaggtgtactannattcagtttgttctttctaatgacagctcttaacaggcagaggacttgggaatgcagaaagatgtgcttgcacgacaggaagttaatatttcgtgcaaacaagatcccagcttggatcaagccgatgttgctggaccttcatgtgaatgtgctgcatagtgataccgtgctgcttttccgtgttttgaagcatagtagattgaaggactccaagtttgttgatcatcacattgacgacgacggataacatctgctgcattcattacctatactttgtagatacttctatagaagtggtgtggtggtgtttgctcattttgttgtgttccaataacttgatatgatggatgggaggtcaatcttgatgggccgttatgaggttgggaagcaattaggacaaggaacatttgcaaaggtgtattatgcacgaaatcttactaccggccaagctgttgccataaagatgatcaacaaggataaggtcatgaaagttgggctaatggagcaaataaagagggagatttcaattatgagattggtgaaacatccaaatgttcttcagttatttgaggttatggctagcaagagcaagatt

SEQ ID NO: 55477 - DNA, 2254 bp, Oryza sativa
tttgagaatacatgctctagtgggccgaatttgtaatggcctgatagttcaagctggaattctgcggtggaatagatatgggcccgttttatttgtttcgtacgtcgaactgaaaacagacaaaggcacaaagctttgtcacaaatcattttcttctcactcatgaatcgttttgaactttgaagaagcaacatataaattctcttgtgaacttttgcctacaaatcatcctgacaatccaacaaaaaatggcgaacaaaaatagccttcaacttcgattaaaatatgcgctcacaaagatttcaaaattatcactcagagactacgtacagtacttaataatgattggtacttgataaggcgacaaaagaaagtataatcaaatcacaaacatatcatatacatagacccataaactagcatagttcatggtcccaaaagcacaagagtgctccggtgctcccccacaaactcctccggcccatgtggcctgattcggggggttacaatgtaacaacaaaagttacaagacaccacctccctgctgttctacaatataatccttaaattgccttgccaaattttaaaccaaggctacaacaatgcagaaaaaaaaaatgcccaactccatgataacttatttatgtctactggacctatgggagaaagcaaaggcctaagcgggtgctaattaataagcagcctcagaatagccaaagcctcttctcttttactatagcaaagaggctccctcctcctccacctcaatctcaatctcacactgacatttctgcagaaaagtgaactgaaaaacggaattagccgagtactcgatcagaactggccgccctcgaaggtctggccgaactgccagccggccggcacgacgttgttgctggtgacggtgcggccgtcgctgacggcgacctggaaggagaggctctggccgtcgaggtaggagttgctctgccagttctggccccagttgcgggacatgggctgccacccggtgctggaccccttgatcgacacggactgcacgtcgcctgggccggccacgttggtcacaagaaccaggttgaagtaggagtgcccgttgatggtgaacctgatcccgcccttcttcacgcacggcaccctgcaacacaccagcaaaaaaaaaaagcaaagttcagtgaaacagtagaattaactgtaatttgttactatttgttgcaacgattaatcatatggatgtgaaatgggatgcgtaaagtaattccgggacagcgaagtcaagtccacgtcggtgtcaatcgtgcgtgcatggctttgcctacagccgacacggacagatcgtggacaaaccaaatctgccgggtggcccacctacacatggcctgatcagccgattggggatcggcccatcgaagccgacacaccgcacggggggcccatggcttcaagttgcaaacagtttgccactcactcgtgacccattgacccaagtagagctcaccttctgtaggagacgggcacgatgccggcgcggtacacgccgatctggaggaaggccggctcggccatgtcgaagtgggggcgcggcgggttgcaccagccgccgtcgtcgttggggagcgcgtagttcggcgggcacaggttggtggcggtgacggtgacgctgcccggcaggcaccactgcccatcgttgtcgcaccgcagctcgtagcacgacccgcacgccgcgccgtcgttgaacagcaccgtgctcagcgccgccgtgttggtgccgtacccggtgctgtacaggttcccatacccacacgccccgccttttcatgtacacaaacaacacgacacgagtcagattactcccggttttgtcaatgcgtccaaaagaaaaaaaaacaaagtgttacgaggagcagtgcacacgtacccatcgtgccggacgcatcgccgccgccgtagaacgtggcgtgggcgctctgccaggagccgtagtcggcggcggctcgccgggcgaggaagcagaaggccgagaagaggaggagcagggcactactgcgtgaggccattgttgcaaaacagggagaagatcacactaccaacaatgtcctgctagctacttcactcggcttaagctaggatcgaatcgatggttgcttggttgtgaagagagcggtgctcccgggctcaggtacttataggcgactcctccttggcagttagaatcgttgatagcttttgcccaacgacagaggagagaaccgga

SEQ ID NO: 55478 - DNA, 1660 bp, Oryza sativa
aattcctgcagcccgaattttttgtttacagcaaagggatcgaaagcgagatttgatcggctgcatgaacaaaaaggattaaagcagtgggcagtcggcagcatgttcctgtgctcgtgtctctcctgcctgaatcctgaaaagctcgacaggtaatgcagcaatggaggaggacatcatcatcaattcatcatcattagaacgaccaaatccaaataaacatggcgcacgtactggccattatcttaacgaaactgcacggagagtggaagtagtgatgggaagagagtgattcactttggctgtgtcacgcagcggaagtttcgatcgatctgtttgggtttccatccgaaagataaaagatggaagccactatttctcgccatcatctgaatgaagcccttctttttttggcgggcctcatctgaatgaagctggtcggaaggagcaagatttgcagatccacgtatgtgcaaatcgcaccacgaatcctaatactccgacatgattttgcttgtgtcgtcacaccacaaactctatttttgagcttagtttgttaacatcacttgatcgctctcgcttgcgatctgtgaatctagtgcgtgcatactgtgcagttgaaaagtttgccgtcaagtgagcgtagctcaaatccaactcagatcgaagttataaagttgacacatatgctcgcttttacggttaattattctttcaacagtagacaatatagccgttgatagtaatgcactcgcaacaacttcatgaaactcaagatatgttaatccagatttctaaatgtgctaatagagataaaatgtgtgttcatatggagatatatcagttcagtttttttggaggtgtttataggagtacggcgcgtttaaaagtgtggtatgcatcgtgttgtgagtgtttgtgtgtttctttaaaaaaaaattgccatttgtcaattattgtggattttctgcaacttgttgtccaaagaaaaagaaaatagtttcggtcaacaactcaacatccatctgggggtatgaccgaccgagcgcggtggccgttgattggctcgtcgcctcctcccttctcggtctgacggtctgaccagtgccgggtaggaagcgtaattttgaggagagactccgacccgcgccgccgccgccgcagccaagccatggagggatccgccggggcgccgctccgcacgcgcgtgtgcatcatcgggagcgggccgtcggcgcacacggcggcgatctacgccgcccgcgcggagctcaagcccgtgctcttcgagggctggctcgccaacgacatcgcggcggggggccagctcaccaccaccaccgacgtcgagaacttcccggggttccccgaggggatcctcggcggcgagctcatggatcggtgccgcgcccagtccctccggttcggcaccagcatcatctccgagaccgtcaccgcggtcgacttctccgcccgccccttccgcgtcgcctccgactccaccaccgtgctcgccgacgccgtcgtcgtcgccaccggcgccgtcgcccggcgactccacttcgccggctccgacgcctactggaaccgcggcatctccgcctgcgccgtctgcgacggggccgccccaatcttcaggaacaaacccatcgccgtcatc

SEQ ID NO: 55479 - DNA, 1236 bp, Oryza sativa
gcctgtcgccaccgctgctgccgagcctgttgccgccgccgtcgatgagcccgccgccgtctcctgagggcgagcagggcaagtgcgcgagcagcgtcgtcacgccgttcgctcgtcccagtccgccagttttggccggatgagttggtcccggatctgagagaaatattcctctctagggaccaacccatcccacctcatcccagcaaccaaacactacctaaaattggtctcaatcgttcggatagcgcgtgctctccaggtaagtcaggcgatctctttgttatcccggctgggtttcgttcgaacgctgcaatgctgcgtacctgtcgtccactcgtcccgtgccggtcgccgtggcgtcacgctcggcgcgcatgcggacgcagtcccgatcgtgtcaagcaacagagcgcggcgacgcctggtcggcccgtgcacgcgcgcgtcgcgcgtcgcgagatctctggcacggaccgacggacggtgacagaaactccgcccgtacgcgtaccacccagtaccgttacatcagcatgcggcaagaaccgatctgtcgcgcccaggtgatcgaaacgtgaggctggccaccggccggtcgtcggccaagaccaacccaccgcgggaacatcagcttcgccgtgaatggaactactcgtggaagtgacggatcgagcccttctggtcgcgtcacatcggggctatacccgtcgccaaatgggaagactcgtcgcgtttcgagtagctctgccccatgccatgtgtcgcaacagttgcacagcgcagcgcggagcagtgcagatcagcgtacggggttaagtactgaacggtaactgcgtgtactcctacgtaccacgaggtccacgacgctggacgggtggagtagtagtaacacggagtaaacaaggattctccatcggttaacacaagtaaagtacgccgcatgtgatccagtctcacgatttcatggtgagttaaattatttacacgatgacgggcagattttgttgttcatcgtaggggggaaattaaatattttttaaaaataatctacatagaacaattgatccaaacagtacaatagacgataaataaaatccaattgatccaagcagtacaatagacgataaataaaatcttgagaaaacatactgtgtttgtattaaaaaggataaacatccaacgctccacaatgaaagataccacttaaaaagtatttgagtgggctgcaggaat

SEQ ID NO: 55480 - DNA, 1095 bp, Oryza sativa
cctgggccttcccggccgtcgccaccgcggcgccatggccggccgcgccctcgtcgtgctgctgtggtgcgtgtccgcctccgtgttcctcccctccgcccgcgcgcagaccaccaccttcaccagcgccatcgacggcaagaaggcgaccaccttctccttccccacgttcgacaagtccctgatgcagctcggcgccaacctgaccttctccagcaacgccaccgtcagccagagcgcgctgcaagtcaccccggacagcagcaacaatcctctggactacctcgtcaaccaggccggccgcgtcttcttccccaccccgttcgtcctgtggtcctccaactcgtccaactccaccgccgatggcaagtacgtcgcctccttctccacggtgttcagggccaacctctaccgatcaaacacgaccatgaaaggagaggggctggcgtttgtcatcgcgtccaccaacgccatcaacccgccgccgggcagctacggcgagtatcttggtctcaccaacgcctccaccgacggcaacgccaccaacgggttcgcggccgtggagctggacagcgtgaagcagccctacgacatcgacgacaaccacgtcggcctcgacatcaacggcgtccgctccaacgcctccgcctccctcacccccttcggcatccagctcgcgcccagcaacaccaccactgacgacggcaactacttcgtctgggtcgactacaatggcacgtcgcggcacgtgtgggtgtacatggccaagaacgacaccagaaagccctcgaccccggtgctcgacgcgccgctggacctctccaccgtcctccgcggcaacaagggctacttcggcttctcggcgtccaccggcgagacgtacgagctcaactgcgtgctcatgtggaacatgaccgtcgagatgctccccgacgagggcgccaccaagaagaaggcggccctgcccggatggaagctcggggtggtcgtcggcgtgtcatcctgcgccgtcgccgtggtgctcgggctgttcgccgcgctgtacatccggaagaggaggaagaggatcggggacgacccgagctccgtgttcaa

SEQ ID NO: 55481 - DNA, 1015 bp, Oryza sativa
tgcaatgggctcctcttgctttacagccatatcagtcgtcccggcatgaagcagttttatgtggttaacccggctacaagacagtgggtgcaattgcctccacctccaaggcctgatattgggatcatgcacttagacaatttgtaccttgcctttgacccaccttgtcgtcacactttgaggtatttcaaatcccctatgttgatgtcttccgccatcgctctgagttgaatcctgcaatagagggaatagaatggccaccgtcaacatgcgttctgcatgttttctcaacaaggacaaggcaatgggaggagagatcatttgttcgagaaggggaggctgcaggatctttggctatcatacgacgagattttccaaattttctgcacaatgctgtctactgtcggggagtactttatgtacgctgtcaaaccaactttgtaatgaggtagtctcactgataagtattataatttatttctttattaacaaatagtatcactcaattttatcatgttttaatatttctaagttttccaatatttgcagaatatctttgtcagatggcaagtatcgaataattaaaccaccagtagagattgaacggtacgaggagtcaaatatttatatgggactatcacagaagagggtgtactgtacattctttgatgatccagacataatttatattcttgatgaatcgtacggaaaaatggagtgggtgcagaagaacgctattagctgtctggtcatacatgcatttcagcaaactgatgggccctggaccttacaagatataactatcatgaatatcctgatgcgtacggacatgacaacagtgaggcaatagaggaacaaaactttgattgggactctgacaatgataattttatcaacactacagacgaaagaaatttgcgctacggtagaattacttttctaggatttcacccttacaaggaagttgttttctcaagtcactcattgagccgaggactggcataccacttaaata

SEQ ID NO: 55482 - DNA, 2183 bp, Oryza sativa
agcaatcgatcttgttataacacgagagaggatttcaggaaatggcgcgaggcaagaacgacgacgaggcgacagccatggacgtcgtcgctcgcaagaacgacgacgtcgacgaggcgacgccgatgaccacgccgcagaccggcaagaacgaagcggaagcggcggaggccgccgcgctgaagggcggcgcggtggtgctgacggtggagtcggaggacccctacggcgacttcaggtcgtcgatggcggacatggtggcggcgcacgggctgcgggactgggagggcctggaggagctcctggcgtggtacctcaagctgaacgccaagggcgtccatggcgtcatcgtgggggccttcatcgacatgctcgtgagcctcgcgtcctcgccgatcccgtcgcagtcgccctcgtcgtcgtgcatcaccttcgaggactactcgtcggcgaccatggaggaggagagctaattaagctgttctcgaggaagacgacgaccacgttttgtttttctttagcctcatcaagagatgacaatctctttttctctttttttgggtgctaattcttttgtgtttccacgaaggaatggcaagtgagggaattattgtacagttgctaaaaactaattgatgctgatcattagtgtagattaattaattaattaatgctgagatggctaattgatcactttgctctgctgtgatctctcttcctagcgtagtgtgggtcaagatgtcaaattttcaatggctgacaatttttatcacaattttgtgaagattttgatgacaagattcagaggaatgatgggtcaaaccctgttccttggtctgcaggtccatgaaggcaatgcaggttatctgggatatattaatgagtcaccaacagctcataaatatgtggccttcatgccattggtttctttggagtaatgcggtaccagatgattttaatccaagagattgcaatgttatcaagctgtcacgtactctaccctgcggcaagtattagtaattattttggtcacattgacagggggctgtgtgtttagttcttttcaaacttccaaaaattctgttacatcaaatgtttatgtctttggacacatgcatagaacattaaatgcaaacgaaaaaaaccaattacacagtttatatgtaaattgcgagacgaatcttttgagtctaattacgccataatttgacaatgtgatgttacagtaaatatttgctaatgacgaattaattaggcttaataaatttgtctcgcagtttacagacggaatctgtaatttattttgttattagtctacgtttaatacttcaaatgtgtgtctatatattttaaaaaaatttggacagggaactaaacacggctagggtcaagaaggcactatttgaccactaattcccattttctacataataacataatatgttgataaatatcagattttaaaaaacgcacactacataattttataacgaatgtaggaatgctattgtcgtgcagccaagctagacacggtttatatactatggtcaaacctaaaaagctgttaaaccacatttaattttcgagatgttttacaatggtttttaatgaaagtagaattaagttagaccgtttattttttttctaattcaacagatcatatatatttatactaccatctctatgtagaattttttttactgctactagaactcatatatcaacgactgagataattttattggtgattatactggtagtaaaatgctatagtagaaaccgcttcaaagattctggtattttggctgaaattattggtgtttagttggaagttccttccaaataccagttgatgaaagttggatttctgttcagtttgagtaaaaacatgttgaaatttgcctcgaaattctacaagaaaatgtctgtttcatgagaaatgtttggccttggattcttatctaggatatccacacattaatccacgcacatattgcaagcatgatacttccattttcgcgagcatagtcagtacaaacactactaggactgtttaagttttgtccatgaataagccttacccacagtcctccacgatcataagtccctttcagtgttttcgacttgaatgcgtcgagtaataacacagtgggtccatgaatttatcagtgcttatcatgaag

SEQ ID NO: 55483 - DNA, 1022 bp, Oryza sativa
ggaaaaaaaatcttcacaatcctagttggccgtcggcagttatttttccatgccttcattgcttgcatcgagagaatagacaatagatcatcccgcccacgaagggaacatctcctcaatattttaaccacacagcgccgtgggggttaagtgccacacggcctcctgtaacacccacttttatataagtttaggccaaatatcatattctaatcctaattaaaaagatcctgcgcattaacgctgcagcagtgagtcaaacacctaatctccgctcacacgcacgggcgtgtgcaactaaccatgcattaagcaataggatttgtttaactttggttaaaagatagtggattcaaagtgcagggcatcgcattaatcttcgcttaagtgaagggattactccattttaatgatggtacgaacttgtgactaaactattgcaagaagctgacacattgtaagaaaaaccataactactaacccaaatggtttgaaatacaaccattagcttcatagatgtcttcaataaagaaaaactaaaatctaataataccaccataattatcatgacaacaaagtccagacctaatgtcaactctaaggacaagtctaaatcttatttatttccatttaattgttcgtacaattctagctttatcttatatactcactatttatctctatgcaatatcttctgagtttgaaagtttagaagatatactgagaagtatccatgcaatatacaaatgcaaaaaagttgacatttgatgaaaacattaagcaaagcaatgttggtttgctctagcacaaaacaattggtcatatgatttaatcaaccataagggtgaacttgtatgaacactcaccagtatgttgattctttgagatccaacctaaacaaccgctgataactcgaatcttactcgcagcacagcgggtacttgctcaaataacctctttgttatccctgacaaagaagaagcaggacaaaattagcttcccctctccaattgctgataact

SEQ ID NO: 55484 - DNA, 5074 bp, Oryza sativa
ctcatgatcatgtcattgagctaaaaacagcatcccaattcacacatttgaaaattttgatgctgcactagctgcataattttaactcccctagtatcttgatttttagtcagcagctttagttgaaagctcaatgttacagaacttcacatatggacgatttagtatagcagaagtgcaaaaatatcttaaattgctgatcatgtgcttgacataattcttgtttaaaataataaacagctaaatttctggaaccaataacaaaaaattacaagctcattcttatagttcagttatcttacactgctatagcactcaataatagacaaattacttatgtggtagactctaacccatgatatccttctacacctttgcagactgatgctgattactggcttctcaccgatgatgatatcagcattactcatatgtggacaacagcatgtatccttgatgaaatatagtcattgggttttttttttctcatatactataagagcttacaagttgcactgtgcattgaactttgaagtactttaacatgataaccagcagaaatgcagtgggatcagattgacaccaacgacttcttagctgaagaaataagtgacaccccatgtgcactcaaccagccgtctgctgcagccagtgaacctacaggcgtgggcttcaaccatggataaccagtaaggtttactgctagaccagatctactggtgtcgattgaggttattcggtatgacttaattcctccggtggtttccatgggagtctgcatcctttcccagagaacaggaagtgcaggcgcagcgtgaagatgtacatactgagatagtcagatagccatttttttctggattggcggtatggatctgaaaacatatttgcttatcactccacttatgatttgattaccctcctgttccaatggtgatcgatatgattgtacatagaggcgttgcttcgttgtgttatttttatagctcactcaggttctttctcccagcttaagctacttggtagggtcagtctgtaaatagttcgactagggtgtacagcatatgagcaaccattgttctatgcaagtttcatgcagaaaatgttttaaaaaaaggcttctgaatgttctggctgtgtacctatgattaataacttaatgagtgtttgaatctgcacaacacccatttctgctagtagtagtttaattcgggatacactagatcattatactgttttagcatgtgtttgtacaaaagtagcagcagatttactgggtagccctctacttgcacatctaagcttacatacatgattcacataccactagtatatatacttgtcatgattcagtacgaacgagccaagatcaaaacgaattcacgcattcaaagatcaaagtatacttgatggatcagtcgccccccttcttgatcctcccaatccagctggccaccaccggcgtcagcgccaccgtcggcgggaacctgatcggcgacgccgccttgtgcgccgcgtaggccagcgcgaacgtccccaccttccctcccgtctcccccgtcgcgatcccaacctgcggcaaaaagcaggggagccacgtgagccaccgccgccggccggtgagccgccgcagcccgtgcgagcagagcaggaagacagctcaccttgccgaggaggtcctgcacgtcgacgccggcgctgacgaggaggtagcagagcgtgaaggagatgagcgagagcgtgatcgaggtcgccaggtacgcgccgccgtacttggccaggagctccttcgcctgctccgtcctcgacttcctcgtcttcccctcctcctcctccccttccttggagctgaacacctgcggcaaattcgattgcgctcacgatcgatttgctctccaactcgacaaatatagctgcctgcgccgcgtgcttactttccagaggccgaactcgaggccgtacttctcggtgatctcctcggccgtctgggcctccccctccttggtctcctgcacggcggagagccgccaccggggaggccgagaggaggcgaggagccgcggctgcctccgctgctgcagcaaccggtgctggtgcctcgccgtgggcgcggcggggttggcgaggaggagagccccggccgccatggaaggaccacgcgcgcggatggtttacgagggaagcgagcgagcgcgaggtagaagaagaggaggaggagaggtgaatggggacgcagaggctggaggggaatcaggggatagggagatcgagccgcctggtttgctggtggtggtggtattcacgggcgatatgctcgtgatggacggctgagattgagcgtttgccacggcgttggtgagtttctgggcttggttgcgggaggaagcccagcccatgaggtggcaaacgtgaggcgggagcacgtgacaagtagcccgttgcggcgccacggagcagggagcaccggcgtctgatgggaaaatatacggcagaaactagagaactaccgttgaattgaaaaatgaatgtttgagattcgtacacatcatcacgagtaagaatttcactcgtagatttactcatgagtaaaacttttattgagagaaaatttcactctatggtgacgtaataaatcttggacttttagttttcaattagtaatttttaggttttcactatgtattttcctgcatctgacacacgcaacagtgtgacaacaacacagacaacatgccatgccatgccagtctatagttttgtgtggcgtatctgcatacgctcattgctacgtaaatgttcggtatacgtatcagtcgggcggatagtaaactttgtccattctcattacaacctcaagcagcatatgcggacaggattacactagcagaccatttgcagcgcacgagattaaccagtgttgacgtcccaaccatgtagagttgctttgctagctcgatcatacttattcatcagcagtgcagggtatagctagcacacttaagcaacagtattataggagtagtatgctgtaagcgatctgtaggtagcttttagtggcgccagagcctaaacaaggccgtcgtacgtcgtcatcagccctgcaggctgggcagcgtgtaagctacaaaaggcagagaaccatcacacttgtcatatacttggttttaaaatataatcatttctatgtgtttcttgaactgtatccggatatatagatgtccaaatatgtttcgaaaaatacgcaaaaatgtttatattctacgacagagatattatatactacatctgttatcactttgatttttttaaaaatcaaatttatttagcttcgatcgagtttataaaaaatatagtaatatttttaatataaaatgaataaattatcaaaacatattcaatattagatttaataaaactaatttaatgatataattgtaatctttctataaatttaatcaaacttttaaaaagtctgacttgtaatatgaaacggtataatatgaagctaaccaaagctcttcgcacgcaatacgtacgtaccgccgcacttgtagccgacggggcggttggcgagtttgcagcgcttggggatggtgatggccacctccggcttgacgccggagcgcctcacggtgctggacagcagcacggcgcacaggcacgcgtggctctggtgcgtgccgatgtcgcgcacggccgcgcagcacgcggccggcggccgggccccggggtcctgcgccgccttcgcgcacggcgccagcttcagcgccaccttctccgccggcgtcttgccgcacttgcccgcggcgtgcgcaacctgccacggagcggcgatggcggcggcggcggccaggagcaggaagatgatcggggacgacctcattgtttgttcctactgctagctagcgtttctgatttctgatagcttcttgtacttgtgttctataagctcgttggctactactcccggctcgcttgggagctggttatatagtgctgggcgtgcgtgaagccgatcgatcaggagcggaaacgttatgacggttatgacacaaaaacgagatgaacatatatggataccggggacacttggcaatcccggtcaattaatggaataggctagcaaagtagcactacgtacgtgcagaaatatcaggacgatacatgtatagagatgattcttaaaacgatgtgtaaatatattatctcagaagtcattctgcaaactcaacctgacaatagatgatactctctgcatagtgtcagatgtgcttacgattataacatgtttggtttagtggatagaatggttacacgaattgtctcgctatcccactatgtaaagttactaaaacactgtttcaagaaactcctatctaagatccctaaatttaggggctccctactctagtctccatattctctaaagtcatagcactcctatccgacttgttagtgattgtgtcatttatcctcccacatattatctactgtctatttttttgtcactaggatttgtgaacttcaaaaatcaaactttattatattttgtgttttagctttcacaattcgtctaatcacacgttttttagttcagtccctaatactcgagagtttaacagtaaacacaacattaatttgacttaaaattaggacaagccatttatgtgcacaaaataagtgtggcaggtcgtggcgtgtgctatgtttaacacaaggaacgtgtgagggtgtgacacaccttcgcttaattagtagcgtgtgtactgtgcaccctaacaagtatgccttatgtgatgacctgcaggccaaatggctaatgcacatgatactttgttgcatgcgagtcgaacgttctcataatttaaccacatataaggtacggagatattagttagcaatgttagtacaaaatggcctccggaattggggaaaagaataatcataaggcctattcggttaatccctatgaggaaagaatttgaggggatttgaaattattccccctccaatcctctttaaacctctctaaaccgaacaaggtctaagagtggtatacgtacaccacacaaca

SEQ ID NO: 55485 - DNA, 4465 bp, Oryza sativa
gccccattttagtttgttttcacggtgtttttcagcggaagcagcaaacgcggggcctggtggatccatcattttgctctgcacctcctatatgtgatagagaaatttgtgccctctgcgatgaacgatacatctactagaagatggtgcaccagtgtccacgtgtagcaacatcgtcattgtaatacatcaagcaaaagatgtcttattatggagagcacaacttaaaaatattatatctgtttttttaatagataacattgttaattttttatcacacgtttgatcgttcatcttattaaaaaaattacgtaattatactttattttgttgtgagttgttttatcactcaaagtattttaagtatgatatatatcttatatatttgtataaatttttgaataaaacgagtggtcatgttcaaaatttaacggtgtcatctattaaaaacggagaaagtagaatataacttacctaaaagactagtcaatcttattaagttgtggctccgattagatttaaaacgatctcctatatcgatatcatatgggcgcgtggggcacaaccgatattgtgaggattagttgaaatcccctaatagtttctgcaagactgtctggagttggtaatgatataggtcctggtttgcggaatgaattcaattcttggaatggtgtcaactcagtagcagtcttcgatattcatgaggttctttcacgtgtggacctaaatatgcttttatgaaacctaaaaaaaagtgtgcgttccggaaaaagtagcctacttgacagaaagggcgggcactctcggctcggaggtaggcactctcggctccgataaaaacctttgaaaaaaaaacgatttttgataagaaacactcaatttctcgtgctctaatagagtgaaaatcgttggctcacatggatgcgtctaacgcacatccgatgttgtgtatgttcaatattgtgattcgggtaaaatcattggctcattgtgcatgtggcgcacatccgacgttgtcaattggagcgatcgttggctcataacaaggatcacacgtgtgaacgtacctagtaggctagtaccgtggctgcgccccttgctaagcttgcaagcactagtatcagcctgcaggcgagcagcatgcacaaccgtcgatgatgctcctctaatatagtcagagagagaagtgcgcctcttacatgtgagagtgcgcctcttacatgtgggtctatggagagatcttctgacgttaaatcagagaggcatggtggctgatatatgggtccataaatgatgagtctcatatatcagtgaccatgtgcgcgctgtacactaatgtgagaggatttggtttcgtttaagcagagcacacaacctctgaatttcttcactgttactagttgcatgtttcctctgtttctcctctgcgggcataaggcataagcgagcatacaagatgtaaaaatgtatagcaagttttttgaactaaaagtgtgaatcgatgaacaaaccaagttgtactattattcagagaattcaggggagcgtctctgcatccctccgagataatatgatcaagtacacactatcctgacttggagaaacaactctacggactgaaatcacgaagtcccacggaagatggaacccttttatttggtgtttgacactgacactaaactgcacgaacgcacaacagcatacagctttagtaagtaacacgacataaactcgataaattaagcggatgacagacacggcaccggcactgcatgcagtactctttgttgctcatggcagagtgtaatctgtgaaagagaattgagaaggaatcgatcatgttagattgttagcgccaaccaactgaaaatgatgaaataatcatagattgttcgtggcaagagttgacagtttgacatgttgattaggctgtcttcttcccttttttttttcaactctattcctccttttcaaattattaaatgatgtgattttttataaaaactgttactattttttaagtttttttaattaatacttaattaccatgcgttaatgactaacaccgttttctttgctgctcccgatctcagcttacctccgcacttgtagccgacggggcggtcggcgatgttgcagcgcttggggatggtgatggcgacctcgggcttgatcccggcgttcctggtcgtgctggacagcatgacggcgcagaggcacttggggctctgcttcccgatggtgtgcaccgccgtgcagcacccgctcgacggcgtcgacttggggtccttggccgccgacgcgcacggcgccagcttcagcgccatcttgtccggcggcgtcgccccgcactcccctgcaccgtccgccgccgccgccgccaccaccaccagcgcgagcaccaccaccacgacacccctgatcaccgccatgtcgatctcgatcaatcgatcgctcacacacacacacgcacgcactgcgaataactagtaattaactaccccctgtgtcacgctgtcacgtagtttttcgttgatgggcttcatggctgctggtgctttatatatatacaggcgtagcaggtgaggtgacacccccatgatggtcggggagagtggtggagcgagcactatcgcctcaccggctcgcgtcggccaatggcgccgtgcaagctcggccacgcgcgcgcgcggcgatcgaccgagaccgagcggagagatagctcgctcggtgcgcgcgctagtgggtgggtggttgtctcggcctctcgtcgacgcgcgccgcgtttgtgacgacctacctgatcaagttcgcatacgtgccgtgctctcaagtctcaacaacgcaagcatccaagcatggctgcatgagcctgagaaaaagcatcgtaagatggttcaatcaaatgttgttgcgcagcggtagagaaaaagagatctcgactagtttagcgagtactagttttgaacgtccactccttacttccactccttacttgcatactactcaaatagttataaaaagcttttaaaaaatatattaacatgtgatatatcactctacaaacatacaacttaaaatttaacttctgtatatgacaacaaaaaataaattaaacttacaagtagaaattaaatgttaagttacgtgtttatgaagtgatatatcacatattaatatatcttctagtttttattaatttatttgtaactatttaaatgatatgcaaacaacagaaaaacatccatacaagagttttggtggtgtgtcggtggtgttggtcatcatttcgttcatcggctaagcacttagtactaattataacctactaggattgtcaaaagcacaaatgtaaacgtgtaagtattctgatgactgatgagaaaaaagagtgtaggcgtgttaggtgtagccgtgtaagcgcgcccggccggcacctgtgcacagcaacggtgcattgccatttgccacaatcccaaattcgatgctccgttcataagggagtgtctctagaaggagagtgccctcaaaattgaaaaagaaattcagatcgacgcttcatcctggccgtgttgggcagtattattacaaacttaaaaattaaaaaatagagttggacgaagattaagatagtctacctaaaataaaaaagccattaacatataattaaaatagagttggatatagattaagttagcatacgtaaaatgaaaaagtcacatgattaattaagttttaattgttacaaacttaaaaataaatttatttgatattttaaaattatttttatataattttttgaaaaacatattgtttagcggtttagaaaacatactaataaaatccttggtaaaatccacgtcttaataaaaaaaacaacataagatatgtaagcgagaatgctgggctaagtcatgtgcccatcagcccatgtgtgtctagtgcccctgtgcagcgggcggtaggcgattcgcgccgccgccggccgtggggcgtcgcgtcgcgtgatggtagtatcaggtgggtgggacaattgggatggaaaaatatactttgactccctcaactatagctccgagtatgattcatatcctttaaccacaaaaccaggtaaattgactcctccaactatcaaaaccggtgcaaattatatccctcggtgattttagctgacgtggcgcctacgtggcggtattgaccaagtctttgttctacgtggcgcttatgtggcattagaataaaaataaaaaaaaggtaggacctacatgtcactcacacaaaaaattatattgtgggatccattgatatgtgagacccacatgtcatcctccctctagctccttcccggcttcccttcttcctcctccctccttccctctctcccccagcgtttctcttcaccccggccggagcggcggtggggagtggcggcggtggcggtggggacagaggaagggagcgg

SEQ ID NO: 55486 - DNA, 4098 bp, Oryza sativa
gccgccgctccccaccgcctctccacaccgtcgtcttcccgaggagagaaaggccggggaggagagagagacaagggagagaggggcaggaagagggaagaagagggaggatgacaggtgggtcccacatatcagtgggtcctataattgttttttaatgacatatggatcccacatattttttatttttgtttttattttaatgccacgtaagcgccacgtaggagaaagacttagtcaataccaccacatcagccaaacccacctccaaaactaccgagggatattgtttgcaccggttttaatagttagagaagtcgatataccggttttgtggttggaggaaataaatcatactcgggcgatagtggaagcagtcaaagactttttccactggggatcggtccgtcaaccgggagagattggattttatgtgcgtcgactgggctttgggccttgggccatgattcaatcgagttctcttgaagtacgtattttagttctttctttgagagaggttctgttcagagtctcaatactgcaaagccacctcatatttacgtcataggattttctataggcatagtcatatcagggattttcaaaaaaaaaaaatagtgctgtaatttgtagtcttgtatatggggttttcacatttggttcagttcatcaatcttcacgcataagtttacgaatagacaacatgataaacggttttaattttatgctttgctattctgaatccactaatggatgtcattggatcaaaatccatggcctgccaagaggtggaggcgtcaatgagggagatggcgaggacttcgatgagagcaggtttagagggatggaggaatagcaatgagtggcagagacggtgggccggtgagggaaagacagaagcgttagcaccagaggcttagggatgaacgagagtagtgcataggatcaaccgcggaaacaaagaaggtcatgttgttaggaagcaggcggcaatggcatgaaccatcggagacgaaggagaagggggattgtgtcgtacttggagacaattggagaagatgcatcaatagcgacatactcatcagagatggagaagggagcggtcggtggggctcttaagaatggtaaatgagaagcaagtttgcgaccaatacatagccaataatctgctcagttcaactaaaactgtagtattttttttttcaattgctaatctacaaactatatgaaaaaaatcaaattaattttttttcttgttccctttttgccactggggatgaaaacagtcacggaaattccgggtcgaccgagcaccatttccatatgagtggtattattttttaccgtttctggttctacctatttataaatttttaattttctatttaacatcatattgctatttttactaaatagctaaattgataaatatggtcctgacaatccgtcgtttcagaagagatgaaagatgctactgtttcttgtaagcatccctttttcatccctgctgccactgctaataggcctgataagcttttttttttaaccctctgtttcgtcccctttttttaataagaggttctggacgctcgatttttagatggtgttttttttcttctgaagataaaaataaaaataaaaattaagttttatatgcaaaataaggtggtattaacgtatgattgagttttaattattacaaacttgaaaactagatttatatgatattttaaaacaactttcatatataaaatttttgtacgaagtatacggtttaactttcatataaaaagcgtgccacgaaaatcttttcaacttttgcttagagaaaagaacgggacccaatgatcttgcaagattcttcctgctgcctttccaaatcttcgccaccacacagagtcagagagatgcacagcacaggtagttgccgctgccacagtgctacctccacacatgccacggtgccaccctgcaaggtcgttttcatattttcagacctccacatggttgatgcccggttgaatagaccttagcggtatttctttacatgatttttacatgaaagattaatgatccgaagcttcttttctgacccgaaaaacaatttgagcaagtttaatagtatagcacactactaactccaaatcatatatagtcaatataagagcaggtacaataacaaactattagccagctacaaacatattttaatgagataaaagatgagagagatgtagccagctgcagcacggactccaagacgcaatgtgtgtatgacaagtaggaccatatactaatagtatagtaagcaactattgtataaattagctattagattggctatagatgaatttgagctagtagttggctatactattaaccttgctctaatagccaatcatacaatagttgcttaccgaaagggccttgatgtcgcctagaggggaggtgaataggcgcacctaaaatttacttcaaatcgtagcggttaaaatcagggcccagaacttcttggcaaaaggtccggaacttcctggcagctttttctcacaagcagagaaagctgcccggaacttccggggttcttcctaggaacttccgggcagttgtaaattgctatttcaaacacctcacaacaagtaaattaaatcacaaggaagcctaaactatagagaggtacaacatgtctcaaacaagagtaatacacatgaagatacacaagatagcacaagtgatcatacaatgggagacatgatagaacaactaggcaaataaagagataagcatcacaatcacaaagataaagagagtgagaggagacaaacgatttgtttcccgaagttcggattctccaccgagaatcctatatctccgttgaggagctccaaagagccgggtcttgattaacaccttgcctcaccaaataatgttgggtccatggaagttagtcacaagagatttcggcacccaaatggcctttgtgctagcatgtagcgaactaatcaccctagtggcacaagtgccatttttggccttcctaagcaaattgtgatgaaatgagaggtttggcttaggaatgttaccaatgggacaatttttaccaatatgtctctttacccggcaattgtaggaaagttgagttttgcttttatcttgcttcttgacttgcttgttaccggtttgcctcttgcttgattgattgcaatgatcatccttcttgtgcggacaaaatccgatttcatgccccttctcattgcaaccgtagcacttccttttgttgattcttgatgtctttcttggaagtgtggcttcatcatcaatctgcaaggacaacttgaggcaaagtgtccctctttggtggatttgaagaacttatgagcaagatcctcattcttgctcaacttcctctctttcttccaaggaacttccgggcagttgtgaattgctatttcaagcacctcacaacaagtaaattaaatcacaaggaagcctaaaccatagagaggtacaacatgtctcaaacaagagtaatacacatgaaaatacacaagatatcacaagtgatcatacaatgggagacatgatagcacaactaggcaaataaggagataagcatcacaatcacaaagataaagagagtgagaggagacaaatgatttgtttcccgaagttcggattctccaccgagaatcctatgtctctgttgaggagctccaaagagccgggtcttgattaacaccttgcctcgccaagaaaaggcctaggaagaggtctccggtcttcaagccaacacccctaggtacttctctttggtttcaagtgaccactaagatccccaacttaaacaccaaaagaacaccacaagtgaggcttgctctaccaagacgacctcctaaacctcacctctgttttctttcggaggtggaataacgctctcacaaacttgcccgggtcaatccacaaccttgttggaaacttgcgggcgacacctaaccgtctaggaggtcaccctccaagagtaacaagcttcaagtgatagcccaacgagatacaccaagtgctcaagtcatcctagccttcaaaaccttctccaatcct

SEQ ID NO: 55487 - DNA, 1004 bp, Oryza sativa
ggagctggcgattgatctcggcggttcgaccggtgttacaacctcggtcagaccgacgatatccaggcggtcagaccggcgctactacttcggtcagaccgcgatccatcgatttcgaggataacttttattttcgctaaattttttttgtttttgggtataccaaccattcactcctctctggttggtttagttcttgtgatttaatcttacatatagtgagttctcgcttgctgtttttgcttctcttccttttgctggagcttattggtttcttagccagcgtttctagtttctctttcttttcctgttcccgaatcccgggcgatggttgtccggctgccgtgtcgtgtaaaaacttgcttttgcttattctaatagaatgacgtgtaattccttgtcacattcataaaaaaaatgaattaatcatcgcttcaccgtcaaaagttgtatggttaatcctaccgaattgtcaaatcgagcatggcatacgttaaaaagctcaaacagcaagtgcatcttgcagactacaccatcacagagtccagaattatcagaacgatcaaacgtctggtaaaaatgcatcccccaaaaaaccctcctcctatttcagtcaaattctgaccacacacacggccatctgctaccagctcgcgttcttaactcctcccctaaatgcactcaacaaccttagtaaatccaagctaagcttcctccgctatataaacacccccaggaagccccattccatccacacgtttcagctgtctttcagtgttcacgtaggttgtagagagcacaacaacgtacgtacacagcagcaaagactgagactagctagcttagctgacatggctccaaggtgcgcgacgctggcggtggtggtggtgctggtggcggccgtggtggcgccgccgacggcggtgcgcgcggctatctcgtgctcggcggtgtacaacacgctgatgccgtgcctgccgtacgtgcaggcggggggcacggtg

SEQ ID NO: 55488 - DNA, 3992 bp, Oryza sativa
  unsure (1)..(3992): unsure at all n locations
tcctgcagcccttcaaaaaaaaaatttctttgatatgaagtttgttttgtattgcaaaatgtggcttgactatccaggctaagtgtataactattctgttcacgtatgctgataaaacaccaggtagactgttcaactgattggtctcacaccgacctaacggctaacgcaagaactttatgcagactggaatactggattcatgagtactaaatgagtatgtaattaagggcaacaaagttttttttatctgttacaaacatctattaattttttaggtatgatgggttcatcattgactgtttcaagagtaggctaaagagctgccaaagtgacaaattgtcgttgcagttcggccgttgtgatgacaacgatggcgatatccgctaaattggcctgtgcacggcgcgggaatctgcatgtctggtaggtcgtcaccgtcatcagaaatcgttaacttgtctctccttatgccaaatgctaatttttcaagcctaaaattgccggggcggacggtgaaatcaaagacgaacttgaatttttagccgcatcgtttgacagtaagccaagcattcaagttaagttagatggactttttgatggatcgatgatcgaccaacagactgacgtagctctgttcactccaccaaactccttcgattgatcaaatgactgtttgattatggagtagaaactgtatatgcgtagcatccgacaataagcaagccagtgaagtccatgaatctgcagtgcggatttggccgcattctgaagaactggacgagaaatgctgacaccgcctgagaccgagaggcatctgtgtctggccagagttggttgagcccgaacaaatccaccaacattttaagcaagacaacgagcaaccacccaccaccgcacggagggaggaggatttctgcctctcgtcgcattcgtcctctctccctctctcggttctcgcggtggtggccacgggcgcaggtgaggggatggtggacggcaggatggccggcacggcggcggcgctgggcctgtcggtggtgtcgtcggtgtcgatcgtcgtctgcaacaaggcgctcatgagcacactcggcttcgtgttcggtgagccctgaacttatccgagttatctcgcgtacagtctgtttctgttggacgccattgttcgagatgccaggaacatttagcggtttatactgcctttaatcgatgcgtagcagagtccccgttgttcccgtcttgtgcatcgcctgcgataatgatttctgattaagctcagtgacggagaatgctttggcctgcgtagaagacaggaggcggcggtgtacggcttgcaaacgaggagtaatttgtgaaaaaaaaacttttatatacatgttcttagcgaactaaaagcaaatgctgaaaaataaagttcgataaaaatacaccaaaatcagcttcaaatttaaagttgaaaatttaaattttggctgataaatataagcataagcgaaaagatgaaacaaatagtttacgcaagtacctcctacaagtacactgcagtttatgtgtcactcgaatggttataaaaaaataaaaaaatattaagaatatataaataatatgtgatatattatttcacaaatatatatgtttaaatttaaattcaaaattaaatggacgggaagtgtccatccatttttttgcaaaacactgcctgctgttaggattggtgagtggcgattgggagttttgcgcgaaaaaaaaaaactcctatgatgaccgttttattgatagcggtctttttgtgtagtccgcttccccttctgtcttcgctagtacggtaggagtaggaccctgtcaaaaccacgccgccggcggcggcggcggcggccggagagcaacatggccgcgtgttcgctgcagagcatcccgcccggatggcgttccggggaccggggatatcattacgctcctcagcctccggtctcctctgcgccgtgctcctcagccgccggtggcgccgactggtcgccttcgccccagccctcggtcctcgttccaccggagatctccccgcctcgcgctcgcctacctcggttctatcgatcaccctcttgaacctacctcgctcgcctactttgcgcttaaaattccgcgcacatatctggtctgtttgctctttgcagagatcttggtaagtagatttcgagtctacgaacatcttattcaattcccgcaaaanaatcctttanattcctccattccaaggaaggcctaatactattgttctatttaatgctagcatctagcactctgtccgcatacattggactgcggcaatacgagcttagagcaacgcaaatgactagataagtatgcactctaggtgttctttgaattgcctcagtgcagacttgatgaccattttctgaacatctctgctctgctgcatatgtgagtcaaattcatggctccatgggacaattggaaattgcacaacgttactgctatcctattcatgtatttgttgaacaaaaatgacatccttcgaaaattcaggaaacacaagttgcctgatggacacggttcattaataaggcacacaaattctatactactttatgagtacaatatgacgaacaataccacctgagaaaactaactgtttcctaagctatataaccatgcaaaaatcacagcactctcctaatttctttcagctactacgctgacaagctggcatctcctggtgacattttgttcccttcatgtggctcttcagatgaagcttttcgagaacaaagatttagaccccaagacaatcattggatttggaatactaaatggcatatctattgggttgcttaatctgagccttggattcaactctattggcttttatcaggttggtttactcttcagaaatcaggccaatcttgcatttgtttatttttcctattttgagatgaacatattcatcttcagcaaacgacacctgttggaaactttaaaacttaaattcttgctggaaatttagtagttgaccttgattcatgcccaatctgaaaatcaacatgcacacaatatgttgccctgattttattggggatggaatgacacaattcaacagtctctagtttcagccaattcatgttctttgtctacagacctaactgtgcttgtgtaattagtctactgctttgtctaagctatctcactctatcaaatgcatcaggtaaccaagctggcaataattccatgcactgtatctttggagactatattgttcaggaaaacattcaggtctgtccaaattttgccttgtcttatgtaaaaaaaaaaaatttgccttgtcaattcacgctgaaaaaaaccattaactactaaatatatgatgattgttggtatccttgtgaatacaagcatggtacttgaatatttgaattcctcaatacctgtgggtcttgcaatcctaatgtcatactcccataaaacaataacttgtagtactatcataaattgaatagactataacaatattttcacttcatgcagccggagaatccaaatggcactggcagttcttttgtttggtgtaggtgttgcaacagtgacagacctgcaactgaatagactgggatcgctgctgtctctatttgctgtactcaccacgtgcatttcacaaattgtatcctctaaacaaagtatacattcaatattattttctttgcactaaaataatgacacttgattctttgtttttaatagatcaataatcagacatatgcattatagaaaaaatggcttttggtgttagctcatatcaaatatatattaatttaccagataaatagtttcttatatctattttgatatgcattctcttgcacctaaagtggatgataacttttaacatactctgaaactctgatagtttctacgacctccgtcccaaaatatggcaacttttggctatgatgtatccagattcatagctaaaaatgctt

SEQ ID NO: 55489 - DNA, 1121 bp, Oryza sativa
agcgtgtagggtgttgcaaagcggaaagtggcaaatacgctttcgcttatgaaccccgtgggccatggcccttatatattcctacctgacaacttagaccgtcgatccaacacacgaacggccaggatgctttgccgcttctcccggttctagtataaaaggccactcgtggcgcaaaccctagtagaggagagattaccttggaggcttctgagctcgaaccccccgccgccgccgccgtcgcctcctccatccgccgccatggtaaggccttgcttccctatgcttaacgcctagattgctttgcgggattcagcgctgaactgacctctcttcttgctgcatcggcgcagaccttcaagcgccgcaatggcggccgcaacaagcacggtcgcggccacgtcaagtacatccgctgctccaactgcgccaagtgctgccccaaggtaaggcgaagcgaatccccttttgccctctctcgttgcgcgcgaggcacccactggatctctgtgttgattgggaatctttgctttgggtgcgggacaggacaaggcgatcaagaggtttcaggtgaggaacatcgtggagcaggccgccatcagggacgtccaggaggcgtgcgtgcacgatggtgcgtttcctctcccccgcttttggtttcttttgctgaatttgtatgtgatgcgaaatcgtagtagaggttggatttgtgatcgccgataacacactggcgatttgcatactgctggaaatttttattctatcttgatattgttgaattgatggcatacaatacaactatctcgttgcaggatacgttctccccaagctttacgccaaggtgcatcactgtgtgtcctgtgcaatccatgctcacatcgtccgtgtccgctcccgtgagaaccggagggaccgcaggcctccggaacgcttccgccgcagggtacctgatccccgcctcttaactattatatctagtgcttaattgatagtgtaattagtatatcatgatcggaacgatttcctttatctgttactgcagatttaagaaacaaagtctgatatactaatagacgtaatgattttgcacagtatttgagatatctcttatctgcacatat

SEQ ID NO: 55490 - DNA, 995 bp, Oryza sativa
agggggggcagtgtgacgtgtccgtgtaaaatgtgaaacgggtggccagcctgcacgccaaatttcgccgcgtgattggttgggtcatcgaccaagcagatcaaacagcagctgctgacagtgttactactagtagacatgagtgaattaattagtgggcatgcgtccgtgcgtgcgccctgctcagttctacgtaactgcgtagagattacgtatagaatagtgatgtttcgtccagcagagtgagtggacttgtaggggttaagcgcagcagttaaccataaacatgcgagttggcaggagtttggcagggctagttaaaaactcaaaagagccattaacaaatgtactggcatgacggatctgtcaggagatctctcggcacacggtatatggggaggtggatggagtttgttcgtaccggcatgaggccagttgctgcagacagtttgattcttgtgaccccatgaacttgaataataaactgtgtgcgtatcagcgaagagctagtatatctattgaaatactatgaaatgatgtgcgtggatactctgatatccagctggtgtgtacgtctttgtcccgaccaacaacccaaatattttcgtgttgctgtcctctcgattcagttttcatgcatacatatattcagctcaacgaacgttaacacgtaacaccacagcaagaacacacgtcagatcatatccttgacaatctccctcttgacgtacaatgcatgcattccagaacttttttcaagcagatcgatggaaaaatccgtccgtacataaattagagtcttggatcgattagtcaaaccgttgagcttgaggtcacaggagagccacacgtaccgcatgccacgcacctgccgatcgatcgagccgcacgcaacgcaggcacgggggctcgcgcgatccgcaaagtcgcgatcgatcgatggtggccgcgcgcgcgcggttaggtacgccgtgagccggcgaaacggccggagc

SEQ ID NO: 55491 - DNA, 764 bp, Oryza sativa
ggagactgtcgtcctcttcagagcccacactatcggcgacactcactgctcctccttccttgagctcgtagccacctccttagctctatcgttgctcatcctggatctggtgagctcgatgctggagggacgtcgtggtggtgcttgcagtagcggctagcagcacacgagcatgtgacctcaaggatgtcactggctgtaccgtttgtactcgtggcctactattgccttcttgactaccccactacctttactatccaccaccctctttcattttatggctttggtggtgccatcaacatgtcaccactctcggctctcctatagcctccatcacttggcttttctaaacccactacctccctccctagcctgatctaaatccctaaccagagtcgtcgctttgtctttactatcggagggtcacgtgagttggtcgagttgtctgagttaattaaaggagccggcctagtgtatgaatcataagttaaatcgatggttcaaaatttgtaagattttttctctaatttcctattagataccagctagaaatgcaatataaatgtcgaagaattttgagtagtatttgtatttccgtcgaaagtgatttacaaacggatacgggatacgactggcattagaccaacaaaaattgattcagaatcagatggtcacagtcgcgggctcacatggcaaattaaagggcccgtcatggtcaccatcttgatttcttgacacagaagacgggggcaagaacgaattaa

SEQ ID NO: 55492 - DNA, 765 bp, Oryza sativa
tttctttccagatctgtgatgctatgatttgtggatgatttggggatatatagggagcagatcaatttgagcaaagaaacaaaaaaaaaaagaaaaaaactagggatcaaccggactgcttccaccattaccaactgggattaaagatacccggatttatagttccggttgtatagggggttcccaactaggattaaagcccctttttccactagggtgaggtacgtttcgtagggtctaaaatttcagcaacgctatatcaacgcacgtacgtacaggtagcctagctacccggccattacccagtgagcacacaaaatttatcatgcccagatgatcaggcgtacgatgggaagaagaggaagactggaagaggaaagtaggaacttaccgcgtgtactgctgcccgcccagatgatcaggcgtacgctgcgggcgcaggtacggaaactccctcccccagaacgtacgccgggccttccgccgtgcagcttgccgctaccgcgacgagatgcgtcgcacactcgcacgcgcccgccgcgccgggatgcctggtatagttgtacggtgggcggccgccggccggcgctgcgcaatcacgcagaaatccggtcggttagattttgtagggggcaccggccggtgtccggtggccaagggctaaagccagtagaggccgcgatatgatctgggctgagcgtacccagcctgcgagccctgtaacataggctggctgggccgcacaggtagttgggccgtgaaggt

SEQ ID NO: 55493 - DNA, 1156 bp, Oryza sativa
cggtagtctggtataacatggttcagacttccgatggacgaggaagctaccagtccatacacattacttcatgcacatactttcgagaccatttaatatcgttaatttgcctacatatattgtcctggtacgtagaaagcaatgtgggtgtgtgcaggcatatgctgaagtgatgtgagtcggctgttctatgcatagctatgccagcttctactagctaattgcattatattactaaaacccctgtaggactaggggcctttccttgacgtgcagtgtttgcagctagctcagctcgatcgtacttggttgagttccaagcaggcaaagtagacacacacccggcctcgtattaaaaactggagcaaccagcacggcctctccttccagcgtccatgtgtgcgagcgagagagagagagagacagagagagagagtcgttaatttgtttatttccaagctaaaatgggttgggttgggggagcttggcgtgtgggatgtgattgtgatggggatttggtccagcgtcgtgcttgcttgaggtggcgggcatccttgcttgcttgcttgtccgcactcaacaccaacgccgatgcttaaaagtcttcgctaacctcgaaaacccagcacgggatgcctactactcatgcatctccactgttcctgctcgtactactaccacatttgttgcactacatgttttttcatgtatacagtagagtatatggcctgttgcaacccaacacagtagttaggttgatcagtgttcaggctttcagattctggacctggaatttcagctgtgagctgaaaccggacagattacgcactgcgtgttaggtttaggtgtatgttcgcggctcactgcacatgcttcgacgactggcggtcggtcggcgccgcgacggtgcgtacaccgcaccgtttttttgtttgtataagagtgacgacggaataatgtaggagtactagcatagccgctccattgactagaggagttttgcatgccgactgcacaaatcttgaggtttagcacgtggtggtggcagcaatacgcgaccttgtcgatcgtaccactgtctggtgactgtgccggtgggagaaaaatgaccgagattgaaaaaccggactgctttttccagaccgatacataagtg

SEQ ID NO: 55494 - DNA, 1235 bp, Oryza sativa
gtaaacaagtgcgcagaaggatgccagctcgctgaatttcattacctaacggagcagcacagcgcgccgcttgaatccaccacagccactgccaccgcaacccgagctgaggcagacgcaacacagggagatggccacagcgaagaagcacaaggccaccaccagctttagcatggaactgccgctccgcctccacctcccccccgagctcgccattggcgcctcccccaaaaaccagctccttttcaagccgcacgccgcggcagcagctgtagagcggaggctgatcagccggccagatttaggaagctggaaggcagggtcagtcgaagccggccggtgccgcgacgcgaagggacggttcggcttcacagctgtcttgtagccctcccactggccactgtagcggcgtcagatctctctccgaatccaggcaaaggccaccactgcatgcatcgatcgatcgggtttaatacatcagcgagaaagaacagtggcactagcaacgtactccctctatttaccatatctttgcatcctcgcctgagtcctcccttcgtcacttcacttcactcgtgtgtgaattgtgattgctcagtgggaagcggggaactactacgtgactagtactagtacgtcagttggtccagcgccaaaacctcctgagggcctcttcggatggaaggattttttaaggattttcaagggaatactatatataggaaatatttcctttcctgacattcagtccataggaatcaacccaaaggaaaataagaggaaaaattcctttcatgtggaatcaatagagaaacaaaggaaaatttccatccactcgtatcttattttttccatttcctatgtttttcctctgcctatccgaacacatatttaccaatcctatctacagaatttttgtgtttttcaatcctctgttttacacatatatttctatcatattcttacgatttttctactcctacgtttttgcagtaccgtgatcctaataagccctaaagttattcctgcccatggagaagtagggatagtcgtaaaggctcgcatgtgcaaccccgaaaaggctgtgatacttgccagaagttactccctccgtcctaaaaaaagacaaaccgtgggttttcgtgccaatgtttgattgtccgtcttatatgaaaattttttataattagtatttttattgttgttatatgataaaacatgattaggggtgcagg

SEQ ID NO: 55495 - DNA, 1309 bp, Oryza sativa
tcaaagggatatccaatccatgaacaatccatccaagaaacacaacttttctcagggagaaagggctcacactccaaaggatactccaccggacataaccacatgaggctacccaaacctataggatttgcccacatatctctttgtttaggacttgataatactcaccacacttggctagacaagcccaccaaatacacctacatgcatatgaactaatatggcgcaagatcatccacatgctcgcttcatagacccctcttaatagtacgacgtctatctagcaaatccggtctacaccaaacaccaagaccgggaaaagactaagaaaacattcgtagctccattatacctttgccttgcgccatccaacttggggtcaatgcttaagccaaaatcaacacttgtgaccatccggttgaaccatgtttatgccgaggtctttaccatcctttgtcaagactttattcccatcacaagtttgacttcattcttgccaacatgacgatgtccttggcttggtgaccattaacccatggtgtcattcaatagccttatcgtagtgggacctattccttttcacatctcaacaaatcggatgtagtataagatattttagataactgtgtgtccagattcatagcaaaaagttgctatattttgggacggatgtagtataagatattttagacggatgtgatacatcctagtattagtattaggatgtgtcgcatccacataaaattctaggatgagtagaatatttatattatagtaagcatagaatttctatattgtacccctccgtaaaaaaaattcaattctaacaacgaaccgttattttctttttacggaataggacatgttagctactactcactgtagagcacatgcatattagggggtgtttagatggggctaaaactttttagcccatgtcacatcggatgtttggacgctaatttggagtattaaacctagactagtaaaaaaactaatttaataaatgagagctaatccgcgagacgaattttttaagcctaattaatccataattatcaaaagtttactgtagcatcacattgtaaaaatcatggcgtaattagactcaaaagattcgtctcgcgaattagtccaaggttatggaatgggttttgtaattagtatatgtttaatacttaaaaaagtgtccaaacatccgatgtgacagggacttggaataagtctctataaaccaaacaggaccttaatccagcagccggctcttgtatagatctagcagttactccagttcttagtgtgacaggtc

SEQ ID NO: 55496 - DNA, 2393 bp, Oryza sativa
ctcaatctagaccatcgaatgcacgatctgacggtcgtctacgccccatgaagctagcttctccacgtgcagttctccatctttcacacgacacgaaacttactccgaatcgaaaacaatactcttccatgtattttaagttctaaccaaggcacgaacagacaaaggcttttccttctcaaaagatgcaacggtcgatgcttaattaagcaatcaagcttaagcgttcggtcttgagaacggtgacacgctcgcgcgcgtggaggttaagctcgtctcgaggggagctaagcttaagccaccaaaaactgcagcaacccaagaaactcgcatggttatttgcgaatgatagtacaggacagggagtgtggcaactatgcgttgtttatttaaatcagcagagagagagagagagagagagagagattcttgttttttcatatgacatgtttcaaatttgtcacattgcccaacccatgattgtctgtgatcccttctcactcctccctcactcaccaggtgatttgaaacccatccagttttgatcaacagaaagatacatccatgctgcacttccagctcgtcttctttcttcagatgaatgtttttctggctgcaagtcttggccataccagggtctttgcagtctcccagagcagagcagaaaaacataaatgtgacatcttacaacctgctacctcgcattcaatagcttgcagattgtgccaggcacatctactagtatagattttctttttttttatctctattttcaaaaatccggcagggaacagtgactgttcagaatgaaagtgaggttcagaaagtgatttgatcagtttccaattaaaaaaaaaagagaggatactgcgagcaaaattcggaagagatataaatgtaagtgctccaataagaaacggagtgcaatccaaaaataaacaatgaacccaatgtgcattagacttatgataacaacactgcaccagcacagtgcacagctattagatttgatgctgttttcttttcaagtatttgcttatagcacaaagccagaaacagctatcagataaaatatcagaaagtggctttgcaagacataaaaaataatcaggaaagctgttgatccagccagagagcaaggaacatgatgagcataccacaatcctcgcagcagacatggctatctaaaaaatgtcagttgttaataagctttcctccaaggacttctaaattttaaaatcttctatatataactgaagattaaattgcaacgttaggtggaagccatgcttttggcaagttatagcatacaaatgttgcggtggttcacaggttgttagcaccaaactctaattttcttctgtttaaggttatgatacagtattacagtgcataacagtatgcaaactttgaacagagacggcatatgtgttgttttctgaactcgattttgttttcttcataaatggacactgcagataataaatatttaacattcatagataagatttagttcaatttacggaactttgaccatcaacgacttcccaaatgcttaatttgaaaaaaaaaaggtatacgtatatttgaaatgtacgactatcataatgacaaaaattctttatattttgtacactcaatataataaattattagattttgtaaacctattataacaaaagtagtgattacagtttttaaagttttgaattttatcctaaatatccgagaggagtacctaaaacgcctattttattttcaacggcaattaatggaatgaggggtatgtttctagatcaaaatcttgtttcaaaaaccattagttcaaggtgttctgatctcttttttttttagcagcggccacaaaattcctaacttatatcccaatgatgtgtacgtagttaatactcctttcgtctacaaatataaggaattatggattcaattttatctgcaaatcctatatttctataaagttcatcctcaccaagtgtagttaatgctatttttttctcattgagccacatcatcttaattatttctaacccttgaatgattgatctatggttcaaattatgtccctcctttccttcttctaggaaatcatatcatctttcttttgtctttggatgattattctatatcatttcccttcttttcattccgtcattgaggtatatcaccttagttttgcttttgaataatctatttatatatgatttacattgttataaaccatatcattttaattgtttataactttttttcttccatggttgatcacagatgaaaattatataaagtatataaagtgatgtcgtgtagctatatgcatgttatttatactattatcatatataactcccacagcaactcgcggggtttcattttga

SEQ ID NO: 55497 - DNA, 2204 bp, Oryza sativa
atactctatacatgtgtccaaatattcgatgtgagatggtgaaaaattttgccaggggatctaaacaggcccataattgtaggaaactgcaaactaattaaggtcactaaaggaacacaactaatgtctggccaggaaaaagggatgcaattaatgaaattaattgatgtctaaaaactctcaccatgctttgctgaataatactgtatagatttccatgtattacatgaaagtgaaactatctatgtgcaagaaacttctttacggaatattcagagcatcatctattattattatgtaacccctgctaacaaatttgacttcacaactactccctccgtttcacaatataagtcattctagcatttcccacattcatattgatgtctatatatatatatatatatatatatatataattttctatagatgctctttctatctgcattcttgatctttgggcaagtcattgcctgtacaagtgctgttgtgaatgttggcgcctgtaaaaggcccaatttttacacaacaaagggctcatgactgttggttcctgaaaaaaaagaccttttttaacaccaaaaggttgaatttttatgctctatcatgcttttatgtctgtttgcaaggaaacaattatagtaactgtttagattggtaggtttgacactgtttgatgctaaaacatattacgtgtgccgttcatatgcagggaatggggttttgagaagcttgtcttccgcaattcaattaccaaagttaggcgagatcgcaaatatgcgatccaggcccgaaacgcatactctgccggcgtacacatgtcacagaatgtctacgggaggacaacccataagacagaaagcctgatcagatactaccactatcacaattcgatcaatgtcatgggagagccttgtcgggaatttgtgccggtgccggtcaatggtagtaagttgatgttcgaggggatcccttacgtatacgatgataacatgaagcgtttggctgggcagatcaagcggtttgagaaggaagcaattggatctgctcatacataggcacatagcaactgaactactgaagactgccggtacataactacagtctacatatatacctgatgatattgtttaggatgcctggttgagagttgagacgggctcacgcttctgctgttgcaagccaccgtgtctggctggtaagcagagggaagagcttgcaagtgggttggtccaagtggtgtaaagttttggttctttttattgacatgccattctctacaggagcactgctgtttttgctccattttctcctttctcttttctccttacccccacatctgttattatagatctgtgtaaactgtaaacttatggccctgcctttttacagtagattctttgatagatctccctccggggttacatgcagtgtttgttgttttgtgtgtaaatctggattgcacattactcttctgtactatccattaggccatcagcaatgggtaccttcgacccgtcccctcacaaacggccgtttccctcccgtcctcttttcggcgtgagccgtctccccagctaggagcgcgtctactccttgggagacgcggctctatgcaaggagcgctcgcttttcgcggagagccggccctcgcccctgcgaggagacccgctgcgaactcccgtctcctcaccgctccccccaaatccccttcctaccctcgccccctcgcctctctcccacggcggcgcccactcgtcgatccgctccaccggccgccatcgaccggcgggcggggaggtccgcgacggcagggaggagctcggcggccttgaagaggaggagggcgagccagtcgtcggcgaggcggcgctgggcggaggtgccgggggcggcagagtcgagggcggagtcgatgtgggagaagagggtgtgggagatggcgatgtggatgaggaagaggagggagagcgggaggacgaaggtggcggcgatgcgggcgaagagagggcggtcggcgacgatgatgatgagcttcgtcggcgacggctggagggagagaggggagcgggaggagggcgaccggcgctgacctcgccggcgagccgccgccgtcgctgccgaagcccagatccggcaagcccaggccggatctggccacctcgccgccactccgacgacgacgaccctgcggggctgcagga

SEQ ID NO: 55498 - DNA, 1222 bp, Oryza sativa
aattgtacagtgctaatggagacttaactaacggcgatggtaaatcatagaagttaaacaaaaagtgatgatatattatggaattaaacaaagtcagtggcagattgttgaactagactaaagtcagtggtgtatagtagattctctctacaatcccgttgaatttctgagaaaaaaaatgtttcgctccaaataaagccgggctccttatggtttgtggagatgatccgctctctgtttaagcatcttcgtacaatgaagagggattagaacccaattgaaaacatgatcaaacatcaattgacgggtgattgatcaattcaattccaagagtccaaacagataattcgagtgctgagctataattgcaaacatacttttccgatgtgcagacgataattaagtcacactgtgcactcaaactgtactccctccatttaaaaaaacgaatctattattatatgacaccacataatacaacagatttaaacaaatatatattacatatattattaggttgattttttttagagttaattgtatattggaccactaatatttaccttggttgcacattggactagaggtaaatctatcttttcacattgggcctgctaaatctacaatagttatatattgaaccggtattcttctccaactctcttctccgttgagttgaattgtacccaatttgtaaagtctccatacctgtcatctagctcaaggtcgctaccacaaatgagcaaggctctgggagaccaggaccttgagtgagctgctgccggctggcgatcaagcccctgccctacgctgcatcaagctcgaccttgcactggagctacattgagcgttgcctcgtactcgagctcactattggcggtgagcagaccatccagatcgcgccaccaatctagcttgacctcctccgatccctgcctgcgcactggagctcaagtttgagctcgaccttcgtcagctctggccactcggtcgatctcgctcgcacccatccctgcatcaagctcaaccctcctggtcctgcaatctctcaagctaaacctccatccacaagctgttgcaagggagaagttgatggtgagtagctacgattaggttgagtaagcgttgcctgagctccttcgtagatatccgtcccaaaaagactcaattcttgggtttccgtgttcaatgtttgaccgtccgtcttatgggctgcaggaat

SEQ ID NO: 55499 - DNA, 870 bp, Oryza sativa
catcctgctaagagtagcatggcatgagaacaaaacaatgccacttgtttcaagaaaatacgcaaatcacctacctgaaagacagataacaaaaggaaaaggagtacatgcaagttatgttgtagtaataaaaagaaactaccttttactgccaactgccagcaatctacaagaaccagagagccatgcggtgatgcaacaatgaattatgcctccttggaacgcgaaaacctcagagaaatttcgacatcccagcattccaaacaagaccatgcatcacaaaggcatggaaacacaagcacagagacaaggaaccaacactcattcctgtcaataaactggtaatccagtaaaaagaaaaaaaaaaggctctatatgtctatcaacatcgcacaataaagtcagctcatttggagatccgttctgttacagattacgttgtaaaacttgcttacattacaagtgagggctatggcttttgaaaggaaggacgcaagagtatgttacatactttacactatctataagaacgacaacgaagatgcgggacagagaatttgaggagatcctcccctcaccatccctatcgctcgcttcccttggatcagccaggacagagactacaacggacgaaactggcttacgaccagcatggctctgactatggttcttggggggtgctttgaaatgatccgtgtcattggatgtcgaacctcgtaaagggatggcttctgagtacgaaatccttctgttcttcaccttctgaacagggccagaaggaagattttcagtataattttgtgacgtgttagtcactgacccagagtagacaggcacaatgccatttgcatcagctgttgttggagataa

SEQ ID NO: 55500 - DNA, 5348 bp, Oryza sativa
  unsure (1)..(5348): unsure at all n locations
ttgtgccatatgctccataaacaggacatgtgtaatggaagaatttcagcaaacaaagggaaatacctacttgtgatggttatacatgtaaggttgaattcaactatacagaggcagctaaggatataatcaattcattcgatcagtgactttttgtccagaggaagtttataaggtcaaactaagagtaaattgcattggtagtacacaaacttgttaggtgggtgcaatttagtacataaacttgtgaaatgcttgtttcgatacacaaacttgtctagttcgtgcgaatgaggaccaaaatagcttggcaatgttaattttacgaagctaatgttgattaggatgtgacgtgcatacgtgtagtgagtgtacataagacatgcaatatttataaatgtggtctctactttatccttcatcatgaaagtgatgaatttcatatatttctaacccttatatcattgtttgttttttttatctttttctacgatcactatatccattctatttttattgaagaggtgtatgtctaatagcaaaccttctcagatatatgtttacataatttcctaatgagcccctaaattaataagattagccatgttgtgtcctttttgccttcctccgcatgcaccagacaaattcaagcaccaaaacgagcattttacaagttcgtgtaccggcaatgcaatttactcgtcaaactaatgtacataaatagtatactgtacaatagtaaattaaatatcataaaatatacagaattagcagtaattcagaacataacattccagtcaacaaaatatatgcattgagcagttaattatatatgctgcaatggtaccttctccaatagcataccgcaacggaaaaaactacaacattgagcttttcacaatggtgactaaacaatgaaccactgacccaaaagtctatgatcgcctcctatgtatcatggtatattggtaatcatccacccgagtggcatactaaacccacaataagtttacaactttaccacggcaaaagaacatgtaatatatgcagatatcttctacttccagcactgaataagcactacattcatctattaagatcgctagctctagcagatagtaagtgttatactccaaacaattcatcgcactaagtgccacattgtcctacaaacaccaacaaggcatatacagtattgttcatttaaattaaatagggtgtgcgtgcgacattatgcagcattcttacctgacattgcttcactaaaccactgcggcagcatcccatcatcctccctgtatatgcttccatctccaggagccagagccatcagttcattcattcctttagcagaatccatgacttctccagcttctaacggagctacatagccagggattgctaagctagtctcctcctttccttggtttccagaacccttctcgccatagttagacaaacgggaagaggctttctcactcgcaacaatggacttaataaccagatttccattgatcttcacatgcttcccattcctcggcaaatataacaaagctggcagcgtttcgcttccattctgaggtaccttcggatcaacaccatttgagacactattttgtggcccttcaacagccagaattctcccatgatgtgacggaacaatcgcagcgccttccccagtgtacgctgcaccatacatccgatttaccgcaggaaccaaacacccgcagaccatcatcaagaacagcaatccaagcaggctaacacctgcaaccttcttggtcttccgggccttcttggccggtggctccggtgtggacgcaggctgctgcgtcttgagccggggtatcggcacaagcggcacctgcgagccacgcattgcgtaggctgggtggatccatggcatcggcaatgggtaaaccgcagggtacatgggcattggcggcggtggcgcggcggcaccagcaccggcggcgccacccaattgctgcttgagggcggcgttctcggccgtgacgcaggagatcctggcggtgaggtcggcgatggtggcctgcatcaccttcaccttcccctccagctcctccacgtactgcttcttcctctgccgcgactggtgcgcgctctcccggttgcgcaccagccgcgcgcgccgcttcgcctcatcatccttcccatccttgccgccgccgccgtcactcccgctcctcgacggcgacgacgaatccgcggactcctcgttcttggaacccccgtcgccggccgacgacgtccccgcttccggcgatccggcggccgaggacgacgacgacgtcgtcaccggcggcggcgcatccggcgggaagagatccacatcgaagtcgaagtccagatcgtcgagatcgaaatcctccagcgcgaaggcgtcatccccgagggtcgggaagtcggggaaatcgtcgccgggggggaaggggaggtcggcgaagggcgcgagtaggtccggctccgccatggatcccggtcaccggcggcgcatacgcggcggcggcggcgatggaggtggatgggatcacggacgcggtggtggttgcggaagcgtgagggctctgcaatggaaaagagagcgaaggtgcgtgatttggtcgtagtcctcgcgattttaggtcgccgcggagacgaagctgctccacgcgtctcgaaccttctctgggcctagttgggcctcaaacatcgggccgattttgcggatgggcctagttattgagcctgatgatagagagagggggggggggggacagatggaaggctaattcggtttataggattcccaaatcaaaggtacagggaaggtaaagaattaggatgttagatgcatcttatttcttaggaatttttctaagaggtcttatctcatgataataagaatcatatggaataagcttgtaaggctataatccttaggtatttgataggattttataggaatggaaggaatgaggcatataggaaaaaaatcctaatgtttgaattcctacaataatcctataaaaatcctttaaaccgaatgagcccgaaagagagagagatgatgaagaagatgaggtgacatgaaagtcgctgacacgtggatcccatctactgacttagcaagttaaaccgtggtcaaactgtcatgtcagtagaaaccacttccaaaacgatcgaaggagttgattttcactactttccgaagacaaaaaaagccttccgggagcggcgctatatccggttttgcagttgagggagacgatttacaggagcaagagatgagggagacgaaacagacttatttgcctctactagaacagcagcttaggcccaaacagcggagcgagaccagtcatggcggcgacactcgcaggccgccgcctcctcctgcagcgatccgcggcggcggcgggggggaggtggcggctgctggggacggcggcggaggcgtcctcctctccgggagggagggaagaggcgggcgggggagggggagatgagatctacctgaagaagccggcggcggcggcggcggtaacgacgcgggacgagacgtcggtggcgatgccgatgtcgttcatgacggggtcggtggtggggaagcggttctaccgggaggccaccgtgcggcgcgccgacgacggcaacgggtggtcggtgatgctcgactaccgcaccctcaagtcgccggcgaagcggccgctcaagctgcagtcgcggacgctcgccatggccatcgccgccgagtgggagtaccaggtcatgatccccatcttctgtttgattggccctcgattggttatgctgctcaactgtagtgtaagattactcaaattcggatggaagatggtaaatcaaatgattcgaaatggaaattgggtgactagtagcgcttaggtcgatcttaatcttgtaagttcagtttaacccagaactgtaatgagttgcggaaggattttgtgcaatttaaatctattcaatcagtgaatctcgcttgccatagtgtactattcagtggcagtggcatcgatgatttagatcgtgcaattagaggtggttttggcattacatttcttttctttctccctgttgcggctagagcagctagaataactacaaatattgttcagctttaaagaatagtttccgtttcatattgtaagactttctagcattgtctatactcatatagatgttaatgaatccagacacatatacatacctagattcattaacatctatatgaatgtgggaaatgctagaaagtcttacattgtgaaacgggggaagtagcaaagaagatgaccaggactcctaattaattcggatactggtattatagagttattgtttcagtaggatatgaagaatgcagcatttagagttattttgttgtctggttcttatcttatcatccctataatagtactaccacaagatggactgtattcaaatttatcaggttgattccagcagctaagtaaaagcaaacttcataaggcaattgcgcctttgcatttgcatcacatattcacatggcaacccttaaaatgtatgtatgtctgtacttatatgttgcggtgggtaaacttaggaagtagtcagctgctctatacttccatattgcatatgtgaattaaaagatctgtcatgtcataagtaatcggttttgtttgttctttggttatattagcatcacgggtgtgcatccaattaatattgattactgccttcaactgtaacatatgttcatggctgaattgctgcaatcaaacatcatctattttacaagtgacaggagatgttacaacgaattctgtttacttgatgtgcttctcatctacacagcccagaattatatttgaatttaacttctttgcaagtctcttctttatgtatttgattttctagtttcttatgtaacatatactgataccaaactttcttgacatcataggaagcagatggaatccggccttttacaatgcctcttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55501 - DNA, 3470 bp, Oryza sativa
ttttcctttccgcttgttcatttgtgcattatctcaatatgttttcttcttttacttgttttactgcagagatattagcggcagcacataaaggctcaaatgggatcaacctcttcactgacgagtgtgataagactgaatcattccttccatttggctctgggagtcgagcatgtgttgggcagaagtttgcggttcttgggatcgcaatgttgattgcttctctgcttcgcagttacgaggttagatgtgataattttttctgtatcttggcatggccatgtgaagagacacggccacgaactctgttatttattaccctaaaaaaactgttatttatttctattcactatgagctcagcgagtttctttagaacaattcctgactaaattatggttacaccccccttgagttataaaatttggcccttattaaggttgtattctaaacttgtgatgttgcttggaattcgaacctgcaggtacaacctcatccagctttatcccaagaaatggaatcattagttgacagcaacagccttcaccatattccgaacccaaagatcatcctcaagaaaaggagcatctgaagcagcaccttgacaaattaaagcttgacgcatttacccttgattacaatatatgttttttactggtggcatgccaggatatggtctctgttttttttcagaagcaatatggtctccaagcttgctttctttccatcgcagaaaccgcgacgtggatggttttttcctccagatttttaacggccccagtgagcttttctagacctagtttccattaattagcgttttgaggcacttgtgggcggttaaatcacaggaggtgtgtaccgatgtgcataaaccaatagtagcttcttcttttttcttttttttttccggttggtgttttcttctccttctggaggaatgtaatgttttatgatgcactgtatggctgtatcgtgcgcgggagcgcagaatctgttactgagtttagtgtaccatgtacctatatatatggtcacattgtattattgttgattgtttcttccaccgtaactggtgaagtttctcaaaaagaacattggaatttgtattgcctggtttgtggacaaaacatcaacaaaaaaaagagagaagaaaaaacctggtgactttgagtagtacgttatcgaattatgatattttaccatcgtcgtcgtctcatagtagtataccgtagtggtagtatactactagtagtgtgagtgtgtattattttacagagagtccgtgcttggattgcataggcgctgtttttggcttcgtctcgagctgcattgcctgcatcctcttcaaatcttcagagatgagagaggcaacggcgcagagcagccaagcatggacggagccagtcggtggtgtatacgtccaagtgtccaagccgaaagctgcctcaccatctccctatactgctttgattttttgtttttggttaattgtttgtttttgggatgcaagtcatgcaacctgcactgtggcagtggcagtggctagcaggcgagtgtgccgctagcgcgcacttcccacttaactatctctattagttaacattaataacagtaattaggaatttttttaaagattttatcttttttttagatttttttattaacagattgacaaaaatttaaactaaatttgaaacttttgatttaagattcaaattttaaagtcaaattttgaaaacttttaactcagatttgaaactttcaacttgacaagttgatattcgaaaactttaaagtccaggtttgaaaattttgaaaactttcagcttaagatttgaaaatttttaactcgagattcgaaaactttcaactcgagatttgaaaactttcaagttcagatttgaaaattttgaaaactttcaacttgagatttaaaaatttttaactcgaggtttgaaaactttcaactcgagatttgaaaactttcaagaccaaatctgaaaatttttaagttaagatttaaaaattactagtaaactaattatgattttttctcctacccgtgcgacatcgaactgtgaaaaaaaaaggaagaaacatggcggtagcaaatgggggatttacaattatgacactgcaaacattaactgcgccaaaaaaaaaagagaaaaagaaacacgtgtgtgggccggaagtacgcgttgacggcgcatacgcgggaattaggaattctgctggcggtccggcctgcacggtgagttaccacgttggctgttgatcgagagattctccggtcagaattttctctgagaaaaagaaatctgaggatgcccggcccaatatatggggcccaaaacaagcgagcttttatgggccgtgacgagtagccatcggcccatctccgctttcccttgttgaggtcaggaggccgtggcccgtgtgtgcgacatggtcgcacttccagccccatcttttgcttatcagccaaaatttaaatttttaacatttaatttagagttggttttgggatttttttcacctaagtttattttttagcctctacttttggatcgttaagaatacgtatataaaagttgtattcacaaattattttttttatgtaaatatatgaataagccaaacgatgaagcctctcccctcgcccatctcccgacggtcgtctcctccttcctcttaggctcgtcggtcgccaatccccccatctcccgccgcgcgcccgccgccgctccgcccgtcaccaccctgcccggcgtctaccacgctaagatttccgaactacggtatggtacgccgccgctcgcctgtggttactctactcatcttctcgctttcatatactattgtcggttatttttgagtatcctttctcctgcctcctccgaggagaaagtgtgctatttccaggggcagattgtcggatcggcggcgactattggaaccaagaaaatttgggaatatttgggagcccttgggcatatcattattctagtcggactctcaatgctcatgtcccccccacaaaagggcagccgaacctttgtcatgaacaacaaacacgagcattgggtttcttggcttcctaggcgcataaagggctcttaacttcgttgctgcataaaagagtcaggtcgtaagctttgggctttcaacatagcagcttcgctgcagaaggcaagtcagattccacatggagatagataatggacacacctttgtaagttcttggtttcaattataagtactacatccgttttttaatagatgacgccgttaactttttctcacatgtttgaccattcgtcttattaaaaaattttatgcaaatgtataagatataaatcacacttaaagtactatgagtgataaaacaacccataataaaataaattataattacgtaaattttttgaataagacgaacggtcaaacatgtaagaaaaagtcaacggcg

SEQ ID NO: 55502 - DNA, 2376 bp, Oryza sativa
tcaccaaagcagctacgagtttgctatctgtgccacagagagacacctccatcagaaacctatgcctcaaactctacatgatgggcagccactcaagcaatataggatcagtattaagtcaagcaattgaagctgggatagtaaaagaattggaccttgctgttttgcacgagaagagacatatagattgcaatgacgatgatatgcttcatcaagccagagctgtgaaggtctttgctggtgcttttcctcgtgtgatttgttgcatcacaaggctctctctgtacaatgtgcacctcgatggagacattcatcgtattcttttcgattgttgcactcagttggactatctgaatctcgagcattgcgatgatgggagccgcgatgtttggaagataaatgcgccaaattcaaagctccggcatttggagcttgcagtgtgcttctttgggaggctcgatttagtctgcctcccaaaactcgagtacatttactgggaaatttggttcactccttatgcccccttgtcattcggctcagtcccaagccttagggaattacgtctcgcatgtcctgcccaatctgacttccaaggcttgaagttaagcaaagttttacaaggtgtcccgaacttgcatactttgacaatagatttccaaggagaaaaggtaattgcataatcatttgttatgatctgcttttctattattggtacaactgttacgttgcggcatgttactcagaatgaggatctagcactaaaatgctgtgatagtttcagctggctcagttcaaccacttaggtgtatttaccttcaatttaaaaatgagaaaacctgtgaggtggtcaagtgtgcaaccacaccctcctaaattttggtttaacccctcttttgcttgtaattgcccgcaaggattttattatttaggagtaatcttgtttgtgcaatggattcatatatatttggcaatcactcacgtgcttcatttctgccttttgttttttcagttatggatgcaacctgaacaaaaacagctctgccctgcattcaacaatctaaagaagttatctattctttgcattcatgttgaatttgacctgttatggactataaacctccttgaagctgcaccatccgttgagctcctttgtattgatgtaagtttcctttttttttaatagagcgcaacaatagcatatgacagtaactgcaactggactatcattatgtgcacaaattaacataaccaagtgctcatactaaatgtagacctgggaacatgtatgcttggtaaacaaagaggatgaagatggaagaaagcttgttcatggagaaacaacacatccttcatgggagatatctgagttcactggcaccagaaattggcaattgaaagaactccagttcactggctttaggccactcaagcaacaattggtctttttaaaggccatcatggagcaagctcgcaacctgcagactgttattctgaaagaggaagaaccatgcgaggactgtgaggcattaggcacgcctctttcttgtataaaagatcatgacttcccaaagtcgaaggatgagcaagacaatgtagtcgagcagctcagagagaagatttcttcggattcgcaaataattttccagtgtttgtaacatccccttcccaaattattttcctatagttttggaaaatgaatatatcctatgtacatccccgtgtacttgctacttgcaacggaggagttgtttgtcactgaataaatatctggaatttctattttagcttcatcctgatatccaaatacgtgtggaagtagttcaatgccatacgtactggtagcattaagaagaaccattgtaaatctaaccaaagatattactacctccgtcccaaaataagtgcagctgtaaatattcgtgctcaacgtttgaccgtccgtcttatttaaaaaatttgtgaaaaatttgaaaacatttagtcacacataaagtactattcatgttttatcatctaatagcaataaaaatactaatcataaaaaattttgagtaaggtgtattggcgatccttaaacttgtagggttatatcatatagttccctaaactctcaaaatgcatatccagatcctagaacttgtcaaagtgtatcatctgggtcccaaattaactcatcccctctaggatcctacgtgacgctgatgtggcaatgccacatggacgtgacgtgtccttttctctttttttcttcttttctttttagttttcttctcattcttttttttccttttttctgtacggtccacagcgaaaggagaagaaaggggaaaaaaaagaggaaaaaaagaaaaagaaaaaaattaaatgggtcccatt

SEQ ID NO: 55503 - DNA, 8535 bp, Oryza sativa
taaaatcacaaagtaaaatgatgttgaataattaaatttgttaggatgaaaaccttattattgcacgaacaataatttcatcacatccttataagttttcacaggttagtaatacaaacagccaaaaaattcaagaatagaatggcacaataggtctcttagggcacgttcaacggttgagcccgccatggactcttgaataggctatgtcagagaaaaacaatagttctacaaaggctggctttccgatcgtctctccactaatatgcagtaattaaatttttgtagcaatggtgtcgtgattttctgcattttggatctaaatacgtgacttttcttgaagatggactatacaacggccattggttatctcgtctgctcgtgtttttctcattgtgagccgatgtcaggccgattgcatgcaaaacatcgatgcatctccattcttttttctctctcttccacatcatcaaatctgcttccatggcaataaagagagcccactaattaatacctttgtacatgccctagtacctcctggccctcttccatagatcctgcacgcacaaataaatgaagaataactgtgcagtaatgcaggaagtaaattaagctgaatcaagttgtatagatgagataggtttatttaaaccatcaagattaatatttgtagcatcatggttgcatgatcttccaaattcaacctgtagcttcgatcgaaaccaaacctgtacaaatggtcttcccagttaaagaaatttcaggctgtgctacttatttcaaactgaaaatttccaacctttgaaaaatatactaatttaaatgagacaaccgatttaagtggttcatagctagaaacaccataccttgatttttcctaataattatgtaatagactaatagttaacagattgagccacaaaactctattgtaataaattgctagattccccaaatttaatcactaagtgcattagttacttgtaacggactcaatttcaggggaaaaatttttacgaaatattttagttgcactcttctcaattcttcttttgaagtgatcttgccttctcttaatttcttttaacttggatttagactttatttgcaaagttaatcgcgctcttttaaattttgcaaaacatttctattattttctttaatctctaactttggctctagattatttttcctttgaatccattcccgaacatctccaacaaatactatttcaattcccactcaaccatctctagagtacaggaaaagttgatacctttcctttggacccccaaatatttcccctttgaaatctcgttcatctaaattatccattcaagattttaaagtctactatttagcttgggccaataattcccgattgacccgactctttgttatattccattaaccattttatccttgggactaaaccagtataatttcctttttgctggaatttattctagatcaaacccttgatctagacctatctttagaaatccttgttctctttcatacaacaccttccacaaactcctctagatgttccacttcttctatctataaattaaaccgccagtttgattcccaaggtttgattctttctagcacaagaataatatttccagaataattgttcttgtgctaacaaaccttttcaatccctcctattcaaaaggtccaaaactcctttaaaacctatttaaaaccctcccgtcaaaattcccttagttttcaattccttaaattctatttaaatttcttgtccaaaattcaaaaggttcacaaatatcttcctttataatttttcccctttgaattctagtcaaattcaaaaagtccacaaacatttcttcctatagatttcatctcctttgaattccattcaaaatcctctacacaaaaattccaaaggtttctattcaaatcgggctgaaattcctttttcttctcccctcagcccatctccctcctcagcccaagcgacccagccccagctgagccgcctccttcctcttccctgtgggcctgccgccgccgccgtctgcaaccacagcgtcgtcgccgtctcgccccttccagatgtgccgccgccgacgccgtgctcctcttctccacgccaccgtcaccgtggccaagtcgccgactgccttcgcaaccgtcattcgccaccgcctctcaccgcctatataagaagacgaaccccctccattttccacacaccaatcgagctcttcgagctctgcctctctctctctctcctgccatgtccggctgccacctaccgtcggccgatctccctcaccggaattccactaattaaatccttgcgccatcgggtttgcctcgacgaggtgaactcattttcctagtttccccttcctttacccttccgaaaccaaccaccacagccacctcctcttgttgccagagctatactcttgcctgcgccgttccggccatctccttcactccctttgccaaccaccgacttccccggatgcgcatcgttcgggaacaccatcctctaccggcgcagtcatatcttagccaccacagcatcggcgcccttcctctcctcctctcggttccctggctaacagagaggaagaaaacgaagcaaggagagaagaaccggaggaagaagagacatatgacatgtgggccccacttctataaagtaaatctttttcctttaatttccatttcaatcttcaagcacccatgtctctccaaccacagatcccatcccagtgagaccttgacctaaattcttctaatttcaaactcttttgttttgatatcaaattcctattttaaaattttatttaaatttctttatttgaatacctttttaatttaaacctatttgatttatcttaaatacctttaattttaaatttcttattttatttaaaaaccttttccttatttatttatttatttatttactttctaattttaaattattttaattaacctttaaaaattattttacatccctttaattttaaatttcttgttttatttaaaaaccttttttaaattttaattatcctttagtttctttaaatacccttttctttaccattttaaattttatttatttaatctatttaaaacccctttttaatttaaattcctttgatttatttaaataccctttttatttctaaatcattcccataccatcccttagccactaaaaatccgccgatagaactttacgccttccatggagacgttcgtgtggtctcaaaccccgacgtcaaaccgttggtcgtaaatcctggcataacctaatcctaaggtcgaagtgttgctcttcgcaccctacgcctcaacgcgtacagtggtcagagcctcactactccctcgacctctacagcatgccacacactagctttcggattctgtgcgatccaagccgctctgctgccactcacggctgtagggtaacactttccacccacaaacctacataaaccctcccaactctctagtcgttgtgccacttgattgtagcatcgactagatgggccgatatttagccgttatgccttaacatcggctaaccactccaaatatctagccgttgtgctgcgttactctaggaccgactagaaaaccaaatccaccaaataaaccctacctatccattctatcctttctttgtttttatttgattcccaacctatagaaaccaaaaacctctcttttgttttcaaattaaaatttattttgaactcattcctttttcctctcgcctcgctccaattttatttattccttggctttatcatttctttgtagcaatttgcttataggctttatttgttatcttttcgtattcgtacattagaccgtacagtaagttttatcagtaacttggataaggaaatccgtctctttgatggtgtcatcagtgagtcacgtggtttaaagaggtcggtggttgctgtaaggagggattctttcatagatttgaagttcgaagtgggcgcgtttccatccagtttcgaccagcattatgtttccttcaaggagaaaatccatggctatgatactcaagaaataaagactgattttgcgttaatctcagtaaaggtgacttggtcggctttgctttctggactagagtgatacctctgtttctgtaacagagtgggccaagagtggctaaaaacctgcggcttactaaacctaggtgcggcaaacttggatagtaaagtattgtaataaatctgtcattgtaattaagccctccgtccctgaaaaaaagtacttttagtaatgcatctgaataagtgtttgttgagatgcatagtcggtcaatctctccgtccctgaaaaactgaacaagaacttttagacatgcataattagtttcgtctctgtattattacttcagcactaggggttgtattaattatatggaggaatcttcaaggcacaaccgtagagtggcttctctgtgatttctgcatttctgaatcgtatgttttgtggttatagttatggttttggtactagtgcatacacgtaagttctcattttatcacaacttttgcgacactatggatgtgcaaagtttcaaaaattttcagaacatttgtgccattttcacatatgactagcttattaagtcgcgcgttcgcgcgactataacctttctttctatttaaatgtgtggatacgttgtttaattagtttaaataagtgtctgtgaaacatactttgcaataattgcagctataagggaacaaatttatcttgatctttttcatgaatagcattattataaaaataaattacttacatttatgaatgtgtcatttgtaatattgcaagtagacttgtaatatgaaatgtcagcccttctttcggcttaacaaaatagtaacatgtactctgtaatggctagggttaaaaacttaaggtttctattcatcttcgccattgtttcgctctcactatgtgtgcaatcataagctctctttctgttgcgcctatcatctaggcaccatattcgctgatgcactaccccatcctcctcttatgcatttcattcatcctcttgtttagcaaatttaatttaattttaaagtaaattgcgttgacggtacaataacttggcaggtgggtgcgattaggtgtaaaaacttgaaaatacactgtccagcgtagcggtacaataacttggctaggtgggtgcgcccatagtgcataagttgccacgtaaacaaaaattgccatgttaccattccaccttatcacaattgccgcatcggctttgacacgaaagacctatctcattttatagaaaaccacttaatatcatttcttgacgtacacatatctcctttcatctttcttaacgtgatcttgaggtggttgcgctggtggcggtggcgacgcagcggcggtgttcaagccctaaaccagtaaccaaaccaattcaagtgtcgacgtgatcgctgcaagctttgggatggctccgactcggcgagtttttggagcatctgctccttgttttggtaaatcacttgctgatggttgtagatttctatttcttgttcaattgatggatggtcgcaaagacatcagccaacactgagaagtggcacttcgtcagtcccaaaatagctcaccagatttgctaacccctgcaacccttgcagcttgttcttcagaataagctcctagaaaaagcaaaaatcagatacaagataaaataaaagtgcaggtaatttgtcgtagcttcaaagtcatgctagtgctagtacagatgaggccgctgcaacagctgatttgagtcccaccgagggcacgaccaccatcgcttgctctgaaaccttatgagtgatgatcgtcgccgccaactgcgagcccaaaccgtcgcggactatagtagtgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacagttggcgcgccaggtaggggttgcgtcaagcttttcgccgatcagtgcaatgggtcccgtcaccggcatcgacgacctcgtcttcccacccgggcaggcgtttcggttcggcagcctcgacttcatcaccagcaacttcggcaagatttctctccttgactcggaatcgaaccagtcgggagagaaccggatctcagtcccgtttggattcccaaacgcggctgaaacctacttcaagaccatctcactcgagtcggcttcaaaccactcggccgagatcgcatcttctccaacgacaccagatcaagatgatggggcttacccaccagtcctgatgaagctccccgacgatttagcggccgtcttcaccacaacagcgtcttcatcccgtaggcctaggcggaagtcagcttcaacaccgatttcgcctagcttcagggaagtcggcgtcatcctccaaccactcggcacggtttcgacggatcagctagatgactacaacagctctcccaccgtcgactcgcgccccaccgacatcgtggagtacgatgagtttagctctcgctaccacgacccagatctcgacgacttcgacggaagcctagatgacaactacacccctctctactttggcgttttcatggccaataacgagacggaggagcaacgccaagcccgggagactgaagaacgtcgccgactggaggaggagcgtcaagcacaagaacaagaacggctacggcgtgagcagcaggaccgtgagcggatcgccaaggaagctgaagatcgacgtcagcgagctttggaagcagggcgccgagcgcgtgatctcatcggccaacaagacgtcgaagggacgccggttttccgcacccctcagcagaatgcggttgccgcgatcaccctactcgacaccctcctcaaccaaaacgagctcaatcgatccgaccacgtcgtcaacatcttgaaccagaccaagaccatgattgcggcctcggttccagttaactctgaaagcgtccacacgccgactggtagccgagttccacacttccggtctcaagactaccgtcatccaagcctcagcatcaccggcgcaggatccaatcgcaggagcaggggtcacgacgagcggtctgttcactcacctcccgaccttcatagggagcgccgagtggaacggcctcgctcaccacctcgtcgccgccccatcgatcttcgcgatacaatcatacagcgccgagcagctcgaggctaccatcactcgctggaccgccacgacgacgaccttgacggagtagcagccttcaccgacgacctgcgtcgagtggattggccagccggcttcaaaccgactggaatcgagaagtacgacggtaccactaacccagaatcgtggcttaccgtctacggtctcgcaatccgcgcagcaggaggtgacaataaggccatggcgaactatttaccagtggctttagcggattccgcccgatcttggctccatggactgccccgtggtacgatcggatcttgggccgaattacgcgaccacttcatcgccaacttccaaggcaccttcgagcgtcccggcacacaatatgatctctacaacgtcattcagaaatccggagaatcccttcgggagtatatccgacgattttctgaacaacgtaacaagatctccgacatctccgacgacgtcatcatcgccgcattcaccaaagggattcgccacgaagaattggtcggcaaatttgggcgcaaacctcccagaacagtcaagctcatgttcgaaaaagccaacgagtacgccaaagccgaagacgccgttaccgcatcgaagcagtcgggtcccagttggaagccgaaaaatacgccggctacgggaggaggtggaagtaacaatcataaggaccgcaagcgtaagcctgaggaacttgttgcaaccgccgctcattcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgca

SEQ ID NO: 55504 - DNA, 2512 bp, Oryza sativa
atcccaggattatctgcaactccactcggccagatcactcttccggtcacttttggcactcgggaaaacttccgcacagagaatatcagctttgaagttgccgatttcgagacagcataccacgccatactcggacgcccggcgttagccaagttcatggccgtcccgcactacacgtacatgatgatgaagatgcctggtccccgaggagtcctatccctacggagcgacattaagcaagccgtcacatgcgacaaggagagttgcgacatggcccaaactcgcgagatggcgtctgcccgagaggaaatccgactggctgcaaccacggtgagcgaaggagaagtgcccaccgccaagatttcaaaaagtggggaaaccgaagccaagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgtcgatttgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattacactgatctcaacaaatcatgccctaaagatccttgcgggttgcctcgcattgaccaggtagttgactcaaccgctggctgcgagcttctcagttttctggattgctactcggggtatcatcagatccgactgaaggaatccgactgcttgaaaacttcattcatcacgccttttggggcatactgctacgtcaccatgccgtttggattaaaaaatgcaggagcaacttatcaacgtatgattcagagatgcttctcaacacaaatcggccgcaacgttgaagcctatgtggatgatgtagtcgtcaagaccaagcaaaaggatgatctgatctcggatctagaagaaacctttgcgagcatccgtgctttcaggatgaaattaaaccctgaaaagtgcaccttcggagtaccgtcagggaagctgcttggctttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtgaggaagaaggccatgtccagaaagttcagcgaccaatctacttcgtcagcgaggtcctcgccgactccaaaacaaggtatcctcaggttcagaagctgttatatggtattttaattactaccaggaagctgtctcattattttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgctagctgattttgtcgccgagtggaccgagtgccaagaggatacccccgcggagaaaatagagcactggaccatgcatttcgacgggtcaaaaaggctttcgggcactggagctggagtggttttaatttccccgactggagaaagactaagttatgtgctttggatacatttttcggcgtcccacaacgtcgccgagtatgaagccctccttcatgggctacggattgcaatttccctagggataaagcgtttaatagttcgaggcgattcacagctggttgttaaccaagttatgaaagagtggtcctgcattgacgacaacatgatggcatatcgacaagaggtacgcaaactggaggataagttcgatggactcgagctcagtcatgttcttcgacacaacaatgaagccgccgacagacttgccaattttggatccaaacgtgaggcggcgccctcagacgttttcgtcgaacacctttatacaccgaccgtgcctcataaagatactactcaagatgcggacactcatgacatagccatggttgaagccgactggcgagagcccttcatacgatttttaacttctcaagagctccctcaagataaagatgaagccgagcggatttcaaggcggagcaaactttatgttatgcacgaatctgagttatacaaga

SEQ ID NO: 55505 - DNA, 14373 bp, Oryza sativa
cccattgtcggcaaagcttatcggcagggttttttctggcctactgcagtatccgacgctgacaaaattgtgcgcacatgtgaaggttgccaatttttcgccagacaaattcatctaccagctcaagagttgcaaactatcccgctgtcttggccgtttgcggtttgggggctcgatatggtcggcccgtttaaaaaggcagtcggcggttacacgcatctctttgtggccattgataaattttccaagtggattgaagctaagcctgttgtcacgattacagcagataatgctcgtgatttcttcatcaacattgtgcacagattcggagtacccaatcgcatcatcaccgataatggcacacaattcaccggcggagttttcaaagacttttgtgaagactttggaatcaagatttgctacgcctcagtggcacaccccatgagcaatggacaggtggagcgagccaatggcatgatacttcaagggattaaagcacgtgtttttgaccggctaaaaccctatgccggcaaatgggtgcaacaattgccatcagtactttggtctttgcgaactacacccagtcgggccacaggccagtcaccttttttccttgtctatggggcagaagcaatgttgccgagtgaggttgaatttgagtctttgtgctttcgaaatttccgtgaagaacgctacgaagaggaccgagtggatgacttgcaccgattggaagaagcccgcgaagcagctttaattcagtcagctcggtacttacaagggttgcgacgttatcataatcgcaatgttcgatctcgtgcctttctagtcggcgacctggttttacggaaaatccaagccacacgagatcggcacaagttatctcctctatgggaagggccattcattatctctgaagttacccggccaggttcatatcgactcaagcgcgaagacggcactctcgttgacaactcttggaacattgaacatcttcgtcgtttctacgcttaacttcatcattgtatttccctattttgactgtcaacatcaagttttcttcttgccgttgtcagtcgggggctatcatcataataatggagtatgattttttatcaattcagtttgcttacttggtttatcattgccttgtttggtttttctacttagtttgcgaggactgaaagtttttaatagcttctttgggttttaggctcaaccaagcttagcaaaaacttttaagaaatcaaaaacttcgcaagaatcatcaagcacagcataaatacaccagtattgtacaaattgagcctccatgtattacatccaaactcaatcagagtcagtcctttcgtcatcagagtcatcattactcggctggaggtcgttgttgcgaaattgttccacaacatcactcgcaattttgtcagccgcagtttgcgcactactgataagatctagggcagcttcttcacttgtcccgtctgcaaacccatcaatggtgtcgacttcaattctcgggtacaaggattttgtcatcgccaaggccatgccagctcccatgcttccagccttcttgatattcttgaaatatacttccggagcaacactcagcttgtcaaatatttcggttgcgtcgagtgtactcggaccaccattattgaggaacatggcttggataattggtgcagcggcattggcgacgtcatcccttgctccttcaagcctcttgatcttaccaactaggacgtcaaactgagcttgagacttgattttccggtctacaaaacacatttataatcagaatctactgcatttaaaagaggaaagttcagatcatcagccggcagtaccttcaacttctttcaaggctgagtccctttctgcagccagttctgttttgtcttttttcaaggcttcaatctgtttttccatctgagctattctggtggcttgcgctgtttgaaatccaagtgtttgaggatgcaattatgacagcataaatcaatggaacagatctggatgattacctttggatgaaccactcagctcatagtttgaatcttggagctgagcgattcggtcccttaactctttttccgtctttttggcgcactccttggcctcatgcagctggtccctaactgcttctagtgttcccaaatgaggaaccagcttttccaaagttgtagtcttggcctcattgcgaagatggattctctgcatgatggatcatggttcagttctgctaaaaagaaaacaaagttaccgaaggccatcactcggaagacttacgtttacaatacgagtggcttctccgagcgctttcttcagctggcacacttcttcatcttctttctgacggtttatgactataccggcggcttgtgagttctcgtcccaccatttgatcaagataggaggacgagagtcgtcggtcgcctttatgcgagggatttcttctccgtcatcacctgatggtcctgatgtgtttccaagacattagacgggtacactgaggttatttaaatcgccattgtttgagaagacaactaacctgaagatgtgcctagctgggcgtgaggtgatctttgttctttacctgaagacccagctatcgagtcgttaccagcctccggtccttgcgaagtcgtcgtctgcgcttctacttcgggaatctcttgatcagggcctgcgtccgactggtttccagtcgggggctcttgagttgttgccgtttcagttgttgccgactggtttccagtcggcggcgggtcactcggattggctctatcgcacgaagcatgggcgccagtcggctgactttcagcggtcggctggttttcagcagtcggctcggggtccttggatatactctgctctgtcatggcaggatcggggtcttttccagatggatctatatcagatggtttcctgcaaagtgttctttcggtattcagcatcatttttatgagcaaaacatgccgaagcggaatcatatcgagagatctaatacctggaagatgttctgatctttggcattgcacggccggccagttttttcctgggcatggtacgctttgggggtttattaggcgaacctttatccccagatttatcatcgtcgccttcatcatcatcaagtaccagctttctcttgcgaggacctgtttgaccagccaatttggaagtctgaggttgcggatctggtctgattgttggccctccacctccctgagtggtgtgttggcgaggagaccggcgctgagagattggtggatctgacttcatcaatgcatattcctacacaagatgcttccatagttagtcaattcagcatgaagataaaactatgttctgatcatggtttgagggtttccgatgcatacctgtggaggcggattgaatgcattatatggcacgactggcagttggtgagagtagctgactacaattgcatttgagaagattttgtacatcctctccttcatgattttgaaatccaaggagtctggttcttcacggttgggatcatgtttgccgtcgaactcgaatgctgtgcgggatctttccttgattggcgccagtcggcatttgatgaagtgccgagtgatttgctctccctgtaagccttgttctttaaggtttaacatacgatccaacaactccaaggcttgtactgcttcatctccgatcggaagagagttccaagtgtcttggtacattggaggaagacaagagtacccgggaagagcaggctcgggattctgaacatagaaccagttcgcatgccatcctttgttcgaagtcttgaagggcatcgagaaatatttttggcttagagttccccttagttggaatcctgcccccccgactacacacggtttgttcttgtttggttggggtttgaggaagaagattcggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacgatctcatgagtatccggagacgggaaagcctcaccgtgcgctggtcgccacccgatgatttccttggcaggaagaacgccgtgcgccaccatctccttcagattttcttctgtcacgtcggatgtcgcccattggctttcgaagctttctccctcttccgccatcggtttcactcaaatgtgctgatttgattcgagggatggcttgggagaggtgagggattgaggcggtggatcacgggaaggattttgatgcacttttttgaggtggatttggccggagttgtgaaccctagttcgccggcgcagctttgcactgtagcagggagtggggaaaatggcgagagttccggcggggaagacgaagcgtcgcttggatataggatttttcagtttagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgctcaaatcctttttatgcggtcatataattctttggaattattgcaatgcaaattaaaaaggtgcccgacagaaaggcgttatgctatttttgcaagcttttttaggctacaaaagctgtttgggttaactaggaatgacttgtttttattatagtcatttccttggcgtgttatatgcctgttttcacggtaaatagtcatggcctaggctatttgacttttttattaccataatctttataatacttgatgggtaatctttagagtttttatattcggatacctgtcaagtgtgttcattcgtgaactttttagagtgtaaaccactcggatttcttttattatggctaaaaagcagtcggctaacatgcctatttaggcgccgcatacgcttttgtcatataatgcacaactgtgttattattttgtctttcaactatatgtttagtttgttaactaatcacatagttgggggctacacctaattaggtgcatctattcgatgcaccatattctttttcttttcgccctttacagtccacttggcaggttttggcttgaagagttagaagtactcggattattatctttgagaaggctatgatggtcgactgcaaaggactcgggggctactgtggagattatgggtaacccatatctacacggagacggtatttggattgggtaccggatacctaatgtagatagaatatcttatttgtatcttgggtttgtttcttaacttgtgtatcaaggaaacaccctgaaatttagtcggttacgactgtatcttacctatattttcatattccgttagggatatagattatcttttgtaacccggactccttcccatatataaggggggtccgggcgcctctaggggcagttgttgatttttcccgaatcatacaattaataatacactcggcggattcatccccggacaggagtagggtattacttcttttttaagaaggcctgaacctgtataaatcttttgtctccgaacccatacactttccaagcttgatagccacccccttttattattgccgaaatctagtttcgacaagtagggtgaggcatagctcctgcagctgctggttgcttgtcgtgcgcgataggaggtccggcggggatcccctgcactcgtcgtgtccggcggaggcggcgccgctggctgtggacgaggaggggaacagggacttgacgttgtcagagactcgatctgcgcccagcgaatgtggaaggaatgagccagcagcggacgcggagctggtcatggcgctgccggtgttgccgaatccgtaggacgtcgaggtcgcctgctcggtggcctctggctgctccgtcgacgccacgtcgggtggtggtggggcctcagcgcagtcgatcggggagctcgtcgatggcggccttggcgttgcacatgagccagtcgacgaccttgcggggctggtcgtagaaccgaatggcagtgtgccagtgtgcgcggcgaggcggatgcgccggtccccgctgcgtgtcccaaccgttgtccctcttcaaggatccatcgccagttgtttactagccgcgctgccgctgccacgaccaccgccgtctccgcggcttcctccagatctttcccatctttctgccaaacaatgggaaaacagatgaatttgaaaaagaagtaactggaatataaaaattactatggacttttttttgtaaaatgagatggtcaatgctaatgtggcactttcgctgaggtggaacaatggcgtggcaacttttgcatcatgagcgcacccacctagccaagtttttgtaccgctacgctcggttttcaagtttttgcacctaatcgcacccacctgccaaggtcttgtaccgtcaacgcaaattttacatgcttgaatagatgtttggagaacctatttgataggaagtctagatatgacacagagaaatttattttgatccatgataaatgaatcgaataatgataataaattatttactctggctacattaaacctatggaatttatcgtaaaaaacaaaattataaattttcctatatgcatatatatcatgttatcatttttttctatattatgcgtatgtatctgcgcattctaccaaatttcttataataatatgttgtactaaatgtcttaggtattaatttatatctctagaatatgcctaattatttaataacattgacatatatgcattttgtaacttatggggttagtttgtagattatattttattataggactaaaatgcaaaaaggtcattacatccccattcccccattgtacctctacacttccacagccctccttttcctttccattgctgtagctgttcctcattcttttttctctcccgctaatctgttatctgtggaggactccagatgataaaatgatgtggaattgtttgaccgacttcctccttttacatcggacggttaatatccattccaccttttctttgcttcttaatccaatggctatgaattaatacatgacgtggctcagtgttgtgaaatcttgaaatttacttttcacaaatgtagatatgcacagtttatagtcgacctttagattcagtcctcattgtttcgcagttcatgttatgatagataagggctgctgaataataacctggtgatcttaaagtctaatcaattcaattgcctgctcaattcctagcttgcctctaaatattttgagagggattaccagggaattgaatgggctgctgctgccatagcatcacaccccaattttcgttcgggattaaaaatcatttaataatttattttctagaaattaaattaaaattaaaagcaatttaacaggtgaatttaatgagggaaataaaatttacttttaaaatcatggctggaaatatttttgtaatattctccatgccctaaaatagtctctagaatttcccgtggatttttggaggtcaagaagtatttttaaaagcacaaacatcacttaatcaattaattaaattgaaaaacaaataaaaatctccttctttctatttgggccatttggactaagtccacttcgcctcccttgggcccgtccccttctctcttctcccggccggcttcgtccctccctagtgggcctcaagcccgctagcctcctcccttttcctctaagtcgaattgacgtccctccttctttcgtgtcgccaacaggaagagcccacctgtggggctcacctttaacctgcaggcacctctcccgaaactgccggcgttccgtgcctcttctccgcaccccatggaattggtgcggacgcgggtcacctcccttcctccaactttttgcccccatgtcctgcactgaggccctgtttagttagtaaaaaaaaaagttttggctttatgtgccacatcgaatatatagacacacatttgaagtattaaacgtagtctaataataaaacaaaatgcatattccacctgtaaaccgcgagacgaatttattaaacctaattaatcagtcattagcaaatgtttactatagcaccactctgtcaaattatggcgcaattaggtttaaaagattcgtctcgcaatttacacgcaatctgtgtgattgatttttttttctacatttaatactccatgcatatgtacaaacattcgatataatagcgtaaaaagtttctgcgtgagaactaaacagggcctgaatcaaagagaaccaacactatctgtgcttgctgatgcatggtaatgtggactcttttgcggttctatactagaaattttgtggacttgattactacgagaaactttgtggcaagatcatgttatgttgaaaaccatccgtgtagtagtaatttatttactaagagaaatcttgtggtgataccaatacgttaactctaagtaatttatttactaagagaaggtgtacaaaccaattaggagtactactatcctaagtaatttatttactaaagaagagctgagaacgaactaagagtaattcatttactaagaggaggaatcaaattgagaagggttgaaaacaacctgggagtaatacatttacctggtgcagctgacctgcaaagaatgcaaacatcaaaaaagaccagcaacgcataacatggctactaaaagtataattacatccagaaagtatgagattgggcagttagccatgaaagcaagattgcattctagaaattagtcaccttcttttcacccatgctctattgaacatgcaattatatctgtgcttatgttaactttttctgtgacacactagattgaacctaaaacagtatagttaatgcttatgttacattgctggaaagcagcatgagtgaatgctttttaataagtaggctagcaccagattttatgatatctcaggattagatttcacaattattcatcattgttttcatcctgagaaaactaacgagtgaaagaaccttaaacatgtgtcctctcggctctcggccacagcaggaggcatatatgtatgaagcaaaaacatactagtcaataggcattaatcgataagcaataacgcaatcaacagtacggtagaggacatgcgcatggtaagaacgcaatcaaattaggccaagttttagttccaaaatttttcttcaaacttctaacttttccatcacatcaaaactttcctacacacacgaacttgcaacttttccgtcacattgttccaatttcaaccaaactttcaattttagcgtgaactaaacacacccttaaccaaatgatgtaaatactctacaggaaggaatgcccacaatccagcagtacggaatgccacaaccaaattcacacatagccacaaatcaaaaatcaaataaaatctagccaccaagcaagcacacgaccaaaaatatacatcgtgtacgatcctatccgtgctccctcacctcaccggccaatcccccccaagccctagtttccccacacggacacacaacattaattaatgcacgaacaatctcggtgcgccgcgccccggtgagttcatccccggccgcgcgcgccgctcaccatcgatcctcgtctccggaggaatcaatcgccttcaccgccgcccccccccccccccccctccccctaaccgctctctcgtctcctccttcctctcccccaccgatcgacctccaccgtataccaccgcgcgcgagctagcgatcaacaacctcgctctccggtctggagaacaacacctacacaccatttcgagacgagatccaatccaggaaggcagattagccggaggagaactcactttcccatggcagcgacgaaggtgaccggtgacgattgcgagcgattcgctcgaggtggtgggggtttctggggtttctctctctctctcgtctctcccccttctctcacaagtcagaactcaccagcggtcgaggctatatatttgaattctcgatcgttcagatccgaacgtgcggcagcgatgccatcggctcaccgcggcgcacgcgggaatgggcccacctgcttacctttgtgtaattccggtttggctgtgcaggcgcggcaaatatgggaatttctttttactactttactgtagatacatctcagctactgttgtcgctggttgtaaagcagcactacttagtttctaccagccatgttaggggagtttctaccggccacagcttctcagataatctcagcttccctaaacaacccagattatcaaccagattttaaaaatttataattatagaatctataaaataattagaaatcggaatggataacctagcttctctagaaatagggtcttggttgtgttgttcccactcctttcccaactaatctcctcgtttttcgtgcgcacacttcccaaactactaaacaatgtattttttaaaaaagtttttatacgaaaaattcttaaaaaatcatattaattttttaactaatacttaattaattatgaaaataaaccaccgtgtgtttccattcaatcccgaacacaacctaaataaactggtttaattcgttagcatgtaaaaaaagtaaatttcacaaaactacagaatttttatcaaattatcactaaactacatatttagtgtgatatattataaaactacatacttaacactaaatttctcacataactacatctttaaggtggagtatcgtaaaactacatatttagtaacaaaattattacaaaactatatgtttagtgacaatttaatctaaagttacatgtttataactcaaacataacactagtgcgaaggacttaaactctaaaatctatagtttcgtgataactttgttattaaatctgcagttttgtgatactccactttacatctgttgttttgtgataaatttagtgttaaatctgtagttttgtgatacatcatcttaaatatatagttttgtgataatttgatcaaagttttgtgatacgtagttttgtgaaatttacttaaaaaaagtttcaattcgtcgatagaggttccctcacctctcccggtcgcccacattgcctgagcttgagcttaatcggttccctcaccttcctcttctttttctctggaccgtcatagccctcgctcttattgttgtagactttccagtgccactcagtcatctcctacgccggccgccggccctctccccgccaacgggctctagagaaagtgagggggagagatggagagagtgaataggtgggagtggtataagtccatttacatgtgagtattacatattttttttattttttaactaagataccacgtcaaccaaacattgattcgtatgatctgtatgattttattcaacccagttttaaaatatggggttcaaaaatctgattttattctccttaggtttccgccgccaccgctcacggaactacgatccgacacgccctcgccgctcccccgcccgctcgcctgcacacacactctctctctctctcttcatgtatgttgtcggtggatttcccggatcctctttttttttccggctgttcctaagggagaaaacgtgtgattttcggtatcgcgtgagatttaccattctgctgtagttgctagaatgctactccctccatatcaaaatataagtattttttacttctatatagtcttcgagatgttgcttggactaacaatatcttaaaaaaataaaatgttttaaataaaaatgttgcatattatgattgtttgtttaatgataaatctagtaacgtcaattttacatgattgagctttttttctattaatagtcaaagttaaaaatgtttgacttgacaatatgctaaaaatgcttatatgttgggacagatggagtagttgttattattacttactgcaattgaaatgatcataagtagtaggttaagttaagaacaagttggttttgtggttgtatgaattcgttccggaatgtttgggatgccaccatgagcttatcattgttagaatcggactcaacgacccttacaatttacatatcataaacaataagcaggatcgttggtttttccctacaagcattggattttacacttactagttttgttacaaacggcccaacacagattctccatggagttaaacaaagaacatatcctcgtaagttctgctctccagttcccgtcgtaataattatattttttcatttttattaccgatgctttaattcattaatttagcacaatctaattattgtagcaagtggaggatgaagatagactcagcatgcttcatgatgatattttactatcaatcctggggagagttgacatttgtacagctgcaaaaacaagtgtcctgtcaacaaggtggaggcacctaccttggcagttaactaaactggataaccaccgtgtacattgacgaagctatgtcaactctcaccaaagcagcaaggagtctgctagctgtgccgcagagagaaaccttcattacaagtctatgccttaagctctacttgatgggcaattactcgagagataaaggatttctattaagtgaagcgattgatggtggaatagtaaaagatttggaccttgctattttgaacgagaaggaacctgaagattgcgatgacaaagatatgttttgtcaggccagagttctgaaagcctttgctggtgcttttcctcgtgtgcttcacttcctcacaaggctctctgtacaacgtgttatcttcaccgagacattcatcatattctgtttgactgttgcactcagctggacattgtaaggcttagaaattgtgatgctgggtccaatgctgtatggaaaatagatgcgccaaactcgaaactccgacattctggagctttcgttgtgcagcttttggagattcgagttagcctgcctcccatagcttgaggaggtccattgggagatttggttctgttcctatgcccccttgtcatttggcttcgtcccaagcctcagggaactatttcttgcatgtggtgcccaattgggcttcgaaggcttcatgttaagcgaagttttacaaggcaccaaagatttgcatactttgacaatagatttccaaggagaaaaggtaattgaatatgtcattttgatgaatcattattatttttttatactataactgctacagtgagtacatgcttttcattactatgaatctgttaattcagttgtgttggacttttgcacaagtcatgaggatctagcagtagaatgctgtcatagtttcagttggttcagttctagtactacttaggtgcattcaccttcagtttttattttaataaagaaacaacctacttaggagcatgcattcttcattaagaagaagaaagacatctgaatttgagttaaaaggacaccaacctaggtggtgtgctgtgcatctacacctctcagttttggttttaattcctcttcactcaagacttgtaattgtccagaaggattttattattaggaacaaactgagactaacccttgtttgtgcaatcatttaaactcatcggtgtgctttgtttctgttttttttttctcttttcagctttgggtacaacctgaacaaaaacaattctgccctgcattcaacaatctaaagactttatctattctttgtgtttatgttgaatttgacctgttatgggctttaaacctccttgaagctgcgccatccgttgagctacttttcattgatgtaagttttcctttcgttttttcaaaatgtaacaacatgacagtaaatgtagctggaaattctcactatttgcaaaagatttacacaaaccaatttctcacactaaatgcagacctgggaacatatatgcttggtggaccaaatggatgaagagggaagaaaggatatctatggagaaagaacacatccttcatgggagatatccgagtttactggcaccagaaaatggcgattgaaaaaactccagtttgccggctttaggccactcaagcaacagctggtatttttaaaagccatcatggatcttagggacaatatttcatcgccatctcagataattttcctgtgaatcagtagaatttgtgttctatagccgcttcagagttctatatgtaaaaattttactgtgcagcaatgatcagctcttgcatgttaatattatattttaattttgagtaaattgtatgcgatctagtgcaaaaaaattgaaaaatgagcaatacc

SEQ ID NO: 55506 - DNA, 6412 bp, Oryza sativa
agttgtcaatgagacaaagttcaattcaaatatggacgatccaaaaaaggattacatcaaaagtaaggtacactctctgcagtatgatcaaatctctcaaatcatcagcaaacatacaatgcctaccaacaaaagaatcagttgattgaagggatgaactgaaggagcccagttggagccagggggagcaggggagtaatcacctgaacccgagctcgtgctgaggacaacgaccacccaatctccctcattcgcgatcccaacaccagagaacttggtgtcattcagatactggttgtactgtgacttggtgtagttggtcagaaccacatcaggtacaagtccgggaacgcaggccggcatcacctgaccgtctccggtcaccgacgcgttgagatggcaatggtcgaggtactttgggtagtcggggaactgctgctcggtgccagggacagtgtttgctccggtggtgttggtgcaaggttggtctttgaattgctgtgctagctgctcagccaagcaggcagcattcttgttctcggatagcgcagggactttgagggaagctctgtagctgttgatgcccttgagaagctgtgaatcacttcctggaaatgggaagcagtgtcaaacaaacaatgtaaaacaatgattgtatctccaagttttcctgatttaacagtggaatagtttgcatgcatatcagatctcgaccagcaaaaggtagaattttatcgttcgatcttcagcaaatgataatcgtaataagtactgttaacaaatgacaagtgtatgaataaatgcatctcaataaactatgatacttcatatgtcaccaaaaattttcacttgaaagaattttcattcgaaaccatatgcataaaaactgtgccatatgtacctaaacacatcaactccaatacatagcaattgtgacttaagttactgaaaaattttctccttagcagactaccactgagtcctccccgcaaaaaataaaataaaataaaataaaaaatctaccactgagtcctaaacatcagatcttgcacatcaaaagctggatttgtacgaaaacagcttcccaaacaagattttaactcaaaaaagaggaccaagcaaacctcgaaagtggctcacaaatcatgaccatgtgactagttacatcaaaatgtatagaacaccagtgaccagatctctgaccagcacaaatgcccagtgcaaccgcttgagcgttttctaagcgatcgaacagagacaaactaattcgtacggattgaaacaagaatcatcttctgcagactcccagatcccatgaaccaattaaaactcccagagtaattctcaattgaatttgagcaacagggcagctaaatcattgcactactacacagcagccaagaacacgcactccagcgaatcagatccagacacactacaacaaacaaataatcaaaacaaaactacaacaattctaaccatcgaagcccgaatcagattgcaggaagagcagcgagagccaataagccatttttaccatcagatctggcgcaatgcagcaaggaggaagcgaggacgaggaagcagacgagggagatcctggaatccattctcgccgacacaattcctcgctgctgcagcggtgttactgttgcctcggccggggaggaagaagagtgaggtgcgaggcaggcaagaagtaggagaggagtgaggaggaaggaggcgagttgctgtcaccaaccacttctttttaattttactctttattgaatcttgattaatctttactcttccttccggtctgtcctaaaaactttttagtaaaaagtggtgataaatgtttttattagggtccttattgtatatttacactggcaagataattcgattacttttgtatcttgtaccttctgggccatttttcactggcaagtggtaactttttgggttacagcctagctttagcagttgtagttaatttgcttaaaaattattgtggtcacataacttcaataaattctgaaaggaactgtataacagtttttatttattatatatccaagtcaccttcattacattttttatatatttataaataaatagtgcctaaagaaggtctagaaatagttttgttcctcatgtgaaaaataattatcccaaggaggcattagatgctttagtagtcataaatttccctgtataaaatcacggaaaaattgtgaatgatgcataaataacggtaatgatgcatgcgctgagtacattttatttatttatacatacaggtcgatattcatatgaaggaaatacaaatacaataatgtagattctgagaaaaaatagccccttatttcacctgactataactctataagttataacacttattagcgataatatatatatatatatatatatatatatatatatatatatatatatatatatatatatattcttaacgatttaaaaggtagtattgaaaaataaactacgatgaaaaatatcaaaatcaatttaaaattaaattttaaaatttaatttttggttatggctacgagctatttgtgttttaagttaatacatgtttatggcatggtggtcgtatagtactccctccgtcccaaaaatacttaatgagaagtggcaatgaatctgaactaccctttattcagattcgttgttctagtaggggtcacatcccctcgcttgagtttttttcggacgaagagagtatgaccctgtttagattccaatttttttcttcaaactttcaacttttttcgtcacatcgaactttcctacatgcacaaactttcaacttttctgtcacatcgtttcaatttcttcaaacttcaaattttagcgtggaactaaacacaacctatatttgcatgggcccacccccattatattctctgtgcttataaaacaaacttcatatactctacgaaaccccaagctgtcggtgtttctcaagtagttgctacaacgtgatcatctgagatgcggccacaaataacaaatttattcttatcaggaaaagaaaaaagaagcattagttgaattaagccatggacaacgtgaaacaaataaaagaagaaaggtgcttggtcgatgcttttcatcatcaaataattaatttcgctgcgtgtgcgtcttctccggttggtcctgcactgacgttaaaaaggttggtgtagatgatgatgatctgtgcagcgagcgagcgaacggcgggacagagagacagctcaccgtgtggcgacggcgatggtggaaccgacacagcgtacgccaacactcaacacgacgcggcggtgggtaatacgcagcgccagtgcactacgtacgtaccttacctcattgtttgctaaattttaatttcagaattgattttaaaatttttttaatgtagttttaaaatattagtttcctgaccacatatttacccctatattataacttataatcagctcttaataactaaccaatggaagagtgaatcactgtgcagtcgcagttgagtcacttacacaggacatttaaactatttgccacctttaatatgtgatgtttaataatttattactcacaatctatgacgtgcccttttacatatctacaagtacgtagtaaattgttaaatgtccacttacatataagccccgctctaacttttgtgcagttttcgacatttcctgtgaatattataactgtaaactgtgtatctctataactgtgtacaaggaagcctcacccaacaatggagttgtggttcattttagcaatgaagggcttttagtacttccaattctaacgcaacatattgaacgcacttaactgtatgaatatatcggacgcactcctacatcccgctgcgatgcaagtcgaccacggattcacgacccagagatccttttaacccctgactacaattttttgccaagattttcctgactcgtatttgcatacactcgaaaaacaatcgcactggttccaaggctaaacatctgcattcatgctctgaaactaaatctctttataaatatcaaatagagcactaatacgagtaaagctaaaagccgatatttcttatctacatgatgagactacgactagttcacggttgttgccaaataaggttaatatttacatcacctacgagcaatctcggttaggctacaaaaggctatggtaaatatttggccaggcgacaataggctgagtttgttttcacttttcagaaccacgggtgccatgtcggatccatcatgcacaggttcctcgaagataatgccgcttccacgagatccgtgacgcctctttggaccgactgaggtggctcagatgaattctcctcctgaaatagggagagaaaatgctcccagatgtgaatataagagcaggtaaaatagcaggctataagctagctataaacatattttaaagagataaaggaagagagactcccaagaagtaatgtgtatatgacagataggatcaggtattaatagtatagtaagcaactaatgtatgaattgggtattacattggctatagatgatttggagctagcaattggctatactattaaacttgatctaacttgaatgacttgataatgaatttggacttgctaatgttactatccaaaatggttttccagttgattgaagatagcaatcctaaaacatagtactaactgatagtaggtgcgcaacaaggtgaaatcagtagggaatatagtgcagtattggagcattgctatcatgtgaaattgtctaactaggaacaagcgagtgaaacacctcggcttgctgaatatttcactttgtgcataagtggcctctccaaataacaataactaagtaaagaaaggattagcagtgatagcattatcattttaaaagttaacggccagctagggaaataagcatgactgaaatcggaaaaaatgatatatccagagaaacaaaaatcaagtttaaagaaatagtttacctcatcagcaagataatgtggtgatattaatttgatacgggtaatgacatgctccacattgtttatcaccttttgctggaaatccaacgggttaatcattccagcagcaactggaacagaaggaatgccaagtggcctcctccatgaccaagataacagttcatcacggaaaaacatagccaaatggtgccatatatgctggctttgctgaaaatcacaaagaaaacaatccgattacgtaggaaaaatagaaagatgaaccacaagggacaatcctaatattaaccaagacggaaaacaattaacagtaggagtactatcattagcgcatcctactataattcactctttaaagaatgatactcacttttggtgaaaccacagactgggcagcagaacacatggcagacacaatgagaccttcaacaccgaaatttgagaagaaagcttgcatattgcgtgtcagcctaaagggaactagctcattgaactcaatcattccatttggatcataagctgcagataagcaaatgtgagtaataataatttcacgtgcattatttacaattactggtaataatcaagaagagtacctggatggaaatcattctggaagatcttgccagtatttttagcaaataatattttgttaggagccctaccaccaatctgcaacatgtacgacatgaaacaggacagagccacttggattgcaaactgtttcttgaaggtccagaggtgattcccagttggtagaatcttatgcatgtattgagagaagatattatcattaacgatatttttagtaatttcattataggcttgcaagcgtaattccaccactgcttcaggggacacctgccctgagatggcttgatttagctgttctttgaaaattgtaataggtgaatcagcttctctattatgtcgggcacagttaatttcatacacctccaggaaagtgctgtacatcaaatcatcctctaccatccgaacctggatcaagggaaattaaacataaggccaggatattaccttggaagctgaaataaaacagctaaacatgattattatcaggtatggaagaatggaaggtatttcacctgtgaccaaacaggaataatgattggggtgtgaatagcaagatggcgctgcctcgactctttatgtttgtcaaacattttgtttagtacacggaatagctgcagcattctctcatcactccgggcatttggagtcaatgatgtctgaacaataaaatggcgctgtgaaccatcagagccaataagtgtcagacgtcggaagctactaccgtgcctccggacaataggaatatcaggtccaactctgtccaacttgacagtatgatcaggtgcaacctcctgcaaaagacaagtaaaactta

SEQ ID NO: 55507 - DNA, 10761 bp, Oryza sativa
ttttcatatggggttttagttgccatatgattgattcttttggtacaaatgagttggtaaaagaaagggataacgataaatagatcaagatgagagaccttgtgatcaaattgtacatgctttccactactcattaccttcagagctcaaattgcaaatatatgctcaaaattgctgacagttttgtgatggttattttgtgatcaaaggaatacactattttggttcacttggaagaatccgaattaacgaaatttgtagttttgttcacctatcaccatcattatattactcggtctataagccgtagctcaactaataactttgcaaatgaaaggctaaaccacaggagacagcaacagaaatgcagtctcccagttccatttttcaggtttcaacactccagtagcagtgtacactttcgaaatcaaataatgtttcctcgcaaaaaagaaaaagaattgaataatgcatcatgcatgattgccttctagcctaaaagagggaataaaaagcggggaatgtacccaatagttagtacacgaaaaaatggtcgcagatcaacaacggattaataactcccgtaaattcttgtacaagagcaaaaacaccactcaaaatcatgtttacaagttgttacagctacaacatcgttaagggcaccagctaatggtgtgggcatcttgacagtggcagatcattgacgccttcgcttaatcctctcaagggcgccaagctgctcattctcctgggcaccagagctttcctcctccctgttctctgcagctctcttgccgagctctccaaacaccgcagcgggaacactcttctccgcaatttggacatcgtcttcctcctcgtcgctctcatcgggcagctcaatgtcctcattgttagtagcagcagcctgttgttgcctgctgctgctctcagcctgtgcctgcactccagcactgacaaagttcatcatccggttagcaggagcagtagcagtgcttggagctggtggagccgtggaaggtcctggcgctagttgcctttctaggttagccatctcatcctcaggaacaccggctcgtttcagagtgtcaactgcctcatcgaggttcagcctctggtccctctgcatcaagtactctgggagtatgaaatgagtctgcacatgaaacgaaatacatcattttagtttactaactcacaagatgatcattgataataccaaactgcctataaggttggcccttgtgacatacctgactgcggctagcagccacagtacgcttgatgcgaagcatctccctgaatgtatcttcgttaccatgctgaatctcaaattcattccatttattccaaaattcaggatgagagtttggatcagcatagttggatgcgtggacataaatggcacgggcacgatcaatttctccaaggtttctttcaagttctgcaaatttcatgcacattgtcatgacatctctgtctgggagtccagattcaattgcttgctgcagcacaaaggaataaagttagaatcatttacagttgtgcatacctaaagtgtgactcaactaaaatctagaacatactatacagaaaaatagtatctggatttttcataagtatatgggttgttacagcgagtgcagaatgagttctttgattcatacgaacagttagcaaaaaaaaaaaaaaaggcaaggctgttggaatgtaataaaacccacattaattttgtcttaaaacagcaaaatgtaaaactggatctcaaaacaagcacacgatataaccagtattagtaagaaccaagataacacactcacctcatatatctgtcttgttcttggaacaccaaatagctccgcagcccgtgcaatatatatttcgtacatactcatcttttcgctgttaggaacagcccttacagcttcgtcgtatacattcattgcacgtttcgcaaggccatagtcttcctccagcttagcatactgcaaatacaataccttcttttcttgtggaggagcctgatcaaacaaaacaaaatgtaagtactgaagcaatataggaaaaacatcattttcaaaacagcatcgatgcaggaaaaaggaacacgaaataatcaaccaaaggtttggaatctaaacaagcaagcaagcaaatgcaaaatatcgcatgacatgatatcagcaagcagagacaaggttcttaaaggaagaagaaagcaggcgcaacaagaatcgccctgaacttattcgtatgaagcaaggacaaaatttctgattgccagttatacccaaaaagcatttggtaacatgttaactaaaacaagtcccaactccaactagattaaacatgattcaacttagcacattttatccggtgaacaagaacagtacttagggacacatgcattcagtgtttcaaaagttaaatgtagatatattcataactactttcatgattttacaaaattattgtgttgtggagatggtgtctctatccaaactgttactcttttgtgactacagcagcatgccacaaatattgcttacatgcaagcattgcatacaactatatgtaagaaacatgtgggtgaaattctagttacctgtttgacagcttcatcgaacagttctcttgcccgctctaacttgcttctctgataccttcttacaaactttgtgaggtaggtcacccaaatgtctttaacatggggatatttaaaaattttcacaccacgctcatacactttaaacgcatcttcgaaatacttgttttcctgtggaaagaggaaatgtcatgatattagcatatgcacgataaaatagtttactcgaattttggaaatgcggagttaacaaataatcctacctcaagaagatatgcataattgagaactatttggggagtggcaattcgtaaatccaatattctctcataaactgcacgagttgattccaatgttccaagactttcctccaggtccacatagaagctccacagtttcagggatttatgtactttcaattggacaggttcatccccctcagcagcagctgcacaggacatattgcattactgttagaaaatatgaacagtaaaacacacaacaaaaaataagatggtaaatatatatatatatatatacctcgcctcttaacctcaacagagggttctgcagtagcttgcctcatcagctcaatagccttgtcaaaattactgtgcctcagctccatctctgcccactcacaccaaatactggctaagtggtcaactgccttgtagttcacctgtgttgcttttttaaagatctcttcagcactatctagacgattatgtttctcatacatctttgcgaatgccacccatagagtatgtggttttccagctgccttcatagggtctacggttttcacagcttcaacatatgtggctacttgccttgtaggatccttctcaaaaagtttcaccctcctgcaaacataatcgtattgttagccaattccatcaagtatgagaatggaaaacacaaaagggaactgccaacatactagtacattgctaggctgagaaatgaaaacacctgccactagattgatacattccacagtatacatgttttgaattaaaatttaccacagccacttactgcactaaagaatccaaaacttgtcgctggaaagaaatatgtactacaaaaacagtaaattgcaactacaataaaacagtaaaaatacatagaccgtatacttacaaccatatgtaatagtccagtggggtcttgcattagtcatttaatatatcacctaaaatatgagaagggaccaaactttttgcagtaacagtacatttggtttgctggtttaacatgaattatccaaatcaaaattgttctactaggctggaatattgagatgctactaagttaagatgttgatgttgaaaaaataaacagcatgtacatgaagtgaactaaagagcaaattagtgtttactattgtcaaaacacatgaaaaagaataaatcaatgtgatcaatcaagtgagtctcacctgtgccattcctccacattatgcggattctgtcgcagcaggacactgctgaggagctctggccggcgatccaacagccgctcaaaccttgccagcctcaaatcagtatcatcctcatcattcagccagcaatctgcgaggaatttcttcgacagcttgtccatcccattcttcctgcccgcttcctcttccccctcactccccgcaccctcctcctcggctgcctccagctttgccgcaagcatactctgctcgaattgtgtgtacgcctcaaacaccacgctgaattcctgcaccgtcatcaccgaagcaaccccctcttcgaagacatccctcgccttctcatacaaggttcttctgacgtagtaatcggccagggaggtccacagcttgccaacctcatcggtgaacttgcgaatgccgccccgcagtatagcgtccaccttgagccccgcaacctcatcggcatgcttggtgaggatttcgcagagctcaagccagagctggtgctgggtcttacccttgacggagcggaagccgtcatcgttgagcacggacgcgaggcggtcggcggcctcctgccagcggtttgcggagatgaggaaatcgatgaagtcctcagcgtgggaggggtcgtactggaggtatcgtcggaagacgcggagcgaggtctcgacggggcaggccgggagcgaggcgaggcggaggtagagcggccagatgcggtcgtgctgcgtgacggggagcgcgcgcagcgcgcggtcgaaggcgcggcgcgcgcgcgtgagcaggcgctggtcgagcagcgaggtgaggtagagcacccagacgcggggcatcttgtgcatggtggcgagggcgcgctcgaaggtgttgttgagggaggcgtaggcgtggtgggagatggggtgcgggcgcgcgtggtcgaggcgctcgcggaggtaggcgtgccacagcttgtagctccccgggagcgccttgagcgcgcgctcgtagatgacggcgcgcttggcgaacggcgcggcggcgcgggcgacgaggtagcgccaccaccccttgagcttgaacggctcgcgcaggatctcctcctcgtacgccaggtcgtcctccgtcgggtacatctccggcgagatccccagcgcctccgccgccgccgcagacgccgccgccacggccaccggaccccccgcaggcgacggcatctctcgctagggtttagtgctccgccgcggcgaggaggatttgcgccggagagagagagagagatcgagtcgagacggagaggctggcttggcttggcttggccaggccggcgcgtcgttttgttgggccgatgagttggaacccgagtaggcaagggcttgagtggttttggtgggccttcagggattttgggctgaacttttttacggaggaattgggcttatttggtatttgagtaattgggccgagttttgtctgaaccagagcccaaccgtcagtcatctgcttctgctactctactcaaatatttctttccccgattttggtatacatttgtcaatttttttgttaaaaaaactacaattatactgtatttatatttgactacagatatatagatagtcctttttttcctgaacagaaactttaagttttttttcttagagaagaaactaaagataaaatattactatttaattatgtgattacgtgtaagagttatttgctgcaatgcaaatgttgaagtatagtcgtgctacggtttctttatatgccacagaccaggaaaaacttggcaagagaaaatagggtgcttttttggatagatgtcgaatcatgccgcacctgaattaggcagactgactagtgagtagtgactaccatcactgatacaacaaatcttggcgttggacattatccgtacgagttcttctcaacaatattctcccttggtccaaaaaaaccaatctagatggggatgaaataccacctagaacaacgaatctgatattccatccccacttaggttggattttttttagacggagggagtagctgaacaacgaaaatgttagcccctctatttttttgggataataggcagtgatcccagtatatgctgaataaaagaggggcaaaaaccacaatgttaatgagactagatcctaggtggttgcgcgcacgcgaaggaacggacgacctcctacgtgcagcgggagggagggaacggaaggaagaagaacggcttcgtttttaaaatagtagagatatcacgtacaaactgccagtataccactaaggcgacatctaaatacatttcagcatgctcccataaaacttcattgtcaaggacaagaggtttggtatacttcgaagttcgaaagaaaaccaacattgttacattaccggacttctgctaattaaggctcaatcttgcacaacaattcatctatggaaagaaaaaaggagccattagctcataactccagattatttaatcaataatatgaaaactatatgattgatgatgaccaacaaaatcaatggaaagcctctatcagattcagagagctcacatcattcgtgtgcttttcaccttgctcctgaccaatcctccattccaggagtctatcagaattcagagagctcacatcacttttgtgctttcaccttgctctcgaccaaacctccattccaggaggcgcacgtgcatctgcataatctgcatattgccgaaccaactgagcacgatttcaggtgagcttaacagaatctgttcttgaacaagaaaaccaagaaatgtcactgccaaacttgccaggtcctgatgaaggcaacagaggaggaaccctgccttttgcctgtccacacagagatacacacccaaggccgtgattagttgcatttttttttcaaacttctaacttttccatcccatcaaaactttcctacaatcataaacttctaacttttacgtcacatcgtttcaatttcaaccaaacttttaattttggtgtgaactaaacacatcccaaatcgtctctgcttcttgctctccacggagaagggagatcaccggcgcttccacgagttgctcctcgccggctcgccgctggtcgcctcggccgccgccgccgctgcagttcgcgagaagcacttggggtgctagtgtttgggcccaaatggaaacaactgcacgaggcccatgtagtccggcccaatatgtatagccagtataattcgatcctttatatttgtggtcggaggtggtgagattaagctgcaccgccattttagattagtacgttgtcagcatcggtagcgccttcacttttaatacttacccgtgtctccatcgcaaaatataataagttttgattagataagatacatcctaatattataaatctagatagatcgtttatccggattcgtggtattaggatatgttctatctaatcagaacttcttatatattttgggtagaggaagtacttgctctatccactccaaagaaaagcttagggcatgtttactttgataccattttcaaccttaccaaattttggtaaagttgtcaaaaaaaagtggctacatttagtttgctgctaaattttggtaactatacaagaaatcctatcaaaattttagcaatttgccaaaattttagtaactatgccaaaatttggtaagattttttttttcatcaaagtaaacaggcccttaattctagttatagaactggatgggtgcttatcaagttcatagatagaattaaattattattgtttttataataacaggtctactctctccatctcaaaataactcatttgtgatagtaatgtaacataaactagattcattgttcgagtcacttgggaaggaggaagtatagctcaggaacgggagaaattcttggcgtgcggcagaggaaagctgtcattgccttcgtcgatgatgtgtgctgctaatgtccattgcacaacactgattaatttatcagctcattgacttcaatacattcaagtattcaatcacatcctaaattaatggatacaagggcacgtgtccagctgtcgttggttcaggagctgatggcctggtgctgatcgagacgctagctcagctgcaactgcaagaatgtaaaacaattaattagccaagctgactgtaatcactggttcagaaactgatcctgaagatctattcacatctcaaatactccctccgtcttgagtttttcttgcactgtttgactactcgtcttattaaaaaaattgaaattattatttactagcaaatatgtccgtgcgttgcaacgggtgaaaaaacgtaatgataatatacgtttttcatgcataaccatgtcgataacaatcagaaaattagaactacgaaactttattttctagcgcgttttcttttgtgcttttttctgacatttttccctcacgtggttttttaaaccgtttttattttctggcgcattttttccttttttaatatactgtagaaacttctctttttatagttagattagattagattagagataaagaagatatataaatggactaaaaaacgacgaatataaatttgacttttttcctccgcgcttttttccgtccttttaattttttttctcgtgcatttcttttacgaagggtttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccatttactttggaattttttcgccctgttttcaccacgtcgacggagtcggattcgtttttatttttcccctttttggctttttttgtataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaaatttttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggacagttttctttttattttttaaactctttttaccgtgtcgatgtagtcggattcgtttcggtatttttttccttttttttgtcggacatatttgttttttttccgcccggttttttttcgccaggtttttttatcggacttttctttttttttcgctcggtttttttctcccgttttttgacggacgacagaagcacctagagaattttcttttctccaatccaatacagatcggatctcttccagggaaatcagattttttttctccagggaatcggactcttttttttcgctttttttattcattaaacggtttgtctctcggacttttttttccctttttaagggatcgggtgttttttttgccagggacgggtgtttttttcgcccggtttttttttcactttttttttgatcggactttttttttcgtccggtttttttatcggacaaacttggttttttctgcccggttttttttcacccggtttttttgacggacgatggaagcacctcttattttttaagtagtagtagatttattttatgacttactttattatccaaagtattttaagcacaactttttattttttttatatttgcataaattttttaaataagacgagtggtcaaacaatgcaaataaaatctcaaaatcccttatattatgggacggagagagtgtatgtagtactacttaattagtcagataattcagagctgctgctcgaggtcgtcgttgatgtcggtcaggctgatctgcccggccggagagaggtcgtacgtcaccggtgaaacacctgatgacctgaatggtgatgctgctgctgtccagcttctccaacttccgcatccgtgtcatctcgacccatatttgctgtgtgcagcgcattgccaaaaaagaaaaaaaaaacagagagagaccaattgacagatatgtgcagcctgagctgatttgagttctaaactaacaatattcagttcaattcaggggcggatccaacgtgggtgagtcctccctacacccacaagacccatggataccccggagcacctcattcaattttttcgccataaatgataaactaaaggtctctaaatggctggaggttaaagaaactgtgtaattaagccccc

SEQ ID NO: 55508 - DNA, 13274 bp, Oryza sativa
gtaccgtgatttttttcttcatttatatttctatagcttattagctatagctgaaccaatcagagcataagacacactccctccatttactatcgatgtattaatcaaatgatataaattaattagttactccctccatttcattttaggttataagacgttttggtcaaagtcaaactactctaagtttgactaattttttttaaaagtaataatatgtttaacccaagaaaaatatattatgaaagtttattcaattatagatttaatgaaactatgctgatattataaatattactatttgtttatacagaattagtcaaactcaaaatagtttaactttgaacaaagtcaaaacgtctaacctgaaactgagggagtagttttctagaaaatgggataaacccagcctcttcatccaatcggatgtagaatttttttgagaattaatatcatttttatggaaaatcgcaaaagtagtggtcaaccggggaaaatcgcgaaagtaggtccctgtcgaacgggtgcagttcgatagggcgcctatcgaacggccagagcgcgactggcgaggagatcggaaggctgccgttcgacaggtcctgtcgaacagcccctgttcgacaggcagggctgtcgaactgcccctgttcgacaggatatccgtcgaactggcgcagttcgacagggtcgtgttctccatttatttgtaataataattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattatttttatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatacaaatatataagtcaaggacgatcagtgcccttcgcacgcttgctaggtcctcccttcttcctacgcctaatctgctcagtaggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttctccctggggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgcggtgtgtggccctgctctggcgcacgcggagtgatatgaagtccccatgctgatgtgttcaacacgttgtcccccgttggcatgtaagggaagtgtgccgacccagatactccctgcgtggggtgaacataaggcagagtttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctaacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacctattttaacacacaacatatcaataatatgtactaactaagaactaatttaaccatacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctcccctcgctccctccggcgctcacggcgacgatgtggcgactctcggcggcggctggcgatgtggtcctcaaacaaatcgaacaagcatcgcggcctgggtggacggggctttaaaccggcctgtcgaatgcccattgttcgacagggtcggtggagggccctgtcgaacgcccccggttcgacaggcctcgcggcgccgggtgatgggccctgtcgaactccctccgttcgacaggtgagcttgtcgaactccagccgttcgatagggatttgtcgactgcccgtcgttcgataggtgccctatcgaactgcacccgttcgacagggagctactttcgcaattttccccggttggccactacttttgcgattttccataaaaataatattaattctcaaaaaaattctcggatgtacaccaccaaagataattagttagttattgatactttcatgcaaacaaattaaacctaccaaatattatatagctctaccttgtcctctctcctactagttcgtaaaatcgtactaccgttctggggtcttgagaaaagaccaccatagaagtttctcattttgaatgggatagatgattttaaaggtgcaaattgcacagtgaggactgattcatcaacctaccacctacctgtgtcacatatttatcattttctcattcaaaccactcatactattttgtcatgcgaaatcccagaataaagtttacatcttaggtggtgggcggccgggggggctcaagcggggctaaacgttcgtctgtcttacacgaaacatattgggcttgagctttcgtctctggcaggccaaacaccaccttattcctgtcttatgctaatttctggattttagtgagattgaagatgtaccgctaatttctgtcttatactccatccgttcccgattgtttgatgttttaccccctaacatttatgcatgaataattaacgttttgacgtattgcttgtataagtgccactacttaattctatgcttaaaatatttcctgtgtggcttactccctccgtaaaaaaagaaaacataacttaaaaatgaaatgtgacacagtcaactacaacgaatctgacacatcatatcctaggttatcttttttttttaaaaaaatggagggagtacttggttggtgccatttgtgctaattccctgattaaaatgaccacatacaaccaataccaataataatttaggataatttattaattttcacctttagctgatgtagctcaccaattatagaacgatcaacatattggacagaggaagtaaaacatatattcggaagcacattcatagggatataaatatgttgttgcgtgtgtgcgtataagtctaccatgtaatcgaaaaaaataaagaaatactgtattacgtgtgtagtgcatgtgagtttacggtgtaataaaaaaattccatcttaaaaaaagaaaaaaaatgcaaaacgctgcataataaaactagtactactagtactccataaactaaagatgtggacatcacggagaggtgggtcccacggttcaatcagggaggccaacacgcacatggccacatgggccatggccgctggtgttagctcacggcactcgtctgcgcgcaacacgtgtccccttcccccccgcctatctgttgcttggcggtctccatgtgggccccgcgcccttcctttccgtgtctcggataagtgggcccacgtcactcgtcccaccaccacctctaacccacacagggccccacgcagactagacaaaaccatagttattgagaccggactggtaatcgaaccggtgaggctgtcggttcaatggttcactggttcaaccggttggatcggtggtctaatccggttcaataaatactaaatacattgatcattcagtgtaaacacaaagagccaagtagtctggtggtggaggagtttaactaactcccacgtggtcgtgggttcgaatcccacccacgccaaccaccaccaggccggttcaaagcggttttataccccggtttaatagcggtttttaagcaaaaccgggcggtctaaccggtttatagccggatcgattgcatgccggtcttttacctggaccggaccggtggggctctggttctggttttttccggtccgaccgccggtccggtccggtcttaataactgtggacaaaacacaaacaagcaagcactgtagaagctaatatcttgggccggccaactgctcaaaagaaaagaaaaagaaaaaaaaaagaaaaactgatattggtagtcaaagtttattgttcatgctgtcttattcataattggtgctattacgagagaagatttgcaagtgttcgcccatttgcacggatgctttggacagtttgtctgacgaaaaacagctgctgcagctttgcctgttttgcgagcagagctttctatggagtattatccatcacattcatatatactcctctgctactccctccgtcccaaaaaaagacaaaccctggtttccgtgtccaatgtttgaccattcgtcttatttaaaaaaattatgaaaaaaattaaaaagataagtcgcatataaagtattcatcatgttttatcatctaacaacaataaaaatactaattataaaaaaatttcatataagacggacagttaaacgttggcacgtaaacccgtggtttgccttttttttttgggacggagggagtatgctgcatttctctctgcattatgtgtgtgttccctgatttccatgtcggaaatgccagtgacacttgcattcatctgccatcggtttttggaacaaccattgctgtctgtctgaaaaatgcagatgcagagcttatcctgaacgaaacgacgcagcagtttttgggtttccagccgctgtttcatcaagtggccgagcaagcagaagcagcggtttgtgaatgaaatccacgcgccactcatattcatggctgatcctgaactgaattcaatgtgtcccacagcttagcactagcttatcatgcaccgatcgatccagtcagtggcggagccaacgatgtcatcaaacccaaacgataatatgtatttcttacttattagtaatggcggagccacgttcaactcaagtggtgcacacgaatcccagatccaaaatttcttacttaagaacactaaaatgtgcagtgctacattgattttttttctaggcttttaatgatgagaaaattccctatctagcatcagaaaaaaaattgctcttccctctatagcacccaactttcaaaagttccctatctatgcaccatcaaaatttttgttccctatctaacacttccgttactcccgttagcctccaccgtcaaaacaatcatggacccaccctcaggaatttttttcgtcgctctttctctaggacagagcgcgagcgcgacctgctttccccaacccgcgtgcgcctctcagcaaaaccctagatcgccgtcgcccccatggatggagaccccccgggcggcgaggacggcgaatcagccgtgcagcgaggatggcgaccccctgggcggccattggcgccggcgggctcccccggacggccagcgccggcggcacgggaggccatccctaggcctgctcggccggctaatcccaggcgggcgcaggacaggcagctcatggccacggcggcacatgcaggcagctcccaggcgggcacggacagcaaccccctagatggtgcgggcaaacagtccggcatggcgatgaacacaacctttttcttgcttttgccctggatgtgaatttggatgatttggatggttatggttatctatggatgtgaatttggatgctctctaaaatttatttggttcattattgtgttgcaaacatgctgttgttgcagacatgctgtcaaatttctctaaaaattttagatatagaaaggttaaaaaactgtgaacaaaatgaaaaaaagacgtacagacatctggacactaaatgaaaaaaaataaagaacaaaaaaaaattgtgaacagagagagggaaaaaatgtataaaatacagaagggcaaaaccgtctttcctcatgcaacttaacaccgtcaccctcaaaactaacggaagtgttagatggggaacaaaaattttgatggtgcatagatagggaacttttgaagtttgggtgctatagagggaagagcaatttttcttgatgctagatagggaattttctctttaatgatagtgcaccacctctgtttggacgctagcttcgcccctgctcattagtaacattttacaagtattttcgataattaacaatggtgatctcactaagatatctgaactgtaaaaggctttagttagttagttttagttagtaatctgttcttgtcccactacaggcgctgaagcttttggttaccatccagactttgagtggactaagtaggtcggatgcgattaacaatttactaattggatatctgaagagagcgatcatgagtgagcatatcgcggtgcagtgcagtttgcatctttgttcaggtcgctgtccatcgattttaatttcgcacaagtcaaacccttttaaaacaatgcagcatagtgatcgccgaaagagagccatgctgcctttactgccaagttaattatgatatattattagcactagagttcatgccagttgacttgaggttgtcagattttaatcgatttggtgctgatttgtggcacggatcatcgcagcaagtcaaagcaaaaatcgaaaagtaagtttaaaaaattttcaaagttcagtagagtaatgggtgggctaggatcacaggggacacataatcgcgtgggaaaatccttgaatattcggcgcgaaataagggatccatcgatcagtagacgcatgatcttcatgagcttgctttgaagcaactggatgctgcccaaaagcaacatttccggtgcatgatctccagttaatttgatgcatgggtttcttgatctgacagtgtttttttcataaaaaaattggaagagaactggatctgatgatatgtgtccctatcttgagatgacgtgtatgtgtctgtcaatttcttgaaacaattttttttttgccttttttacattcacagaggcattgacttggtgtgtacaattagctgcatctgaaaagagggggaagaaatgtgtgaaaatctttttttttatctacctgatagttacacttgcgttgctgtctgaattgataattgcctaaaagtcaggtcatgtgtgctgaaactgttagatggatctccctccccttgagcccaacggctcaagggggccttgacccgcgccctgatcgggggcgcccagcccaatggctggtgggcccccgtcacactgtgccatataaagaggggtggaggacgggacggcataacgacacaaggaacgaggttcgtcgccgccgccgccactccacccaaaaaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacactaacaatggtatcagagcaatcctagcgtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtggggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgatggcgccgccgtgtcgccatgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccaactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtattttttcatgcaaattacaatagaattttgaattgtcttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatacgacacagctgataaagcagcttgttacagagaggtaccatggaggtggtgtaaaataccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcttgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactacgcaaagaagtgaaagatccattagagttgccaatggagttgaagcaaaagttgaggctgttggagatcttcgcctagaactcgcgaatggcttcacacttttacttccagacgtttttatgtcccttctttgcaaagaaacttgataataagtgtatccaaattggattttgatagatatgattgccattttggaaatggcaaatgtgaactatggtataataatgaatgtattggtcttgtgttgcaagatcagctttatttctttctgagaatgtgaatgttgtgtcctcgttgacaaaagaaaagaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccatatgagctatggatcctccgtgtgtgggggagtcctgcaaaggataaagtatttaacccaaaacagtaagctgccattttattggctaattctgaaagatcaaagggtcatcgtttctactgtccaaacagttatacaaagtttgtagaaacaagacacgtcgtcttcttggaagacgaaatgattagggggagctcggtaattcgagaaattgatcttgaggagaggcgggtgtctgtacccgctccgtcgactcaggaacctttctaatgttgtgccagcaatgcatgacgttgcggtaccaacacctgttgttatctctcctgtggcaacaatgaatgaaagtgaagaacctattctacaggattcaacagaaattattgccacatcagaggaggagctgcaccagcctcaaacatataatgtgccagaataggaggcccctagaaggcctgaaagagtcgcatatcgaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaaaggcttcacgcaacaagaagggattgattacaatgagacattttctccagtctcttgtaaagattccttcaggattataatggcactagtggcacattatgatttggaattacatcagatggatgtaaaaacagaatttctaaatggtgatttggaggaaaaagtatacatggcgcaaccgaaaggttttgtcatgaaaggaaacgaaaatatgggatgccgtataaagagatccatttatgggttaaagaaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaaagtaatccaggcctagagcactggaaattggtatagaaagtcttgcgtgattgcaaggaacaaaaggcctcatcatgtcttacagaaaagcagaatcgctccagatagtggggtattcggattctgactttgcaaaagataatacaaagttaacatcgggatacatgtttaccctggcagtaggagctatttcatggaaaagctcaaaacagacgaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtctgggatcaaacaatcagtcttgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaatggctcaagggggccttgacccgcgccctgatcgggggcgcccagcccaatggctggtgggcccccgtcacactgtgccatataaagaggggtggaggacgggacggcat

SEQ ID NO: 55509 - DNA, 4136 bp, Oryza sativa
aggaacgaggttagtcgccgccgccgccactccaccccaaaaaccctaaccgatcgagggggcgcagccagtgacgggaagactccaccgccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaacactaacagaaactaggcccgtttggttgttctcgagctcacaaattagtactatttctttaaaaataacttttttttaattataaaacaacatatcaactttgtagtgggtactttattgatgccttcaaaattatcataaacttagagtaatccatcattaaaaaaaattaatcgtttcggctataactaagcttatcatcaatgagaaaatgattcatgggtaaaaattttatatatgtattcttaccaattttatataaaactaatacgaagtaatacacaacggtaaaaatcagctctaaaaattaaatttaacaaaggatggcgtgtgttacatatttcgcttttttaacttccactcctattattttttgtgcgctacccaaacagttaaacgatattttttttttgcaaaatttgatagcaacgctgtgtctgaaaaatcatattaaccattttcttaatttttagctaataattactaattactaagtaatacttcctctgtttcacaatgtaagactttctagcactgcccacattcatttagatgttaatgaatctagacatatgtatgtgtttggattcattaacatctatatgcatgtgagcagtgctaaaaagtcttacattgtgaaacgaagggagtagtaatttgttaatcctctgtttcatttttgcttagggatagatttgcaattaaaaatactccctccattctgtaatataagaaacaaccacttttcttagatgttccatgataaaaggcatacaattaattatggtatcttttccattaaattattaccttttaaatcctccactcccatgttatctaattctattgaatgcatgtattatattattaggatgattcaaactataagataataataattatttcttgatttttgagttaaggatggttgtgccttatattttaaaatggagggagtagttggaccagatgagaagtattaccaggtctgaggcctgtggtgcgcagatctttttctccagggagccgtaggcgaatgttccatctctcctctcctcttctcctctttattactgcacgcagagagctccagctcgcgctgctccgaccaccgccgcgccgctcgccgcctccgccaccgcctccgccggcaaaccaccccctcgccatggcctccccctgcgagcaccacgtcccgtacaccctcctgggcgcgctcctcagcggcggcggcccccacgccgccgcgtgcggcggcgccgccttcctccgcgactacgcggagcggggcaccaacgcgctgctgtgggcggccctcctcgccgtcacgtggctgctcgtcctccgcctcgccgcgctgctccgcctctgggccctcggcgcccgcctccccggcccgcccgccttccccgccgaccctggcctcgccgccggtgacatcaccggtaggtttccgtcgtcctcctcctccttcctcccttctcttccctgttcgtgcgagtagcggttggtttggtggtagttccggtgggtacggatgcggagctactgtggaattggatttggcgcgagttcggcgccttcgcagggtagaattattgggcatatggccttctctttttatgcttgctcgggtttccgtgggaactgttcgattgggaggaacgttgccgcagtttgattcgagattcagcaactcatcatcctccagttgctacgcgagcgacctgagtacggtgatttgggaatctgttcttattttgattaattgatgtgggatttgatttagttgggcgctgatctgggtggagttcgattagaatgtcaaatcggctgatttggactgtgtcgaattatttgatctgttttacgacagattcgtgcccaaatttgtagcttcagtggctgtaagcctgtaatatttccgttcctctttgaggaagtggaacctgctggtatgaggtaggggaagacaaaaaaaaaagaagctagtgattgaggtatgaactgtttttggcggatctgttttccagcaactgagcgtgacctataaattgttgcttaatttgttttgccgtttagattctagagtactttttactttttatgtgaggttgtttttgctgaattttcatattttgtaagtcagcaagggaactgaattattaccaagttgaccttgatttgggatatatttccaaaggattggacggtgtagagatctgctacgtattactttgaggtttgtctgattatatgaatatagtagaattcccaggagaattgaattaatactctgtttcctgagaaaaaaaaacacatttctcatgggctcatggcaatcggatcaaatcaaatctgtcatcagtgtatgctgatcttcatgtcaattgtctagatctaatcctccgctcttcaatacatcttggctattggtgctagagaacaatatcggtgcatcatgtaccctatcaaaaacacctgcaaatggtcattaaaaagtgtgaggtaatttgaaaacaatgatactgcatggatctacgctgccacagtttctaaattagtttaacacagggcagaaaattgaatagacagattttagtaaacaataatatagtaccatcctctttttttttcaattatcctctttcagttgattttgcttctttatttcaccttccatgacaaagttcgattttaaactatgtataatgaattgtggtctggtatatccattgtgcctgaatgttttcagtttttctttaaaataaacatttacaccttattttgaatacgatgtacatgaaggtaggatgaaccgtcctaccctgacctgcgccaaactatgatttaggaaatattggacaaaaattgctgaaataacctatctggatgaaaaaaaacatctcccttatatgaataagttgttcattacgattttgccagatgaggattgagttactaacagaattcgctgtgcataaggtaggtgttttgcatataaatataggaatagataggcatcacacgagtattttactaactttaatacggataacttttttttttttgcagggaaatacggataactttttgataccatgctgtcctatgtttgtggcatcatattgtatttctcatttttcctgtttagtcaaatgagcatgtgcgtagactggcctagctcaactctgtagtctttagggcccgattatacaatgctctagcacatggtgcatcaaatactctacataacagatagtcggttgtacattgttacgcataaaaattctggaaagaaatagctaatgcagattttgagcagattcataattgcgatctaccagtatttgttgagtaaaacactaaaactgtggatggtttgatttctgatcatattcccctgaactgctgtatttcaccactgatcatatgttcctttcaactgcattattaaacaggctacctatcgaagttacatggcagttatggcccagttgttcgactgtggctcggaccctctcaactgcttgtctcagttaaagattctagggtaattaaagagttgctaacaaaggctgaagataagttgccgttgactgggaagacatataatttggcttgtggaaaacttggtctgttcatttcctcgttcgagaaggtttgtgtctcaaatgtgataaaataccatatgcagtctgctgtattaatttgtctcgtttgccttgcatatttttggtgatagttatcattcagatggcacatacaattgctgattcatctccgctatt

SEQ ID NO: 55510 - DNA, 762 bp, Oryza sativa
gaagttctttgtgcacacacaaaatcgtaaaagtaaaagctgaacaaaacacaatatgtagatcctattattactactaaaaacaaatagaacaatagggcataagcataccagattcaacatcaaacgagccgatgtcgtatgaatgacaagggttagcgaagaatcatgcatattccgagagaacaaataaatgatccgcgatagctgcacaaaaatgaggtcactacgttaatgacatctgaacatagaagatcaacctccaagagtggagtttgtactggtgatagtgatatcacccccaatgaagtgcctagttttcataatcttgcagaatgctggatcaagaaaaaatacagtatatttctgcgtctgaatcagcaaaagagagatgtggcacctactcaaactaatgaactaattgtttgagcaatgcattgttcatattgaattacagatggtgtttgcctgtttggcagttccccgtgcaaaaagaatataataaattgccttcctaaacttcaacaatgcaagtgttgacattcttacatagcaacaccagactaacaaaaaatgagcatctataaaaaaaatacatggttcacaaattacacaaactaaggaattctgcaagaatcaagattaacctgcggaagagaaaggtctccacgaacataatgcaccagctcggcaagaagggtataggcaagaggtctcaatgtctcgatgccaactcggcctgtgcctatcaaaccctgataa

SEQ ID NO: 55511 - DNA, 4854 bp, Oryza sativa
  unsure (1)..(4854): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaagttggatgcacattatgaaagattagcatatttctctgcttccaaatatgccagcaagaatggactcatagttttcatccactaggataaaaggtatcctattcgcgtatataagattttaataggattttagtaaggctaggattataactttacttcattgtcatgtcaaaaaaagttacaagaacatcatgaaagcatttttaataacaagatcactagcttctatctcttgggaaatttgacctctccgtatgcaaaccgggaggagatcatgcacggtcatttccgcccgttgcttgcacgatcaacgcgatcaattaaggttacttattagcacatgattaattaagtattagctaaacatttgaaatatatattaatatgatttttttacaataactttcctataattttttattacaaaaatcacattgtttagtaattcgggaggtgtacatgtggtaaacgaggaagtgaaggttgggaatcttcacttaagaacacgacctaacacattgatcggtaatgccaaaacttgccctcctccctcagcaacatattaataggggagatcaatgctgtgtcgtggtgatagtcacttcacgataatcttctgcccgaaaccataaaacctcttacgaccccaattacttgtgttggagggagaacttgcgattgtcctagggcattgtagatggccctcggaaggcctctatggaatcaaaccgcgatcactttgtctgcgctactgctataacacaaatattgcactaatggcttacctatcagttttttacttttaaattccgcatatattaggatgataatgtttaggctaaacaattagattagtatattagataatttacaatatcatttttatgtaccaaaactatagtatttcatctcttttaaatagtagttgtcgttttaattagcttttgttttaagtcgatcattaaattataaagatatatatagttttacattacaagattaatttatattttggatatactatgcgaaatactttcttcatatataccacataattttattttattaaactaatgaattaacatgaattgatagtcaaaattaaagatgtctatcttagaacgaagctaagacgataattaattaatttgagtacgtgtctatgtgaccggccggtaattaaggcgcaagagtaaattgatgcagtaggtaatcgctcaagcatacatatcttctgtgctgcatttcacgcacaaaatccgatcgagcgagtctgatgccaacatctactaattcagattcttgctagctaggtatagctcgggcccaacgcttggtgccattatctgaaaatgaaagaaagcatggccacacgcactaaaaattcatccaggaatttttgggcgtcaaaatacatttcatttgcgttgaatggttttactactcgactggtcatatttatctgacgtcaggagtacatgaaattgataagttttttttatgagtacaagttagaacgcgtgcgtgcatacataccatacccatgcctatgtacacctttgtggtgcatatactagcacatgccaaataaaaaaaagatccgatatcacatagcatgggtatgcacgcccgtgtgcatgtactccctctgtcctaaaatataataatttagaacccggatgggatattttctaatactacgaatttagacagacatattaagagaactattttgggacgaagggatattgctgtacatgagattaaattttagtaaaatatgagcacatgtgaaaaatagaaaataacgaatcaaactaaaagtcgcaagttaaattaagagaactattgtacataaagaaaaccttacggagttaaaacaattacgttaagataatacaattagactgctcctagcctcttcacaattaggatgaacacaatctatgccttttttttttaaaaaaaagagaaggacgatatgatcacaaatgtgatggcactagtacagaaatcgttttttccaggcagcccaaaaggcattttcgcgtgtggaaggctgacctgtctgcccaggatggtctgtgaagatcatcatctttgcgtgtgggctgctcaactacacacgaatatatatattcgcaggcaggccgcttaacgcgaccgcacacgaagatcgagtatctttattttacaaccaaaaaggtttctttattttacaactaatatgtacatcattataattaagatagtatatattgtactcattgtacacaatcttatagctcatccgttatataaattaatctaataactgacaaatataaaattttaggtcgaccactaattaacaaatagagcaagatgtacatcttgatttatatattattctactacttcgcaacctcaaacccttttgaaactgtcatgatcttgtatcttaatttctggtcctactataccccccttttctttttctttaaaatgaaaagcatttatgcccttttttctggctcactgtacgtcacactgtatactacgtgagatgctacaaacagggcttgactcgatcggctgtcccttcttcttttccttgatgaaagaaccctgcaactgacaaacaggaaaagtttggagaaaaaggcagggatcgatgtaaacttgctggagcttttcgatgcagtgagaaggtcgtagctatcgatcgatttcctttctatttcttttaaaagaaaagaattcatttgagacattgaggtagctatcgatggtgcaatggagctagctagatttctccttacattttctgcctttcaagtttagatattcccatggatatatatggagttggaccatggttgtaaatgtccgcggtgcgcaattctctatgtccatatcatacttcctctataaaaaaaaaaccaatctaaaattggattctttttacatagctggattttttttacataggtttagggttagcctcggaccagatgaccaccatcggttggcatatgctatagcatatcaacacaaccaggctgatgcttatcagcataagcttttctatcatctgatgctacagtccaaggagccaaccaataggctgtagctgaaaatcagccaaccgatgaggccgataacttcttatttggcctaagagaaaattatatggtgaaaatgtatggttctttatgggctttcatgcctaggccctggaccatggcccaggtggcccgggatcagacattcagaactgagaccgtcattgaccagagcttctctcttggccggcctttaatttgtcgctgccgaattcttccacaatcaacgactgttcgtcatcactaacctcgcggcacagaaggattaattcgtagcactaatacagaattgattattactgcaatataacagaaaaataaatcagtaacaattctaaataatttaacactgccagattaatttaccattcatcagcaagcatcgatattgaaaaccaacctttcatggcctgcagatcaaacacataacccctgaacaatctcgttgccatcaatattcggctcaaacgccaaagagtaagggtgcgatcctgatcataaacctcatccagttagctggataggagatcaagatggaaattaagtcgactaattgcaatatcgcgtggttatcttatagatatcgtgatgatctcgtggtaactttctcatttttaaaacctcatggttttccacgataactaagtaccgtagtaattatcatgatatcgctgagtagcagtagccatcataaaaagggtaaggaagacgatggctgatgcaatcgatctggtgagctttgaactgaattaatcaaaattactagtagttaattactctatttgtttcatattataagccgttttgaaattttggttaatttaagtttgattaagtttataaaaaatatagtgacataacataaaataaatatattatcaaaatatattcaatgttagacttaataaaaccaatttggtgttttagatgttgccaaattctttttacaaatttaattaaactttgaaaaatttaactaggaaaacaatcaaaacgaaatgaaacggagtaagcgctatcctgagactttctgatcaggcagctgcaggcaacaaagcgtgttgattcagcaattaactgcgatactatcattattatcaactttacttttaattagacattgtcataacacacatgcatggatcattgaaaaattaataggccatttggaacaaatatacgaaagagacccacttataattaattaagttttataaaaaagtaatttaaaaagttcggaacccttcccacccagtaaaaaaacgaagcagtggattaacttattaattaaatattaattaatacgattttttaaagcaactcgaccatataattttttataaaaaaatacagtttagcacttgtgaaacgagagaaagatgaaaaagatcggcatgcatgacaggcatgcactaaaataatctaactaattactcggccaaccggttgctgggaacataacttgaatc

SEQ ID NO: 55512 - DNA, 1745 bp, Oryza sativa
acatgtttctagcttccgatctgaccattgtatgttcttcaatgcagtacgtgtcaatgggttaccctgcaaggatgcaaaggatgtgagtgttgatgacttcttcctagcagctaaccttgacaagccgatggacacaaccaagagcaaggctggatccaatgttacattgatcaacgtgatgaaactcgcaggtctcaacacccttagcatctccatggcaaggatcgactatgctcccaaaggacaaaacccaccacacacgcaccctcgtgctactgagatcctaaccgttcttgagggctcactctatgttggttttgttacatctaaccaagcaaacagagaaaacaagctcttcaccaaaacacttaacaagggtgatgtcttcgtgttcccacagggtcttattcactttcagtttaatccaagctatgataagcctgcagttgccattgctgcacttagcagccaaaatcctggggcaattaccattgctaatgcagtatttggatcacatccaccaatttcagatgatgttcttgctaaggcatttcaagtggacaaaaaagccatggattggctccaagctcagttctgggagaacaaccataactaaattattgatgcttgataaggttcagaattagtgattggtataaaaaggatttgttgattattatattagccaaaggctatatacttcatgtaatcctaaactcgatatttatacaattctttttacgaataatgtataacagtacgcacatatatatgttacattatgtatggtctggggtattaatttaatatagttgatttcttgggtattttttaacactcataaagatggataattaaaatcatattatagtagggatgcatttccctcgttcaatacttatatttgttatgtagctcacatgatcatagtactcatccaaattaatctattctttttcaattcttgtgattatcatgaaaatttgaacgcttcaaaaacatataaaatttgtttttagatgtgaaccaaattcatttatatataaccgttagttactgacaaaaccaacaaaataaattcaaacaaattatctacaaatgaatttttgtttgatttttttataactagcaaatctaaaagtatgataaacatattataatgaatcaggaaacaattgtgtttcacgtatcatcatgtctgacaaatcataattaaaatttccaaatacagaaaaaaagaaaaatctaacaattcaccatcgcccgttctcgtcgctggcattgcttaaactcatgcctctgacactaattaagttgtagtaaaaaaaattagaagatttggtttctgctcgtatgaaagagtacaataataagcaattttgataaaagtacatatactacacgtaattcaattggtcatatatccatcatatctctattattataaaaattgaatatgtttttgccggtattttgttatatcatccgtgtatgagttggtttttaagttcgtttgcttttgaaaataaatattcgtatttgaattggtttttaagatcgttcacttttagaaatacagaagaaaccatataagaaatctgtttaaaaaaaactcgcatactaacttgagacgatcggacgtctaactgcagctcatgattttctatatatatatatatatatatatatatatatatatatatatatatatatatatatatatatatatatatatatatata

SEQ ID NO: 55513 - DNA, 1796 bp, Oryza sativa
agaatgacgagcagccggccgatgtgatcgatcgatcgatcagccggtgatagagctttgaactgaaataatcaaaactacaaattagttgaaactgtctcagggcaacggggagcatgttgatcgattcagcaattaccgatatcctttttaattagcatgcatgtgtgctagctcttgaaaaatcagaccttattatattgatgtaacacacatgcatgcttaatacgcggagatcattgacaaattaaaagggccatatggaacaaagttactaaaggagtaaagaggccaagtatacgtacgttacatagagagaagacatggtcatatgtttatctgcacctgatactgtataacacagccaggcttcatcatcaatctaatgcatgcatgacaggcactaaaataatctaattgattaactaatcggtcaccgtgttgctgggaagacaacttgaatccatccactaatccatcaaattaaataagttcttgcccagatgcaaatctatcaagaccggttcagactttagagcagatgaacaagtcgttagttcagcctttttttatttttcttattgaccacttcagaatcacctcattctcagaggcctatatatatggatgcatcctttcctggccaaaaaccatcagctagctgtagctccatatacacaacaagctagcatcgagtaatacttctgcagaagcaacagttccatcaacttaaacatggcctcctccaacttttttcttctcatacctctcatcgctttggtcactactcaggccatggcttctgatcctagtcctcttcaggacctctgtgttgccgacaagaactcaccaggtatagtttttcgtcatcgatcatccaattgcatcaaattgatgattatctcaaacatccgtaatgtgtatatataagtttctaggtttctgacccatatatgtttttcaatatgcagtgcgtgtcaatgggttcccttgcaaggatgctaaggatgtgagtgtcgatgacttcttcctagcagctaacctcgacaagccgatggacataaccaagagcaaggctggatccaacgttaccttaatcaatgtgatgaaacttgcaggtctcaacacccttggtatctccatggcgaggatcgactatgctcctaaaggacaaaacccaccccacacacaccctcgtgccactgagatcctaagtgtaattgagggctcactttatgttggatttgttacatctaaccaagcaaacggagaaaacaagctcttcaccaagacactcaacaaaggagatgtctttgtgttcccagagggtctcattcacttccagttcaatccaagttatgataagccggcagctgctatcgttgcacttagtagccaaaaccctggggcgattaccattgctaatgcagtatttggatcaaatccaccaatctcggatgatgttcttgctaaggcatttcaagtggacaaaaaggcagtggattggctacaagctcaattttgggagaataaccataactaaattaaattattgatgcttatctgttgaaaattagttatctgtagtaaaatggtttgttgattgttagtagctaaaaattgtatacttcatgttatcctaaaaatatgttatttgattctttttacgaaataatgtataccactacgcacatatacatatgttacgtgatgtatgatctgggatattaatttaatatatttgatttcttggtacctttttaacactgaatgatacataattaaaatcatattac

SEQ ID NO: 55514 - DNA, 911 bp, Oryza sativa
gtttagtgagcggtttataggtgtgaattgtttaataactagtgaatggtttataggtgtgaaccgttcaataactctaataatcaacatgtagtgtcttactttcaaatctacgattcagtagaggtgacgatacacaccactcgagactcaagagtttattactcttttgaatgtagtaatttcataagattttcacaaaaaaatcgttcaattcttacgagtatacttcacaattaccacgcacgttctaaagaaccccttgaaggccatctgatcctaaatctcatttggccaacaatggagttggtgacctaatcgatcgtacatgaaacaacattacaatgaactgaagacaaaaatatgaaacaacattaaaatgcctagtacaacattacaatctaacaaaaagaaacatgaaaaacattggcttaaacattagaaattttaaacattaaaaaaactgtatcggctatatctgacttcctcctcccctccaatggttggatcgggctttcttcgacaacctcaaacgctgcaatgtgatgacccggtgattctttctataaatgaccttgacttccttgttgtcaactgcgatggcatgaccaccacttgctccgtccgctgcttctctacgataggtttccctcctcctcgctgtcgtcgttgtagttgtcctcccgttgccatcggcatcggctacccttatggtgacatgtcatcatcgccacatcaaagccttggtgggagatagagacagacacacagagagagagagagtagagtaatcaagtgcgcgataagggggagagatgtgagtgagacaagggagagagaaatgattgaatgagtggatgggaatgattggcaggaagccggtttttttctcctagatccagtgcccagct

SEQ ID NO: 55515 - DNA, 1133 bp, Oryza sativa
attgatctggtgagctttgaactgaattaaccaaactaccaatagttattagcttgaaactgtctcggcagctgcaggcaacagagagcgtgttgatatattcagcaattaactgcaatactgacattatcaacttcccttttaattagcatgggtgctagctcttgactaattaatcagacattcagacgttatattgccataacacacatggatgcctgaatatgcggagacgaaagggaccaagtatactttacatggatagagaagacatggtcaatctactcgttaacgtacattcacggttatttttgttacaacttgaatgtcatattaaacttgtattgtatatttgtaaagagatatattttaatttaatttaattatcttatcatttttttaaatcttcttgagagataaaaatccatctccctatctttatcataatatgagcctgttcactttgatgccattttctgataaagttgctaaaattttaactacgtttagtttgttgctaaatttttagtaagcacatataaaatcttgccaaaatttagcaaccttgttaaaattttagcaaacataccaaaatttagcaatgctaaaacttggtaaggttgaaaatggtagtaaagtgctctgtgtttctattcacctgataacaaagacagccaagacatcatcaatctaatgcatgcatcatgcatgacaggcactggaataatctaattaattaattagtcggccaacctagctgttgactgggaattaagatagcttgaatccatcaaattaaatagtttctttcccagatgcaatcattaagagttcaagaccagttcagacttctgaggagatgaacaagtcactagctagctcatccttttcttattgaccacttcagaatcatttcatgctcagaggcctatatatatggatgcttccatggacaaaagcatagactacagctatacaagaagcatcgaccactacttgtacacaagcaaaagttccatcaacttaacatggcctcctcgaacttctttcttctcacagctctcatcgctttggtcgctactcaggccatggcttctgatcccagtcctcttcaggacttctgcgttgccgac

SEQ ID NO: 55516 - DNA, 3195 bp, Oryza sativa
agactccacggcacttaatggaaaatggaatggtcaactagcttctgcaacatctatagatggacacaactggatgtttccagttgcatttggattctttcagagtgagaccactgacaactggacttggtttatgcaacaacttaataaggcagtaggcaatcttccaaccttagctataagctcagatgcttgtaaggggctagagaatgctgtgaagaatgtttttcaaagggcagaacatagagaatgcttttggcacttgatgcagaatttcataaagaagtttcaaggtccagtgttcgggaacatgtaccctgcagctaggtcttatatgccagaaagattttatcattacatgaataaaatttatgaggcaaattcagatgtgaagccatacttagaaacctatcacaaattgctttggatgagaagcaagttctcagaagagataaaatgtgacttcatcaccaacaatttagcagagtcatggaacaaatggattaaagatatgaaacatcttccaattgttgagcttgcagatggtattaggtcaaagacaatgaatctattggctaggaggaggaagataggtgagaaattggatggtgtgatgctatctattgtggtttgtcaactcaatgcaatgactagagaactgggccacttgaaggtagttcaaggtgatagagaccaagctgaggtgactgagatcactgctgaacatcagattattagacatgctgtcaatctagtaaaccatacatgcacctgtagagagtggcaagtttctggtaaaccatgcccacatgctttagctctcataatatcatatagaaaccctaacatggctgattatttagatccttgctattcggtagaaaggtataagcttgcatacgcaggagttattttaccacttccagataagtcccaatggccaaaagtgaatattggttttaagttgttgccacctcttactaagagggaagttgggaggcaaaggaagaaccaaatagtcgggtgccttgataagggcaaggctaggagcaaaggcaagtggcaagttcaatgtaagagatgtcttgccatgggccataggtcgacgtcgccaaaatgtcctttgaatggaacgaagaaaaagtaagtgtataaattgtcatttgttttagttctagcatatttatttgtttcagatctagcaaatttatttgttttacttttgcaggccaagtcgggccaaaaaagggagaccacttagtgaagcaaattgtgcagcaagtactagcatagaaggcacacccaaaagacagaaggtaggcccaaatggttcaactaatactagtccagggcctataacaagaaggtaggcaaaccctttttcttgtttctgcacttgattcaaaaaatgttttactaacacctaattttttttaagtcaatcggcattgacaacaactggtggagaaggaccaatgaggcagatgacaactcctccaaggcccactagagctgcaaagaagatcactccaaagaaagggctaaaaacgagtgctccttgattatatattctcaaatatgggaactattagattatggatgcttttgtatgtgaaccacatgactgtgcaagttgtggcttttattttgtaatctgaacttctatgcctggattatgtattttggatggcattctctgacttgcttacttagaggtgcttgccttggagattgttttacttgctatatatcatgccaaaatatggttacatgctgttcaaattggaaattctgggtatatgctgtcagaattttgggtatatgttgtcaaaattttgagtacgttgctgtcaaaaattacatatacaaatttttggtgtatgctgtcaaaattgcacagattttaggtatgtactgtccaaaattttgttctcacatggctcaggtaaacaactgcaacttgaaaatatgcttcaatctctaattgaaaaaacttctgtaaatcacgattgggaagattgaccattctctacgcatgctgtgaaaattgtctgcacatgctgtccaaattctcagattgcacatacaaagtgatatttcatcgaaattgtaaatgccaattaacaaacatgctacgagttgaaccatcaaaattgtctcagtttgcaactttccatacaaacaatgcgttgatacaactagctgaaccatcctactagcaaacctgcactcctggaaattttctgattacaatcaacttccaaacagtacaaagtataaagtttttggtaaagcaaattgtttgcagcgctggagtcgacggctcaacgcggtctggtcaaagacttcaggagaccgacgggaggtgggggagccgaccggcgcaggcgatcttcgcggtgagggcgtcgctcgaggcggggcgcggtggcgcgacctgaggtgggggacggtgctgccggcgatgcgcggacagagcagcgaggtgcggggacggggcgcatactgggcggcggggggctgagctgcgagcggcgagcggcgagcggcgtcgcctctccgtctctcggtcggccgagaggatgaaggggatcgatctgctttcctgggaggaggaggctatctctttactctcctgacaggtgggcccatgggtaaatccgtccgatcaggtgagaaagatgaaggaaaatattagaaatctgagaaatttaggaaaatagagaaaaatggcatggaatgaaggaattcgtgcttccaatggcatattctgaaagtcacgcgaattgagtggcgtatcctgaaaacggtgtgaattggatggcatatactgaaaaatctcgccttgatccgattctctttcatttttcgcacgtttgccatagagagtttgatgaattatatgaggcccgagagagcatgcacgatcgagacagaaaataataagtggatgaactcagttgggtactatgcacgattgatatatggcctagctaaggatgctttaaaaaaattgaaaatatattatttttaccgatacagtagaaatatactcgttttagaataattggcatcattataccgttgttgcgtctataggaaagcgaaatcgctgacatgctggtggatgcgcgcgagttcctaccaccaacgtgcaaactcgtgatgtcatcggcgcaaaatcatgcaagtaca

SEQ ID NO: 55517 - DNA, 28741 bp, Oryza sativa
atgtcaccaaaaatgtcacggggaaatgtcactgaatctgcgtccgtgaacacgtgtgagttcatgtgtgcagcgtgcgtacaccgagttgacagtggtggggggattgtcgagcgcacacacctagtcacatgtatcgggagcacgagagggcgggagcggcgtcgcgcgtggcagacgcgacgacaataagtaacgctctcgcgtcctcttcatgcaaacttgagacggaatcgcgacctcctaatcacgacaaaggtgatctaatcctgtaattcttttggctgtagttataccaacgcaaaaaaaagctgtaaacaatatattattttcttattaaggatgtgttcatttggaattgttaatccttctcccagcatgtaaaatggaacaatagatcaatatatgattaattaaatattagctaaaataactttaaaaaataatcaatataattttttaagcaattttactgtatatttttttaaaaagaaaatactccatttaacaatttggaaaacatacgtgtgaaaaaaagaaagtagaagtttggaaagtgtattatagaacacaatcttaagacttggtaagacttaagactttagcactaactcatgattgtcttgatatcttctgcatgctttctaactattccctccatctcataatataaggcatgatcaaatttggcacagtcttcaaaatacttaattaggctgtgtttagttcctgaaaagagttggaagtttggggaaagttggaagtttggaaaaaaaaagttggaagtttacatgtgtagaaaagttttggatgtgatgtgatgtgatggaaagttacaagtttagagtagttggggatgaactaaacacggtcttaatcatgcaataatatgagcttcgttttgcgtgtcggggaggaacccctcctcccgaatacaacctagctaagtgagcctaaatattgtttagggtgtaaagcataccaacacaatagttcggggttgcaaattagacttttttttcttaattttaaacagatttcgctgctttaattattttagcggatgatctggtggcacgctttcatcgacgctagttaatcgatctgtacttccatggacactccggcggccgccgactggtcggagcttccggccgacgtgctcggcctcgtcctcctcgagctcgagttccccgacctgttccgctccgccgccgtctgcaagctctggcgcgccaccgcccgcgacatacgccgcctcggcctctactcccgcgcgcagacgccctgcctcctctacaccaccgccgccgccggcccgcgcgccgccgtgctctacagcctcgccgacaagacgacgtcctacacggtccccctcccggacccgcccatcgcggagcgccacatcgtcgggtcatcccacggctggctcgtcaccgccgaccaccgctccgagctccacctcctcaacccggccacaggcgagcagctcgacctcccacccgtcgccaccatcgaacacgtaaggccactctacgacgacgccgggaacctcaacaactacaagttggtctactacgacggcggcggcaacagtcaccggagcaacgacgatgacatgcacacggtgacgcacccgccggagacgttcagggagttcttgtatctcaaagccgtcatctcctccgacccatcgcgcggcgacgactacacggtgatgctcatccatcacccatatcttcagctctccttcgcgagatccggcgacaagaagtggacatggatcaagatggggaacaatgagtgtgagtggttcgaagattgcatctaccacgacggcgtgttctacgcccagaccgttcacggcgccatccacgccattgatgtcgtcagtgcttcttcctccttcacccatagactgattctcaagccgaccatgggtgaattgggcaccctctacattgtacgtaccacggaaggtgacatcctgcaggtcttgcgagtcacggaagaagatgaaggtagcgagcataaggacgtacgaacaactgaaatcggggtgtacaaggttgactacaagaagcaagatcttgatgacgtcgatgacataggtaacaatgcattgtttattggcactagttactcgatgtgcttgccagtgaaggattatccacacttgatgccaaatcacatatatttcgacgatgactacgggtacttggttcaccgtaaacatcttcgtcgggacgttggagtttatgattatacgaatgacactgcgatcgatgtggagtatcctcagccgtggctgaattggccactagctccagtttggattactccaagttttactaaaactgcaaaatatagttgactatataaatgcgtgtaatgttaccctttgtgtacatttttttagtaaattttataaaactattgatactttaactaaattatcacaaaactgcagatttataatgatgtatcataaaactacttcgttttgttccttattaagtgatgtttcggacaatgttgaggtcaaacttttataattttgactatcaataactttaaaaatatttagtttaaaggaactagaacaacatatataaatttatcttttaaagtactataataaaagtaaacatacatttatttattatatatattatagtagaaaaataagatcaaacatatatcttgtagaccgtgtcattgtctaaaacgccaatcaaaatgaaaccggagggagtacagctttaataataaatttatcacaaaactacaaaactacaggtttaacactactagaaaaacaatttttttatggcattaccctataattgtcgctggtggctatatgtaaaaaccgctagcaaaaacataacgaggggtggggggttatggactaccagcgaaaaccgattttcacgggtggtcatgataagaggtcgaccataaaaaataactctattttttgaggcggatctcttaagtatccgcattttcgctggtagtaggtaaagagtactgctgcaaaaaaaaatttcgaggcgaatatataatcccaccgaagatctcagtctttccaccccacctacccttctccatctccctcctatcttcttacccttctccaaatccactcttccatcctcctccctccccaccgaggcgcaggcgacggcggctccggcagcggcaaaggggatgggtggcggcggtgaccgggctcggcggcggccagtctcggcgacgacgacacgtgggcgatggatccggcggcgggctctccttgtcctcctccctcctccaccgctgccagttgccgtcgccaccaccgctgcgggctgccatcgcctctaccgcctctccgccgcgagctcagggccggccggatccggctgccgcgacgtcgggggtggccggatccgctgccgcgtcgacgggggaggccggagccaccaccaccacgacgggggaggtcggatccgccgccgggtcaacaggggaggccggagccgccgccaccacgacgggggaggttggatccgccgccgcgatgacaacgtgaccgctgctgggccgcaggcggcggatccggtcgtgacgagctcctccccgtagagggtgacgagatcggcgtattgggattggaattgtgggttggaggattgggattggggattttagggttttttttttttttgcaggaatgtgaaatgtgatttttcggtttgtaagttcatttgttcttgatttctctctaccgttctctgcttgcttttctttctcctagagatcgatcgataattatttgagctcttatggtgcatgtgattgtttatgccagcaaaaagagcatgggtaagtatctgtggaaatttttgaatggtggagcgttgacggggctgacggagcgccgcttttttttttttgaaactttgcagtattaacactggcggctcacagtgtaaccagccagcgataattcattttccctagtggcctatcttaggctaaacgccagcgaaaatagatctttgctggcggctggcttaagacgaccaccagcgaaaatgaattatcgctggcgttcgataactgctagcgaagatcttgatttttattggcctttgtttgtggcggctccaaattccgccagcgaaagccaaaatggccgccatgaaagatggttttcgtagtagtgtaaggctaagtatcacaaaactaaaaatttaataataaaattaccacaaaactgtagagtttggggtttaaacccttagcactaatgttatggttaagttataaactttcaagttttgtgattgaattgatgttaaacttgtagttttgtgataaaatttgttattaaatctgtagttttgtgatactccaccttaaatttgtagttttatgataaatttgatgttaaaactatagttttatgattcatatataacttaaattagtttagtgaaatttactctcttttttgttgatactcaaattgaagcatcagaattctctggccatttgattaatcgatttggatggaaactttaatttgatatccgatttgtcctccaatatatcaacaaaccagagtgctataatatgctattatatggattctttttcctcgttttgctatttttgttttgagtaaaatgtagggcggtccttaaacttgtaggagtgtgtcatttaggtccctaaactcttaaaatgcatatacaagtcccagaacttgtcatagtgtgtcatctaggtcccaaatgaccacagccccttcaggatattacgtggcgttgatgtgacatgccacacggacatgacatggcattattttaaccgacaaatgggacccatttaatttctctttctttttcttttgtttctactcattttttccctttcttctcttttctatgtgatccgtgtagaagaaagggaaaaaaaagaatgattagcatacaaaaagacatatagaagaagagaaaaaaagagaaaaagacacgccacgtccacgtggcattgccacatcagcgccacgtaggatcctagaagggatgtgtcaatttgggatctagatgatacactttgataagttatgtgacttggatatgtattttaagagtttacggacctatatgacacaaccctacaagtttaaggaccgctaatgcattttactcttttgttgtctactccctccgtttctaaatatttgacaccgttgactttttagaacatatttgaccattcgtcttattgaaaaacttttgtgaaatatgtaaaactatatgtatacatataaatatatttaacaatgaattaaatgataggaaaagaattaataattacttaaattttttaaataagacgaacggtcaaacatatttaaaaaaagtcgatggcgtcaaatatttataaacggagggagtattgactaacgaccgacaactttttaaatctatgaattttgtactccctcctttttatattgtaagatggtttgccctcatctagatttaatagcatcaatataattttatatacatcttatcttaactacttacaaaattgataactttccattagtacactgctggagaaacccacaatagtctcggtttgcaaccccctttagtcccatgttgaccacgaatccaggtctaaagatgcgatctttagtcccgattggtgtgttaccaactgggactagcgctaccttctttagttttttcattgttttttgttgtttgcatattgattttgaactaaactcaacaataaaatcatccacgttcatagaaacataaaaaaatcatccacaaattcagagatcgaatcaacatactcaaattgttataaaaaattcacatcacaaatttacagatgcaaaaacatcacaaatcatccacttgtctacgccggagaaaaagtcgcgcaggcccacggcgccaggccaccttcgctcgctcctcgctgttgctgctacaagaaaaggagaggataagagagaggagagaggaggaaagggaggaggaggaaaagggaggaggagtttgtaatcgagaaggagaggataaatgtgagggattatatcccacacgttgatttagtcccggttggtaatatcaaccgggacaaaagatagtaggggttagacgttttttgatccgggactaaaatgatctttagttctagttaatgttgttgggcttttcaaccggaaaaaaaaagatgtttagttcctgttcctattggaatgggactaatatgatttttggctgacccagtagtggtaacaccttatttttgtctgtcaatcgtccgattctcaatctctccataatagccgactcgggaacgacgagatccggctgttgataaaaactacttcagtttatcccgaattcgttgggatgggaactgagccgaaatccacgggatttagcgcaagattgatggagctttcttgaggaaattgtagaggagattgggaggaacctattataatatccaatttagaaaggggagcaaaggggaggtgggattggaaggagaggcagcgccggcttcgcacgggcacaggggttcggtctggaggagcgagcgggaagaagacggcaatgtggcacgtgggccccgagcgatagagagagaggagggaccgagggaggctcctagacttgctctgctgctgctgtgccgaaggggaaaggaagaaagcaaacaggccgaaaggaggaggagacaaattagacttgaccggagagaaggcaagcctgctggagagagggacagaaaaacagacttcactggaattggtccaagaaggagggaggattttaattacttttccatttaaattaatcactgaaatgatctttgaattttcaaaaacacttaaaatgcttaaataattccaagaaaaatcaagaaaatagttggacactcaaaagtatttaaaaaaatatttatctagatcatttaatgattaataattgtttaaataattattgaattattctttgtattgttaaaattaataaaagaaaatttcagagagtataattaattatggagaatttaataatgattaaatccagccatgttttaattaggaaattgtatttctcacattaaacttcacttgtaaattagtgaacaaaatccacaatcccttgtgagaaggaaaataatattgacttggacattcatttatgttcttcaagggactacatgaatggaaatgatgccggaggaaccagtagcaaattgaatgatagggcagaggtgtctagtaaggacaaaactagtgtttcggagctggaggatggaaatgtttgttcccatcatgggattgaagagcctaatgaagaatcaatgcaaggcattgtaatggaacaagaagaattaagtgattcagaggaagatagccagcatgtcgaatttgaacgtgaggaaatggatgattctgatgaggaccaagttcaaggtgtcgaccccttgctggctcaaaacaaggtaatattgcagtttagcacatatctgttattctagtatcattttactgttcatttctggatgtagaattctactgatttccccattctctagaatgatttcaccaatggcttttaacatatctattgcactctgttgcttatatcatggaaggttacctttgtatgattgcttttgcaatttcttggacttacctgaataaaaaagtgaagcatcacattgtcacatgttcaatcaataattggtgacaacgctgcaattttccctgaaagatctcatgtttgaacctttcttctatgaattaatgcttgcaatatgttctttctcctcttccttttgacatgctgataggctgatagctatagatgtttccttgtgcaggaggtttcaacatcagtgggttgtggggagtatgaaggtagtaataatcagagccagaaccaacaaatggtgtgtttagttcacaccaaaattgaaagtttgattgaaattggaacgatgtgacggaaaagttggaagtttgtgtgtgtagaaaagttttaatgtgatggaaaagttgaaagtttgaagaaaaaatttggaactaaactcaggcctacaggtgagtaaacagggtgcagcaacgcagaaaccacagaggctttctaatgccacaccagcaagagaaaagctgaagggggataatgcgaaacgtataggatctagaacaagcccacgatcatccacgtcccctacaactgaacctaaccaaacgaaaaccagaaggcctaaagctcagcaggtacagattggtgccgagcgcaagtccagtgattcaagaagaagcagaaaaaaacctgctccaatttccagcatcttgtctcatttgcacatcggctacctgtttgcctggccgcaatattctccagatgatagcacggcaatctgctgtcattcgcatttctgtgaacggagcagcaagatcaacattcgaaggtgagaccttgcaagtacatgtccactgttgaatagcaactaagcaagactgaagtggtgttccttgcttcacctctgacaccattgacacattagcctgccattgagtagttaattgcttttgattgacttgactgagtttgtgtcctctccactctccaggaaagtctcagcgagtcatgtgttgtgttacagcttgtaacatgagccaatgtgttaatgtttctgtaaagttggcgtagcgccatggccattgacgctataatgttagtaatgttgattagtgcatggcttatttggttgcacatccatttttcctaccatcacatatcttcaacctgtactgcttgttatttagatagctcactccaattacatattgcaagcttgtaaatatttttcaagaaggcatttcattccttaaaacatttttccccaacggaaaccgttggccggaattgatttcgccttatttgtagagaaatagcatacacagaacagaatgtactgatgtatatacgagggttaacgacgttgtgaaaccgctaatggttagtttgtgaaaactgatacagtatgttttagctgttttttttacggtttttactggtttttggtaaaatggtgaggagcggtttttaatttaaaacggaaaggtaaaccctgggagtacaattcagtcgttcaaagaaacagaaaaaaaatcatcagtgcctcagaggcagaaatcacctgtaatatgtgtataatcattgttgtatgtgtgaagtatatatttccctatttttggcatagctaaattaatcctttattacacaaaatctatggccgtccagcgtaattatgcactcctgtccactcgtccaacaacaacctgctaaatttgcgtcttgcaaagatcacctgttcatataatactctgcagggctcccctctgaaaaaagttgagatttcagacaattaacatcactaggagagaaatcaagaaacaagctagccagcaatggtgtctctccgcgcggccatcgtcctcgtcgtcgccgcctcgtcggtcgccgtcgccttctctcgtacgccacgcaccccgaaactaattgcatcgatcgatcgatcagcaatggcgaatggcgattgaattgatttggatggatgcagatgcggaagggaacgaggggccggacttcacctacatcgaaggcgccatggacgggccgtcgaactgggggaagctgagcccggagtacaggatgtgcggcgaggggaggtcgcagtcgccgatcgacatcaacaccaagaccgtcgtcccgcgctcggacctcgacacgctggaccgcaactacaacgccgtgaacgccaccatcgtcaacaacggcaaggacatcaccatgaagttccacggcgaggtcggccaggtgatcatcgccgggaagccgtacaggttccaggcgatccactggcacgcgccgtcggagcacaccatcaacggcaggcgcttcccgctcgagctccacctcgtccacaagtccgacgccgacggcggcctcgccgtcatctccgtcctctacaagctcggcgccccggactccttctacctccagttcaaggaccacctcgccgagctcggcgccgacgagtgcgacttcagcaaggaggaggcccacgtcgccgccgggctggtgcagatgaggtcgctgcagaagcgcacggggagctacttccggtacggcggctcgctgacgacgccgccgtgcggcgagaacgtggtgtggagcgtgctcgggaaggtgagggagatcagccaggagcagctgcacctgctcatgtcgccattgccgaccaaggacgccaggccggcgcagccgctcaatggcagggccgtcttctactacaacccgccgggcagcgccgtctccttccaggaattcgccaagtgattctttcttttttttttctttcttttttttttggttttttgtatttgatgttgagttgatttgattaacatttcgacgtatgatatgcactatatataattaattaacatcgcaaaatactttttttttcgagaatacataaagggctcgcgtatctttgtattaactagtgggggtggggattaattactatatgcttggacatttttccgttcttcaagattgacgcatcgatcgataaatgtatatatttgtagctaagaaggggtaaatatactaggagagaatacactctattgtcattgagtttgtctctgtcaacgatttgctactgacattgtatgtttctatcagcgatttatcaattgtttgctaggttttcccccgttgttctactcttccgtgtcaaagagtgcatgtcagattaagcagaaccaccagctaatccccttcgatgcgcagccaccgcgccgcaccaccggccggggcttgagatgggaattgaagcacgacggagatcgagactcttctactttcaagatatgatggtatagtcttacataggtgtaggatcgaacagtaagaactaattcaagcagaggaggggtgaatggttgtagtaccaaaaaaacaaaacttttagcggaattaaaagttaccctcgaatcgatgtcgatcggtctgactggaatagatctgccggtctgaccacatcgatgccaccggtctgaccagtatagatcgcccgatctcaccgcccgaagatgccgaagtcgcctgtcgccgccaccagtctgaccaccgtgtactcgctggtatgaccggtacaaagccgtcggtctgaccagtggtgtctcgccggttggaccgccgaacccgagcaaacataaattgaagaactctcaaagtaaatgacaactttattacttatctctgtgtttacaaagtgtagcaacagcactcctcacgaaaatctcgactaaactcgaaaccctaactattctctcaactcaatgctctcaaaagcgataccgagaggccacacctccctctctatttatgcatgaggtagacagcctaaagccacaaaccaaacttatacaagaagtcctaatccacctaggaaaccttcccatacaagaaaccaactttataaactccaattgcaccaaatttgaactccttccaaattcgactccgcatcacatagacacacaatatctccattgtatgccatatagaatcttcaccaaccacgtgcattgatctttagcctaagtatctcgcatgatatctgatcatccggacatcaccttatctccaagttgactcccgatccatcaccggcaacactctcccgaggcgtcaagattacctacacatgaatcaactaagaaaccatattccaagaacaagctatctccaacttgactcattgttagcaaacaacagtattacatacgcatagtatccatctagaagtcataaacacatataatccacggatatccaatgaaacaacccgaaaccgaaaccgacacagagtcggtcggtcagaccactggctggccggtttaaccgcatgcatagcttcagtctgaccggcagcacctgccaggtctgactggaccaaacatccagcagcacctgttcatcacctgcaaattcaataatctccaaaaccacttcgccaataatctccaaatatcaaaatcaataatctcatatgccaattattcatcacaaaataagaatcaaatacactttgattttacaataggtgctcatagagataaagtatgtgtgtactcatagtaggtgagtgcacacgcgttatatgtgtctgcatttgtactatctttctaaaaaaaggagagtgtatatgtggcgtgcacatctttcgtgtaattgagagagaacaaacaatataggaataagtacacttgaggccccttaacttgttaatgaattcgattttcgtcctccaaccagaaaaccagatacaacaggtttctcaattgtcaaaatcagtgccgataactagataaggtccctcgatggtttgcacgacagttttggttgacgtggcgtctatgtggctaatttgattcggtcttcatctgacgtggcgtttacatgacaattcgatctaagaaaaataataaacctcgtgggatccacatgccagtttcacacaaattaataaaaaaatagtgggacccatgtgggccagcccacataattattctcagccctcctcttcttcctcctctctcggtctctctacataatattattaatttgtgtgcgaaactgcatgtgggtcccacggggtttattatttttcttagatcgaattgccacgtcaatgacacgttagatgaagacagagtcaaattagccacgtaggtgccacgtcagccaaaactaccatccaatctgccgagggacctcatgtgcactggttttgacaattgagggacacgttctatctggttttccggttggagcacaaaaattggattggtcgacaagttaagggacctcaggtgaacttatttccaacaaattgtaaatgggccgagtagagccagcccagcggctactggccttggtccaccttggctatatatatgaatgggcctcagattcctcggcccaggcggtacacgagcaaagcgaggcgattcttcttcttcttcttctctggtggtgtggtcgggaagctaaacccgggagaagccgcagcgcagcgagggtgacgaggaggaagacgaggggagagagagagagagagagggaagcagcattggggttcgtcgcctccagatctccgtctccgatccggcgactgagctctcgatcgcctcctcctccccgccggcaaccgccgcctgctctgggttcgccatcgatgcatgcaccctgctttaatttactcctcgttcgttgctctctctctctctcttatcccctatcgattcgattccttcgagttgatgagcaggtcccctccgcgatcgatgccatggatgtgaagggtcgctccgcctccgcgcccgcatcgccgtgcgtcgtgctcggggacgacgccgccgatgccgcagcggtgcgtgtgtcctcttcctcttcctcttcctgcctctggttcgattggtttgcgattcgatgcgctcgtgctcctagttttgcttttgcgctcaagagagtttttgtctgggtagtaagtagtaaccaccgcctaattaactactcctactagttaattgatgattggatgatgccgcgtgttacatagctgcctgttcaatttcgatcaatacaaaaactcgtccgtgctgtgatttttttttttaatttcattctgtttctctgcctattgagcaagacattgttactagaggtgttatggtttgattttgttttttcttcacaggttgccaaagttgatcggaaatatgggagtatgctcaatgctgggagtccactccaaattctttacacagatcagttagctgatgcgaaaggtggtcttaaggttagtttcctcactcagttgttattgttgtttcattacaatatctgcctccttggcacctgtatcttgtggggagaagaaaaatgagaaattatgctttctggaagtgaatcgagtttgtgaccagacattttgtatttttggcccttcccagtcacacgccttctgaaggtggttgatattgtgatctgcaacaacaatatatgacattcttctgtcctctttttttattcaggcaaatgcaccatgtgaaataacttctgttacagaatgcacctgccctctagaactacaaggcatgttgaaggaggaatgtgttgatcagtacaagctactatctgacaggctgcttgccaaggtaaggttttatacttattcacacatatgcttaatctatttgagcttcacgggttgtttcagcagtaattttcttgctatatattgaaatcttaagactagatcggcttgtgaaaaccagaactcttaggaatgacaacaaaaatatttttcagatagttcccaaggttgcaagagtcaagaaaccagtttccagttcagaggtatatgcagagtttggtgtttctgcatattcaaaatatggtacaagaacagtgagtacatcattgagaggtaagcccttttcccttagctattgaagtggctatgactgctgaacttttaagtatgttttgaggctttttttatgatttgtcatatatgtttgctagtggttagctacttagctgtgtgacacatttgcagttttaactcgatgtattcaatttaaggggtgcttgttaccattgctgaagaaaaatcactgcaaatagttcactactgttctaattcttgctgactgtatctactttaccttatgagttatgattagttgataatgatacaattctagtgtttttctaacttttagatattatttaactagattagcatttttgcttatttcctctaaatgtgtttctctttccatgtttttcagttcttaaactgagtcagatgtgggttttattcctggtgatccttctcttagtctgtcctgtctattcattaacacatgatggaagtgcagagattggtacttgtcggtttgacaaaacgagtgttgctgcactctcttgcaaacagcctgatgggaaatggaggccaccctcagtgacatgttgtaatgcattgctgaatgcaattgatcatttgccagctagcaatgagagcggagtgtgctgtctgtgtcgctatttgcaactaagataccctaatgatgggcatggattggtatcatcttatgttctatgccagggaaaggataggcatattgtcactacatggtcttcttttccaatcacatcatgttatacaggtatacatttcatttctgttacctttactattccatcttaagatctggagtaaattaaagtctctaaatatttttctgtcttgttttaatcagtatgcaggcaggaaaaaacttcatcgagtggtatgagtaaccctgtccagaaggatcatcctgtgagaaatgcacatggaactggcaatgaggtcttcaagatcccttggatatttggttcagtggcattctgtgtgatattacttattttcctttggtacctgtggtggtctaaggcagcatcaaatgcatgccaactgcagtcccttcccctgaaccgaaattggaggctgtcatcagatggtggtccatgggctgagcgcaggcgatcctctgggaggcgttcatcggcacaactgaaggagcgcaggatgtcatattcataaacttccctgaacagttggaaggattggaatatctggttctaaacaagttcattcttctttcttgacgggcagtgctttaattgttggtatgatatgcattgttgaggatgtgatggtgtttttgtctcaaggattgcacatacgtgaacatagcaattcacaactgctattgcttaggagttctgatatgccaaagaatgttgtctgaatataatggccatgtttaagtgcagtaagtctgtgacattgtacatcagttatactgtctaaaacctaacaatgaggagttccagaccagtgcacaaagatacttgctacttttttttgcgtgtgtgtggaaactactcactttgtcaacatgccctggccttaaagccaaagttcatggcttggatgtcaaaaacaagcttaaatgatctgacagctctattccctagcatttggacccctcggacacctgcatcatccggcagaaaagtggagcaaattacattgtttgagctttcatagaatgcattttccactggcagcttcaaggtagacctgataagtttcatctccactgttggaaagtcattccagtttgctgagccactgtttgaaatgaagcaaatcctcctttcatcccatcctctggtatatcccttggcttgcatttccttcgtcatcgctttgtccagtgcatcaaacaccggggataaaatgtatgtatcagcagtgccagaatcaacaattgtcatcttggatatatagatatatggatcaatttcaagcctgattccattgaccatcatatcaagctgctgaatagcatatgctggtttatgatcgtagtagatcaattttgtccacataagattgatatctctggcatatggcccaatggtcagtgacccttcattctcatgatctctggggaagcagtaagaaaacgcggtataatctgtctgctgacatacctggttgaagaatgagtaacttttagtcccaaaaccaattatcccagcattgactccattgtaaagattatcttctccacagccaaagatgaaattatcaatgcttctgttgctggcaagagtgagcctgtctttccctaagtacccaactgaatactctcctgacccatatcttaagctgtagatacaagtatcatcctcttctacacacccatactcaacagcaagatccatgtgcatgccattgcaagcctcagttgagcacccaactttactgtaagttgaagaattgtaagggttgaatatttgtccagcttttgcagcttggtcatagcattttatctgacaatttttacactgaacccaggagagagttgagccggtgtcaatggtcacaagattgaagacaggtggtgtgccaaggctgatgcccatgaaatacttgttcttgcgcatgctatcatcgcctatgacggtggaggagtctgcaggtatgtttgctggctggatcattgtagatatgaaggaattgtttatgtggaacacagagaatgtaaaggctccattcgtgtttaaaccaatacctgtgttgttcaggagaaaaacagtgtttcatgaatcaagaacaagaacacataagtatgatgtgttaagaatgtttggcttaccaatattaatgcaaggactacaggtaaactaccatgacatagttgcaaaagaagtacttaatcttggtttgttgatggtttttatatgttgcctcgtgtcataagtgtgtttatttttcatgattccatatttaatacgaaaaatccatacctaaccgaattgcattctgatggaatagaatacccatgcaaattgcaaaataaaactaccttgcacatcaggtttacaagatcacttctgacagcaaaagaaaaaaaattagtatttcacctgccaagcttttttgggggaaaaaaaagatggcactttggtatggcattccaacgtaaagcagagctttcttagcttcgattgtgagcataattaacagattagatgaaaaaaaaggaatgacgagcgcattttctagaagccatagcatcatatagcagtaaaatttgaaacttcatttctgagttgattttttgctttactcatcatagtcaagttttcagcattggcttttaaactgctaataatatggatatagaagttctgcccatagcttaaacgatcatagcataatacagttgaaattaaaaaattaaaagtcattaaccacacatttgactgaattttgtataacatacaaatcgcggccacccatgtatacgtttttcatgtaatcgggggaaaaaaaacggaaacatgattaccgtaggttgatgaggaggctggactagtaatgctcatgcacagtcgaattgtgcaccatagcgaaatcaccatgacagccaagaacagctccatcaactatgtcgatcttcacaaagtctaagctaggtgctgagtaataaaatgaaatgtctctaattctcctatttattatatgggttttaattaacacatgctgcctgacaatatgcatgctccaactaccaacaataacagatatttcatcacgatgaatatgctatttctttttttttctcccctagaaatccacttaatttctctactgtttggctgacatgtgggcccaacaggcaaaacccttcctgttctatctcattctcatcgtcctggattaattaatccaacccgaaaatgaatcggattaggatccaacgaacccgaagaagaatcggattaggattcaacgaggcagatttaaagccaaagcgatcgaatttctctacagagattgctcgatcgatcgatcgatgatggctcgccacatcttggcggcggcggcggcgacggcgctggtgttgctatgctgttttcatctgccggcgacggcgatgatggcggataccatcaggtacgggccaccgagggtgccccaccggctgggcaccgtcatcgccgtcgacctcggcaacaccaactcctgcgtcgccggctacggcgacgaggctgatgcgccgccgctgttccggctctgcatccccacctcggtcgccttcaccggcgacggcgacgccctcgtcggcgaggctgccaagaaccaccccgccgccatctccggcttcaagcgcctcctcgggacgaggtttggctcgccggaggtgcggcgagctgccgagcacctgccgtacaagatcgtcgactggtgcacgatggctcacatcgaggtgaacgccggcgccggcggcgcggcgaggagcgtgtacgcctccgacgtggcctccatggtgatcgccgagctgaaggctcgcgccgaggctcgcctcgccggcggcgggaagaaggtccacaacgccgtcgtcaccgtcccctactacttctccgacggcccacgtgaggcggccatgaacgccgccaggatggccggcctgacaaccgtccggatcatcgacgagcccaccgccgccgccgtctcccacggcctccaccacggccgcctgcgcgacggcggcaacgtcctcgtcctccacgtcggcggcggcacctccgccgctaccgtcctcacctacgacaacgccgtcttcgaggccgtcgcgtcgcgccacgacgcccacctcggcggcgatgacttcgacgccaggatcgccggccgcttctcccagctcatcaagcgcgaccacggcggcggcgtcgacgacatcgcccccgcgaagctgaagtcgcagtgcgagctcgccaagaggacgctgagcagccacgacgtcgcccaggtgaacctccacgccaccaacctcgccaatggcgccttctccttctccgggtcactgacgagggcgcagttcgaggagctcaaccacgacctgttcgagaaggtcatctccctcgtggacgcggcaatggcggaggccagacgcgcggtggcggggttcgacgtgatcgatgaggtggttctcgtcggtggaagcacaaagattccgaggattcgagagctcatcaagaactacttcgccgggaaggaggcgacggtgaaggcgacggcgagcattggcggcggggcggtggtggtggtggagcctgaggaagctgtcgtccatggcggtgggcttctgagccatcccatggaggatggctaccattgcatgggagccggtggtcgccgtcagatagggtcgccaatggatcgctgttaccatgaattttagctgaatttgaaatttagactctcttgtgtacaactactgttgtattaatcgttgatataagagatgtagtgacataatagatgctctcttcgtttcaaattaattgttctaactttatcctaaatacttctatcaatttttaaaaattcagattcattggagagctatacctgtaggcccaaaacagtccgaagttattttttatggaagtatcgtttggtagtggtaaataattcaacaacatatgaattatatgttatacaaaaatatttctcaagctgaatctaaaaattgtatgaatatttacaaatttatagtcaaaggctctctttggcatagttcttcgagttgggtgttgctagctcaataaatcaatgaatctagatttgcgattacaatgataacgttaagataaattattttgattctattttaaatgaaatttaaaatttctaaacatctggtgacaatattttggcctgaattcactcggatttgtttccctcggattagtctctgcatgaattaattagcagttgtgatacgtttccttcccacgcacgcatgcggccagcaacatataatctagcttggcccaaaattgatgagtacacacatcatgtgtcgatgcggctaggtgaagagattaaagaaattacaaataaaaattgtgtcactgcgggaatcccacgaccttcacgtcgcacacacatacctttcctactcaggtacaagcgtttcttatatttagatgagacttgcgtgctagttatattacagtaattacagtatatttatattgtagttacattcgtgtgattttaatgaaaaaattgttaggtgatatataggtagtgatttaaagatatgccaaacagggtcaaagatatgagtgtttaatttaggataaaattaaaacgataagtaatttaaaacaaagagaacataaattatgttgtgaacggctgattcgagcattagtttcatgcagtgagacttacattaagctgtaattaagcaataccagttcaactcaaagcttatcactcatagatcacgcttctctatggcaatatggcataatctaaaacagttagaaacccaagagcacatcatatcactttggttgtagcataccaaatctttgaatcagtgatgtagcacatgggcaattacaaatatatttacaagttttgggttgttctagaaacctgggattaattaggccaattcgaaatgcataaagaaaaagtataaaacgattggttcaagctctatcctactagtgagtacttttgtttgtttgaagaagtctctgacgttcatcacgagtaacaactaacggatcactaattgagttgtcgtgtggcttgtgcactgaagtccttttctaatctatggtcgaacctttctggtctttggtcacttggagctcatcagtttggactatttgttcaaacatttcctctttaactttattctttatgatgttgacaagacagggacagtattaatggacttgcaaatagcggaagaaacaacggttatatatgcatattttcgtcaattataaatgatagttgttatttgtatctttagcattatgctccgagtagtttcttataattaatttgtgattttgtcgttcacattaattggctctagctttttcgaagcaaatgcccaaaaaaattactacattattaaaaaacaatgggctctgaattctaataattaattaactagccagtggcctctggtacagttttcagctagattatgtcttttgcaccatacttccttgcttgatgctgtttaatcaatcatgccctatggctaccctgattaattaatacaaagtttattccaaataccactgtatcaattatcttcagagtttatttcagatacctgatctgtataaatcatcagagtttatttcaggcaacaccgtatcaatcatcttcgttttgttctgatgctctagccagttcataggaggtgacaggtaatatatgacgcagaatgagaactaaaaaataattatcgccttaatttaggaacaaaccacaaaaacaaaatgaagttgccctgcaaacgtgatggtactactaatcagccagtacactctaaagccatgaaaaaatatgtatgttcgttcttgtagcaagaaaagtattttgttacgcatgtcaactccagttgcaatgtgaacatgccatggaaaatttgaaatccacattccgttcttacgtacggtcaatatgcgccatattgcaaattcttcgtgcgctataattagtttgacaataatgtcatgatttattagagtcttccctcggcaggtttcgccgtttagagaggggttactcttcgcctcacggtaaacacaaagaactaaacaaaatctatcaaaaaaattacttttttcttctaaactttaccccgttacgcacccagacccttcctatcaccgacgataagacatacatcatgtatagattcatagtcaaggtttgtctattatttttggacggagagagtagatggtaagggaaaccctgctcctccacgcatgcttatagctgttggcaagagaaaaaaatcagcattagtctcgattctctgatcttggtctaaagatgctccgttgaagatatgtgagaatattttccttgacaagcaaaaaatggatacgtattttattccaaaagagacccctgaatcttcaacgagaggggaaggtggtgttgaaagaatgagcaactggatgatccttttatttttgttcaagtaaagagttgtactttctcttatcagacgtttctcaagttaacatatcggaactaaacttgtctatcatttaaaataggaaaaagtacgaattacccctccgaactatcgcggtcgtccgaattacccctgaaccataaaaccggatatttttcatcccaaactatgcaaaccggacgaattacccccctcgatctaatccgcggtggttttggtctacgtggcgtacacgtggcatcccagtcagcgttttctaattaaaaaattgtgggacccgcatgtcatagtcttcactttccctctctctcactcttcctctcttctctctctcactctatctcactcttcactgcttcgggaagacacggcggcaacgggagacacggaggagcgggcggcgggcggcggaaggcggcgcacgggggcggacggcggacggcagcgtcgcggcgaaggccgagcggaggcggctgcgataatgtacttttctatttgttagtagaagaattatgctttgcagaaaaacacgatgagctcttgtcaagcttggacttggtccatggactcataacatataatgtacttttctatttgtaagtagaagaattatgctttgctgaaaaacacgatgagctcttgtgcccccacaatatctttttttttccaaaataatagggctaaatagggataggataactcccttcatgatatcctattagcaacgaaaatagctagttctcgatccgatttgctcggaccgaatcgatgatgtacttcccttgtcttaaaataaatcaacttttatacataaattttaacttatagcctatgttcagaggatctaaacatgccctatctataaaagatgatttattttgggacagaggggagtacaatgtattttctaaaacgcaatggatgtggattaggataggtattgctaaaatttgatagatatggattattcgatcttttttatgcagatcattcaataaagtactactatagaataatccattttttatatattactaactaaggatatggtatgtattgttttctaaaatccaattaatgtgaattaggatatggtattgttaaaatctggtgtatatatattatccaatttttgtgcgaaagtgctattggacatgatctttttatattaccacaccatttttttaacatacaaacatattaggaagcaagatcagagtttaggggataaaccccagtacattacagataagatctgaaagcacagagccaccctattgaaatgggaatttaactggactaaaggagtagacttcccgatgaaactgagcagcaaaaaaggagcagattgacggggagctacggcaatgccgtgacaactgcttcctaaagactcatttgacgtgcactccacttggtaggccggtaatccccatcggctatctccatggaaacggcacaaaacagaggtttgatgctgagccgtagattttggggtgagcttcaccggactcagcaaaggatatggaggttgtcattgaatctgaagagctctaacatcaaacctatcaatcgaagtcgcgcatgtggtctgagctcaacccgaatgacaaactcggcatggtttctactgataaagaacaaaagagaagccaaatccaaagaccaaccaaccttcaacatgaaagagtttgagtggctgaaaagagacttcaccatttgattggaccatacaagctcatctatcaattttaataacaagtcgataattccttatgagcagactttgctacgcaaagaatattattttggacaactccttacaagcagactctacctatgtgtcttcatctgcaaaataatatattttcaaatatatcaacaacacaacatatgctatgcacgaagagtccaattaatatccatatataccctatcatgaaccaggtccactaaaatccccgcaaaatataaaatcattaatcattatagataatcaaagtactaaaaatgaggagaaaaaaattaaaaaaaaggcgataatgacacgtaggctggcagcgatcccgagagcacgtccctcccttaaatccacgcacctcgccgaagttccaatcgaaaatcaaatcaaatcaaatcccaaccaaaaaaaaaattcaaaatcaaatccccaaaccccaccatctccatggccgccgccaccgccgccgcgcgtgacctcgccggcgacccgccggagtcgacgctcctccgcgtcgggggcgaggtcgcgtggccggacgtctatgaccgcgacgactcgctcaaggagaacaccaaccccaagtgcatcctcaagacctacggcggcggcggcggcggcaactcgtcgcagaggttctccggcaacctgaagccgacggcggcgccgatcattggcttgtcgaggaagctgggccatggcgggggcggcggcggaggaggaggagggggtttccgtccccccgcgatcttcccgaagaaggccaagaccggcggcggcgggcgcaccccgagggcggcggtgcccgaccacgagcccgggtcgcccaaggtgtcctgcatcgggaaggtcctctccgaccgcgagcgcgcgcgccgccaccgccggtggtcgctcgagacgaggccccgcggcgtcggcggcggatgctgcccggggctcggttccctgttcgtccgccggagccggtcgaggaagaacgtcgtggagtgcgtcgacgaccagtcgccggccccggctccggccgcgccgtcgactgcgggccgcctgaggcggagggaggagaaggtggtgttgatgaccgaggaggcagcggcggcgccggcgccggcgctgggagggatgacgcggttcgcgtcggggaggagggcggcggattgggcggctgagatggagatggatggccacgtggcgagatctgggccgttgtagcgtgatctggaaaccatgtgaagagaagacatcgtgtacatggaagtttggtttggtttggtttggtgtgatttttagctggttgttgatgtaatttagtgcaagttttgaagtttgtgtacatattgaaaattaggagatgagaatgatgggattcaggtcagcaaactttgtctaattttgttctgttttgatctgtttctgtttgatgtgagttgaatggagaagatttcagtactggcatgcttgcattgatgatatgtatgcaactctgactttgcatgcctaacttttttttttccttatgtaaggacaagtagtgcactagtgtgattttagtgtagtgttgatgtgtgtatgtctgaaaattaggatgtgagaataatgggtttcatagtactaccaaattagtcaaaatatgctctttctttttcttgtttctatttgatgtaagttggatggagaagattccagtgttgacatgctttcattcatcatatccatgttccaatgactttgcccttttcttttctttctttttttttgcaaggacaagaagcgtgcttttgatgagttgatagttgattttaagcgtactatgcataagtccgataggttatctgttacttgcaccagtcataaatatttgatggacgttacttacaagatgtgatttaacttttaaatatttgaaacaacaataatttctcgaatatgcttaatccaaaattaagaaaagggtaggcgtagatttaacttgaaaaatattatcataaaatcataagcgtattatattttatttattgttttttaatatatattgatagtgaaagttttaaaaagtttgggtggatcttttcctcgtcaaatatttagaggagtacgattaagtgggatagagctatgagcctgagaaaaggactaactacacttcacaatgagatgaaaaaactaacaagtacatttaacaacgagaaaatgttgatttcgaaatcgctggaatgttgttaggttgaaggtctgatgagtgtgtctgaaaatcgataggctgagagtaacatgaaattgatgaattatgctcaagaaacactacgtgtatgagaagtagagtatatgtttagcctgagaaaagaaccaaaggactaagaagtacagtttacactgagaaaacgtgaatttaggaaatgcattttccttgtctcatccttgcatctcccatgactttgcattgagtaacttgtcggagggacaagcagtgtgctttttggggattcggatcggttgcagtcacaatagttaatattgcacgcaactttggccgtctatttttgtgatcaacggtttaaattcataactacagtaacatgaacagtattccatgctacagtacaacgaaagtatttcgtgctacataccacgaatagtatttcgtgctacagtaccgtgaacagtacaccgcacgatctaggccgttcagcttgtatccaaggatgctactgctactgcttaattttctaaaacgctttttagaaaatctgctttttggtggttgataattggtaagacaagtcaacatgttgcgtgaatttaattaattagataaggtattttctaaaacgtatatttagataaggtatgaactgagcagatacagattaaaaactgcaatgcataatagttcagatcatagctagattcgttaatatacagtatatataccaataacttcaatcaatactttatacaagaagttaagcagtgcaattaactgaatcccagcgagaggaacgcatatatacgccgaatagggttcatccaaagttccaaactacaacactgcaactgaacatcacattcagtaagcataatacaaatatgtaaaacaccctatctgataattattgtctactcccatacaatacaaagatatccatgtgatgtaggatggctagagcagttccacaagcaacagcttcgtcaggcctcaattctgtattcagctcccatcaaagtaatccttgataattagttcttgaatctttgggatcatttttcttccaccaatgacaacaacctcatttgatcagattcttcttgttgttcaactctgttgtcatcttggaggtacatacggatcaatttccatttgatcatcacatcaggctgttgatgatcatagtaaatcaatttcagcatatatacctgattgaaaaatgagtaacttttacaccctcacctcaaccaattataccagcattgaatccactgtaaaaggtaacctgctccgcagccaaagatgaaattgcctttcaaagttatcttctctgcagccaaagatgaaattgcctttaaaagttatcttctctgctgcgttcatcgtcttaagaccaactttactgtaaattgaggctcatcaatccaagagagttcaacctttgtatcttgaccatagcattttatctgacattttttacactgaacaatccaaaacattttatccgacactttttacactgaacattaatccaaaagagagttgagcccagtgttaatggttgctgtcatcacctatgatggtggagccttccggtatgctgtcatcaccaattaattaaacataacgtgcatgattactttaatctagaagggccaccgtttgtggattaggctcaacaccaacgacgacataggctatgaaaaagaaaaaaaaaaggagtgccagaaaaccaacccaaccaatctgatgagcccatttgaacgagaaatttctccatttaacacgagattcaaatgcataactgtaacagttgacacaggccttgtcattcgactctactacactacaacaaccaagctcaacttcgaacgatgcttttgctgctgctgctgctaaaaaccagggtagtgaaggccgcataaactgtgtacagcatgcgtatttaagctaaaatgctgcaatgcaacttaactgcttcatatagtaacatattactctg

SEQ ID NO: 55518 - DNA, 7253 bp, Oryza sativa
catccttctcgtctaatgctccattaggcttctcagaccttactggaagaacgctgcgccgctctttgccacctggtttagctgatgcattcccataccatatcatcccaacaacagcaaggatcatcccaaggactacctgaaaattcagaccttccttgccaaagaagagaaacccaagggacaagacgagcactgtcttcatgtggcccaggacttggaaggatacggcagaaaaccgaccaatgcagataaattggctcagattaacaccaatggcaatgacacatgagagagtcaggaaaaactgcggaacaataaaaaccatcgtaagatgaaatggaaaatttgaggtcaaattacaaacaaatcaagcattgactcaaattcatccatattccaaccaagtaaagtgtaactatagactaataacaagcaagagattgcacataaaaggaaatctatagactatagttgtttgaagttactgctaacaagtgatgctatgaagtaaagacttttgtggtcacaagaggaaatgtaatgctagtctaggtcatttgaaaatgagtaaatttcataaaatcccacatattatggtccaagttgcacaaaaccactgggattttggcatgtgacatataaccccacatattataatcctagagtttcacaaaaccacactattgatcattttaacttatatctaccacacttttgagttatacaatcacatctcaaatttatgagcgttttatccatcatataaatattacatccgctttgtaaaattttaatatatgagtatgtcaaaatggttaacggtgttggtttgtgaaactttagaatcatggttttgtgtcacatgccaaaattcctgtggttttgtctaacttagatcagaaacaaagcattgtaatgaggctagcctcttaccaaagcaatcgatgtgaaaccaaagtgatccactcttttgcctgtcaacaagaaatctacaaagggcccaactagcagaagagatcccgcttgggctggagcagtgtggcccaggaggttgaatgagttcagagagtacttcctttggagaaaatgaacatactgcaaggaaaatagaaaaggaaaggaaactaatgagtaatttgtctataattaaagaagtgacaaacaaacaaatgatttagggagtgccaattattcataactaacaaggactgcagggaaccaataatgattcagggagcgccaactattcatcattcatcaataagaagacaaatagatagccacagttactgttgtaccaccatgtactaatttccccctcataaaaatgttcatggctgccaaaggagagctataggaatagaatgcaatcttatctcatagctgatatataagacataaccatacaacaagggtggtgattttaacttacatattgttgtaaagctgtgctccaaacagctataacagcagcagccagaccttttgcatttacactgacatcagtaactgtgcagactgcaacacctataagcacaaccattatgctcagctttgtgtcccgggagtaatgtacacgatcgaagacaacctccaggagacatgatgcaggtatcatgcacagctttgctatctgaagggaagaaaaaggattgtttagtagttgaaagtttaaagccatgatggaatctagctactagaacggtcctttgctaacctgataaaatcccacagagttccacatcaagctcacattcattccaacaattgacaagttcgaaaagatcacaaacttaatcagatctggtattggtaagtgggagggctggctgaggcctaaccaccgaaacacgatagtcatcaaggtggttgtcacaaaatgaagaccagttaatgttgtggctgcaaaatacaaaacacagtcagttacatggcatccattatcatacaaatgaagtatgtgtatgttgaggagcagcccataaatcttgttggacacaacaagaaactggataatatagtgtgcttccactgttccattaaggcccttttaatgttcatcaagcagagtggcagcttgtgacaagaaattatgatcataattctcatagcagctagaacagcgtggttttcaggtccaccggataccttataggttcacttttaatttgttttagatcacaacaaaaacaaatccggcgaacttctttggcatatggattatctagaattcaaatgattggaatttgataaaaaattactcaaagtttaaagatgcctgtcagtcaattgtttaattgcatgccccaaggaacaaacatctagaatccacaattacataagatctagtagcatttattcgttctatactaaaacaacataatactgcaagtttgtcatcccagaacacggagtagcctggaataaaacatcacaaaatatatatcttaaggtagcaaaaaacataccgaaactgaatccatgtgtagccatcagagccttgttgaccatgatgattccaacggatgtggtgatgttgaaactccatgccgcaaaatctagcaccttcttcttgtcggatttgctcatggaagaagtcatttcgctcgaatccttgaggcttcaaatcaacaccaacactttggcaggggaggacctaacaaattattttgggaggaaacaaaactgtaagaattggtactaaggttaaaacagagagaaaaatcctcttccagatctagaaggagaagagaaggaaaaaggttaaggcacagagaaatggtgcgcgcgggtagaacgagaggaaaagaggacgcgcgctcaccggaagcacgccgtcggccggcgccgctggctcgaggggtgatggatggagatcggcgaactcgctcgcgagtcgagaggccgaggtggcgggtggggagagattggcttgggcgcggcgaggaggagccagaggcgagggtacgcggcggcgggagcagctggacgccgccgggcaccgccgctcgcgtcgcggtggtggagatcgccgcgcgacggcggaggcggcggcggcgggccaaggagattttgctcgtgtggtgtttttttttcttttgttttattttttttttagcgaaatgaaaacaagtgtctccaaatctcccagatctgccactatgtggagggttatttatagtgtgctttagtttggtttgaaattttgaatttagtaccaaaatatgtccaaattcctcgattagatcgccgtgatttcgttttcaagtaaggtgtcaagaaaatgccagcccatccttccatcaccgcgatattacaggagtaatattttttcttttttcctttttaagtagtattttctttgagaagtaataaggacctgctcgaaagtgtttgatcaatgatggatgaaactgaaaaattgtacttcctccgtttcagaatgtaagtcattctaatatttactatatttatattgatgttaatgaatctagatagatatatgtatatattcattaatatcatatgaatgtgaaatatgctagaatgacttatattgtgaaacggagggagtacttccttcgtcccgaaatatagcaacctagaaccgaataggatgtatcatagtactatgaatctggaattgctcgtccaggtttaacctgtccagattcgtagtactaggatacgttctatcgggacctaggttgctatattatgggacggagggagtaataattattcaagtatagagatgaataatttaaatattaaaaagttgattgatctatttaaaaagttttcagggaaatattaacgaacaattcttttctcaaaagatatcgcacagtttaaacatgcatctattaaactttaaatcaacaattgtgttgtgtggttctgtttgtgaaagtactatatgtatcagtgttccgcttaactggttgattatatttattaattaattaatacggttgacacaacgttggggttaagatctgtatactttttttagaacaatatctgtatacttaattgtttattaataatgtaaacacatacaccgtgcagttagggtgtcacataagcatggcagctcatacacgtagggtccatgcatccattatattcagatctcaaatcagatttgggcatgcaaccttttttgagattccaagccatcgcactcaaatcaacatttcatccaagttactactaactagtccgttgattaagattatatactcctacttaagtttttgtatgtatcttcaaaaaaatgtttcgacatgtgtattctaaaatgtgattgctgttttgggggggggggggggtttggaaaactgaccaagttaattctatatattaattccattgactatatagctcatgtatttatgaagtaaaggtgtgatttggcacgccaagctacgcatacaaaaggcatgagcaggtcagaaaccaccccatgttttatttgtatggagtaatacgaattgtatgttggtatcatgcatatgctgaatcgatcgatcatctgttggagtgttaattggacaactttaattgtcgtgcaggttgttacatgtgcaattaattggccagatagtagtaggagtactactgtgtttttagtcaagtcgtgtacactcctgagagtgattaactatcggcaacctagcttaattactgatttgtcggtgtgtgtacatggatgcacatgcacctgatgggccaagtaagcagcaaaccatctttagcttttcaggcccgtatgtgattgggccgaactacggcccaaagtcaaaacgtattaataaaaacaaagatcccttcacctagatttctttcataaccacacaagcataatagattaatagtatcattttggtgttaaaagcaaaatatcatgtttttttagaaacattacgagcgaagacaccttcgaaagattggaccagcaaatattaagattaataacgaagtcatcacagttattatcgacagatatattatatatcacttaagaaaataattagctataaatatagacacctatgtcgagtgtagaacttgaacctgatgagctgattccaccacagttgagtaacattcacttcagaaaaaaaaatcatttcctctctaaaaagccaaaagcagtgctgcaggctgcagccatgatgcgactgtatacgcgtacctgcaccgacaaattacgaaccattagtccatttgtactctcctggccaaaggaaaaaattggaaaccattaatctagttgccaataagcaatcaatctcaggagtgtacacaacgttgactaactactacaactcacacgagatatcatcgatgatcactgaattcagcagggtacaatatatccgtattatgggaactagacatggattttcaatgtgatcatgccctccctacgcatagctttcgcgtgccgaaccacacctttacttcacggaggaattgaccctatatcattgaaaaattatgattttagttttcacccaagattgtttaaatctcaattctgatgtacaattttacaatcctaattaagggtaagttcttataggattgactactttcttgtttattcttggtatgcttcctaaaccgttaaatgatacgtttagtgaaaaactttttacatataagttttttttaaaaaaatcaaataaatctattttttaagtttataataattaataattaaatattcacatgccaatcacatatttcggtatctgtgccactaagtagcagagttgaacgactcttttgaacgtctaagatgtctgattctacaattctgtataggcaggatatattactttacattttaatttatacaattctatgattgcgatcccatatcgaattttccaatccgatccaggatcgtgattttaacaaccttgataccatcgaaagttaactctattactctatttatcattgcatatccaaacttttgttagattcattttaattttatttatttatccccatctcacgctcaaagttggtatcgatatcactctatcccaaacttgactatggctacctctatcatcctcaagcttaccacggataaactgcccttaaagtcgcacatagccgtggtgattgaggttgcaaggttatccatggttattaccctcgattagactcacacaagcaatgtccttgaagtcacccatgaccacaacaaaatgaccattgtgctcacaaggccaccatgtacagtacccttgatcgggcttgccacatgtcgccatcctcatcacagtcgagcttgcattgttacccatgtttgccaccatagatctagctcgtcgataatcacttcctcacctccgcaagggaacaatgtaagtgaataaagatccatactgaggtctcggaggacgtcttggtagagtaatcttcacttgtgatcatctctagaagtttgagttggatcttggtggtcactcgaattctagagaaagacctaggggtgttggattgaaggccgaggacttctgtcgggatctttgcacgatgaggcaagaggttaaatcaagatctaactcttcagagtttctcgacaaatagtaggatccgtgtgatccgaacttcgggaaaaaaaatccttttgtctcccctgtgcatattttgtgcttgcccgtgtgattcaattactctgcttgtctactgtgtatcgtgctgattgaataggcctagaagtttgattagatttgaagtcaattctctcatttatttcaatcccagaagttcctgtcttagaactccggaagttctggggtgtctgagctgccaggaagttccgtcgttcttcacgaggaggttctgagccctgttaaaatttgaccgttgcgattgtttttagtatttttcaggaggaaaaagtacgaattaccccctcgaaatatcgcggtcggccgaaattctcccccgaacccgaaaaccagacatcattcaccctaaacttttaataccggacgaattacccccctcgacccaattcagagcagttttgtgctacgtggcgtacgcgtggaaacccagtcagcattttcctttttttaaacatggtggggcccagctgtcattctctcccatctccttttcctcatcccctcttcctctctctctctcgcgacgtcaggcgcagccgcgcgggtggtcggcacacaagggcggcggtgggtggtcggcgctcacggcgg

SEQ ID NO: 55519 - DNA, 5918 bp, Oryza sativa
agccctctcctcccgcctccggccatatgctcccactgcggtggccacggggaacatcacgagctcccgcagcggtggcggcggcctccgtggcagggcgatgtctgccaaccgcttcattggtatccctcgacgctccaggacgagcctcctcttccggcgctgacgcccgagtatgtcggtctttgcaggaaggcggtggagtacttcgattggatgtgccgtgtacggccggcctgacgccatgtccaacgcgttcaggatactcttaggtgttcttccgatttcctcgtcgttgtgatgtgaatgttttcttgataatgtgttgctgtttcctccctagtttggttaactactagattgcccatactatccataattgaatacctgcgccacctcccaccaaccgcgcggcagcacctaatgacgcgctgccgcccaccgccccctcgcgtgccgaccgcccgcgcggccgcgcctgaagtcacgagagagaggaagaggggaagaggaaaaaggagatgggagagaatgacaagtgggccccaccatgttaaaaaaagggaaaatactgactgggttgccacgcgtacgccacgtaggacaaaactgctctggatttggtcaagggggtaattcgtccggtattgaaagtgtagggtgagtaatgtctggttttcgggtttaggggggaaattcggccgaccacgatagtttaagggggtaattcgtactttttccttttcagcaacatctattcacccccctcccctctaggctacatctttaagctttcaccattgtcgaccacgtgtggtgtaccataccgccaagtcgacgacgaccaggtaggttttcccaaatatgatactcaagtgatactaatatatgagagcactaccagcttcgaccaatagaaatagagctattaccttacagataaggggcccgaaccttgtatagaccttgtatagaaatccttatctccatctcttatatctcaatctcgcatatgccctggtaccaacgatctccataccatgcaaataccgtagtcgtgatctacaacatcgtcaagtagtatatactgttttaaagttggctgcagtgtatactggttttcggtcaatattagtatatgcagtttttttttacattggtatatactgtttttttagtagtggtatatactatttatcagttcgtagcggtatattcttttgtttaagctagcgtcggtatatactgttttttatttactagcagtatatactgtttttaaagttagtttcagtatatcctatttttcaattagtagcagcatatgctattttaaagttagtatcggtatacggtgtctttgtcaggggttatggataccacatacctaatagtagttgattaaatctcggcagtaccaataacctgcggatataggaggagttccggataagaaaagacaaccacagttctacatggaaacgacaatgactactcggattgtatccatattggtttcctagttctacttggacaaggggacacttatgggtataaatacaaggccccctagaaggagaggggacaatcaacagacacatccaccacaatctacggaacaatagatcaagacagaagatcaacatataagccaacatataccaagacaagacgccggatatcgacttcagggataagcacggctagtcccctacagtgtctccggatactgtcaggagagacatagcgttgtctctgatctcgccgggcacgaacttgaggaggaagactaccctgttatcaactacgagtcagaccttcagaccgccatgtcgacaacagttagataggctaccccaaatattgtactggtgtgattatggtgaataagagcaataccggcttcggccaacaggatgtagggttattacctgacaattcaggggcccgaacctatataaaaatccatgtctccatcttttttacctcagtctcgcgtatatcctagtaccaatgatccccatactatgtaaataccagaatcgcgacatcaaacatcgacagtggcgcgccaggtagggggattttggtgcttcaggatttagacgagataggtttaagagatggattcttcaacaacaagctactcgacgacttcggctatggaagatctaacctgaccggagtatgtcttccgacgagatcggaagcataaccgaaaattcggtccttcgagatagatagcttcaagacgtcgctaccgctgcggcggacatcgactcagccttcctcatccttggttgactcgatctccaacgcggcgtccctagaaaaaacagcaaagttacggccggcgaggatatgcaactttgttcaacctcggacaacaattagatacggagtactacattggactcccatgcaaactagtcgtgctcctacgacctaaccacaagtaatcaagtcggacacgacaacagctactgcatgcccatgattgagcatgcacatggacaactgggaggaaagaaaaaaaacacacgtattcatacagtacgtgtccatcaagttagtatattaatttttttaattaatctactaatttcgtagatatatccggcatatatctacacaggtacgcattattttatataaaattttccgtacctattttcagactatacaatattgtcagatccaaaatttattatgtttatctagagcatgtattttatacaatatctattgcgtgagtgtccccggtgttaaatcgactacaatctaacgctgggggctcgctctatttccttccgtataaatcatgcttgtttacggtttacataatgcctgatatttacatctgctcgttatatcctgataatactaaaagatccatgcagtttttcgaatacatactcgacattatctactatatgtcttgccttctagaaaatatttttcaagaacaattgagcactcgagtaggttgtggtcaagtacactacattatcgagaacgatctcgacgaatgcagagtcgtcgcgcccaacctaccaacaaagaccgactacctatctcatagcaccggccatggctggactactcgagaaaaggttgttaacggataattcctcgcaaacgccgtcggcttgatcacccgacatgattgcgaacggacatccagatatgctacaagttgggtgtgtgagtcatgctggccacatgagacgcacatgtaataaaccaactctagcacctccattggtgttcgagagataattctacacattcgctggtcctcgaaccagtacatagcaatctctcgcaccgcaacctccattggtgttcgagagataattctacacgttcgctggtcctcgaaccagtatgtagcactctcttgcaccgcaacctccattggtgttcgagagataattctactcgttcgctggtcctcgagctagtacgtagcaatccctcgcaccacaacctcaaatggtcgaggtacgactacagcaataacgcagcggtcctcgcaccacgactgcaaatgatcgagagacacctactcactggttctcaaccagtcaatcgtagtgatctctcgtacatttacttctagtggttgagttacgtctactacctggttcttgaccagaggtgtagtgattctcccattacctctacttcaacaaagttgatatcaggtacacaataatgccaagtgttttacccagagatcccttaccacaaagacacctagcgttgaaacctatcctaatgtccctttacgctgtcttgacaaggcctccgaggaacctaagagaacttcggctggggacgcccagagcggataaggccttgtcggatccttcagagacgaaagaccatgtaagatctggtcgtgtaagagttctcgccgtgcgtattaaccaagccgtgtaatcggaaattgggttttctaacttcacggctaggggctaggatcagtgcttgttcaaccgaggcaggtaaaaggtccaagagtcttatcttccgagaacaattctccgatgagaaggctgggggctagggagagtgtataactcaacaaactgactgatcgaagtcggtaaaagagtagatgctcatatacaaaacattggtctgtaagtttaattcattttcggttttccatacattctataacatgttaccctttgagcgttcgctcgggggctatttctatctaatattcttttctgagtattgatttcaggaaaattctattcgacattatctaaggctccatgtctctatggttctacaccaagatcgactaaggcgagtacgacaaatgttgacaaggcttcggtgcagattctacgccttctcgatcgctcgagaacggttggtggatctcgacaaggaatacgaaatgaagaaatggtgtacccgccgagataaaatttcttgacttcaatccaaattctcgattacagcaagacgggagacttagtcgcatgttctgtacttttttggttggcgtcggagattgactcagacaaaccctttaggtgcccgcacgagactgataaaggaagtctaacgttatctctgaactcaccgagaacggtcacatgagctcgataacagttactccaaggcctgcgcgcggttgagaatatgaattcgttcatttgcatcgaagtcgggggctactgtcagggttatggataccacatacctaataatagttgactaaatctcggcagtacccaccacatactatgtcctatacggaaacaacctgcagatataggaggagttccgaataagaaaagacaaccagagttctacatggaaacgacaaggactactcggattgtatccatattggtttccctagttctacttggacaaggagacacttatgggtataaatacaaggccccctaggaggagaggggacaatcaacagacacatccaccacaatctacggaacaatagatcaagacagaagatcaacatacaagccaacatacgccaagataagacgtcggatatcgacttcagggataagcacggctagtcccctacggtgtctctggatactgtcaggagagacatagcattgtctcttatctcgccgggcacgaactcgaggaggaagaccaccctgttgtcaactacgagtcaaaccttcagaccgccatgttgacaacagttagataggctaccccaaatattgtactagtgtgattatggtgaataagagcaataccggcttcagccaataggatgtagggttattacctgacaattcaggggcccgaacctgtataaaaatccctgtctccatctcttttacctcagtctcgcgtatatcctagtaccaacaatccccatactatgcaaataccggaaccgcgacatcaaacgtcgacagtcttttactagttagtagttggcacgggatttccagttatcggagaatattaaggtgcacagaaggggcgagaacgtcggattttttctacaatagcctttgctttttgtgtagtttgaagccaatgttttacgtagagaaacccttcgaaagaccgaatattctatgtgaaggagagaaaaatcgcaaattagaatcgagctgtaaaagattggcagacgagaggcgttttcgcaaaacgacacccactaaccctagccaccatcgccgttggaagaaaattgcataggacaatagtccttcgctcatccgaaggactttgtccctgcacatgacacgtgttaggttatattctcaaagcacccctcctttgtccctactaatctcacgcacgatgccgttagacctagtcgtcgtcttcttcccacgcgggagacgactaggtgcaacgaagtaaccgggccttcgtgcttgatcctaattcatgca

SEQ ID NO: 55520 - DNA, 3391 bp, Oryza sativa
  unsure (1)..(3391): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgccacaattccagtgctaaagcccacagaatccaacacatgtaacaataggccttcacgagttagtaaatgaaaagcccatcgtgtagcaaatcggtcttctcatgttgtttattcatttatgacttgtgagaaatgagaatcaaagtgtaggtagagttgtaacttgtgtcaatatggccttgaaacaaatccgcacaccgtggcacgagctctctatgtaaagtttctttcgagtgaactaaggatttgaagcatgaaagtaatttttttttcttgttcattccattcattttccaactcctattagtactccaatcaactgatagagaccttctccaacattcatgttcacctaaacatgaacctcactaccttagtgaaactgagactaacatggatatttccacaccgggtgaaactgcacctaagtaacgcaagatatacaagtgagataataataaaacgattgcatctcaagatactagaatttaggataatcgttcttgccagctgacaattacaacgttttaggcaaaaaaaaaacgtaaatagtgtaatccgtgtacaaacaaccgcaggacaatatctgtactaggtaaggaatctatcaagatactattagtacaaccgcgatttctccaagccaatccaaaacaatatcaactaattcagtctaccgacacgacactccaatagtccaatcctaccgcacatctcccgacacggcgaaccacccctccctcgtcatcgattcgaatcaaacagccagacgcaacgcggagatgcctagatcgctcacctcggggccgcggtggcggccaggccgacggatcgggggaagtcgtggaggcggaggaaccccggcgacacgcgagccgagtagtacggcgacacggcggcgggcgcgacgaggtggtgggcggcggcggcggcggcgagagccatggctggttggtggtgacactcgctgcgcgcactgcggcgaggcgaggtgaggtgaggcggtttctctctgtgtgtgtcttttctgtcgcttgctctggtcggggcggttgggcgaggaagtggatcttttttgcttatttttatttttttaatctgccacttggctgcattattggattggatgtgccctttttcttttcttttttcatttttttcccctgctgttgtgttgttcgtcagctaggattttttggacagtggttgttgcagttgtcaaaattttcattgaaatagttttattttaattattggttgccttgtctggcatgagagtatgaagtgtctcttttttttctctctctttctaggtgacgccagatgagggtgatgattcattcactcattcgttgattcccaagagttgcaaacgaaattggcatgcttactgccagtaataaagttgaagacgtgtcgatgaaacggaagtggctcgttctctgtttgtttaggaagatgggccgggctgaatcacacgttagttggaggcccgtcggggcatgtagtccatgtactccctcctactcagaactactcagaataagtttatttgctccttccgtttatctcaaaataagtttacttttaaaaaagtattacatcctagcttataaaagaaaagaataaatgcatttcttatgtatttactgaagtttggtaaaaaaactaaatgtatgtaaatatttggtaactttataaaaaaaagtatggtttaaaatgacatcaatccgaacagcccatgaattttaaggaactgtctatgtaacatccagctgaaatttttttgtcttttcagctggatttctagccgtcggatagacctcttgccagcatcccaacctcgccttgcgctccctgcctgcgcggccgcgcctcgagcgcttctcatttttatgtcttgttggattgggtacgggcttcaagcacgtctgtgttttgtctattataaaaggtccaacaaacaaacgggcttgaaaaacactggcccaatcactgtccacgtaacagaacatatcaggctttgcaacgaaagctctgtttaatagctaacattctctgaacatacgtcgggctatgaaaaacatgtaatctactgtgttcaaattttggttctctgaaccaaaacccttgaaaagaaagcaaagcactagagccacctaattactagtgcctaactagattgaccattatctccactggaagatcagccagaaaacatcacaagattgactttatctgttagcttcctagtcatccatagcgcaatattagaccctgcaaaaatttgtacattttacttagttacttcgtaccaagatgcagatatttctattccaatctgtgacagaaggaaaatcttgtacatcttcatgttgaattttgtagtcccaaaattcagaatgagtattagcttagaaaattatggatagaattttaccccaaaatcaaaatgagtactcattttaccccaacatgagtactagattgaatcattcctgcactttaagaaattcaacagtaattataccccaaaaaaaaagcatttgtggcatatactagcaccataaaaggagaacattaattaaggatggagaagtggatagcaggatgtcatcgaacagatgtaaactgtggaaaagaagttctcataacaaatactcatttctcaatatcaaaaccacactgtccaaacagcacagatcaggtaactaaagatgcaaaccgtggggtttaccgtggctgcctcactgataaccgttttgggatgccatgaccgacacactaacaaccgctggagaggtataggccatttcacccagcgccaataggatacacaatacaatggatgccttgctgacctccgaggaagacgttgtagccatctcgccaaccttgtctcgcgaacaaaaacacggcgcatatccttggccacgggctccgtcgtgacccggcggaacggacgccgacatcatcgcggatgctgctgccgcttcgccgcctcctcccccatcgacgacttctctctctcgctgacaacttgtcgggttgctctctctttcatcccgtgcgtggaggagagaccggcgaggtgggcgcgtg

SEQ ID NO: 55521 - DNA, 3024 bp, Oryza sativa
atgaatggcacaccactcttcacgcacctttgctcccctctgttggtttccatcagaaagaaggaaacaagtttctctgcgtctccgatctgcagtgcgagccacgaaggttggcgtcgtctcctcctccctctcctcctcgcgcgcggctgccgtcgagaagacgctcggcctcccttgtgcggcctcacctcctcgcgctgaatcccctactccccgtgttaggtccgctcctgcttgcctgatgctgcccgttgctggttcttgatccgtcatgtttgttacatgttccagttttatggatgggtttttttggttggctgattcgttgttggtgccttcaattaatcagtactactacattgtcatgccctggtagtgatgcgaaatggcattttttttctgttttcaattttgcgtaataacatgattgatgctagctagaacattttatctaggggtgaaaacggagcggatattacccgatccactctgtatccgtccgaaataaagatatgataagggtttttagatatccggcggatgcggattttaacatgtggatgcggagccgtatgtgatatcaacaatatccgacagatgtggattatccaatattttaatcggattatttggcggataatccgcatttctcatgccatagcccattttatatgggcagcccatgtagcccatctaccgttaacctaatccaatccccaacatgcctgacggcgcgtcgtcttcctaggtgcgccaccacttctcctcctagcgcgccgctgcagcctgctgcttctagcgccgccgccgcatccaaccaaaagcagcctttctactatttctagcaccgcctctgcccttgccgacgccgtcgcctgccgtcccccattccccgcgtcagcgcctcctccagtggagtccccgtccaccgttggcccgtcgcggagtcgccagcgcccagcgcctccaccgtcaggtactattgttttcttgtgatgatgaataatgactgaatgagaagtgaagtctggatccttgcatgttggcgtgtgcagtgtgttgtatggaactagttcatattagttcgtatttgcaacttactaaattgcaagagtaatggtagtactgtatggaacggaactttgttaatgtactgaagacttatatttttaagcaacgccgcaatgaactgaagacttgtattatgtatttgctggatgtattttggattattcaagctcttaagcacttgacaatctgctgtatgtgttatattatcaattatgcaagctgcactttactagttaagcaaaattatattattgatgtgttttgcctggtttttcctagagagctgagatcataaatcatgttcagatgttttgtaatcgtattgctgccctcttgttgtatggatcgaatacaaacttaatatccgacaattttattccattctcgaaccgagtccgcaccaactccgtaccgaatccgacgtccgaaataatctgcatccgcacgtcatccgcacccgcttcgcatccactttaaaaatatggattaggatatggtatagaaactatccgtccgaatccgctccgtttccacccctaattttatatgttcttgtctttttaagcattggcacttgcctcattgcctgcattggtcaagcttacaccacttatgtaactgttaattgatgctcgctgctaaattggttgtgaattttgctttataatccatatcaactgttacgaattttcctaaactatccatgtctgaattagatgtaattcaggagtccgtacatgccaaaagtaccttttgtttttcgcccttatgttgcaagaatctgctgatgcaaatcttgatacagatttgaccttcataatccaaaagaagaggttttagttcaagcgaacgataatggggatatccaaggtgattggcatcgctggaacaactcttctagtcacgtctgttggtctgtggaagatcggcttaagaattgtcgcggttccttttctagcaaccagtactattgcctatatcatcgctgttgcatcccacaattccatcaacataccttggatcttgggaaagaattcaaaggggaggtttccaatttggtcaagtgtactttttggtcctttcttgatacttgcccgggtatatgcaactgtgaagagacatatgaggaagaaggaggctgtgtataacatgatcactgaaggtgtttatctgggaggatggccgtttatgttgaagcatttgcccccaggagacccgtctgttattgattgcacttgcgagttgccaagaagtgattttgtcccaacaaatgagtatctttgtgttcctacttgggatacaagagccccgacgatatcccaaattgaatttgcggcatgctgggcatgtgaaaagagagccaaaggaaaaccagtttatgtacattgtgcatttggttagtaacgacctatctctcttcatatattccaccttttttaaacgttgacacaaggactgtagttctataatctagttttgtacataattgcagctgctaattacttttgaatattgtgtgtgcacgcttatgttttgtgcatgactgcatcaggtcatggaagaagcgcttgtgtcgtgtgtgcagttctagtagcattgggcattgctgaaaactggaaggatgcagaaaacatcatccgagaaaaaagaaagataaaaatgaatgctgttcaccggaaaaccttagacgattggtcaaaatatagagcttctcagaagaaggataaataactgtgagtcgattgttctcagatgtacttctgtcatgttgaaagaatgctcaaaacacattaagagttgtattgtttaacatcttaacattcttaattagtaaaattgctgttttgacaatcaaacgcttatggcaatcgtttgttgaacatgaaatccaaccatcattaacttctttgatatgcttgctagtcatatgccttaaagccttttatgcta

SEQ ID NO: 55522 - DNA, 11198 bp, Oryza sativa
atttctaggtagtttggacctctctttttctgggcgtcagattcacttctttctattagatagcttttaaattcaatccaagatgttctggcactggaagtgtagattctgttccaacttttagctactcattaactttagaactgtaaaatcaacccttttatcaatcgaaggcactcttttcgaaatgaagggcttcacgggaaacataatttgccactaaatcacataaataagtagtatttcagcaacaaaatctagctaacccctttttgttgtcactgggcaggacattaaatcatttgacatctcaggcaaattaccatgtgagttctatgcaatctgggttctgagaaatcttcctagttctggagcttgcattgtttcccagctcatatcagtgtttcccacacgtgtcagattacttccaaaatttgttcccagttttgcttacttctgctcctatctgaaggttagtcttcaaagtccttgtaaatcagaaagctgaaaattggctttcagatggttgtgctgctatgcttagctctccacagttgccttcatctgccaccaatatcctacaggcaaataaggctccagctataaatatatgatggatgcgtccagataaatagcactacagctgctgtcctattattcttttagacttttatagaatttagttagttggctgaaagcctgaaatagttgaaacatgcatagaaagggacaaaatccatatctagcccttattttgtacaccttcacatcattgtattttatcataatcttttttaggataagggactaccactagtttattggtgtaatgaccttcaaaattatgataaaataaagtgcatgcagtatgcatgatgtgcaaaaaaaagtttgctagcttttgactacctccagtaggaggctggtccattccatgctgatttaatagggtgcattccttatatttttttgtctagtaaataatggttcagttatatgtacttcgaactttccaatcagagattaaaccttcaacaactacaggtaggaggcttatcataaaataaagaaaggaaaagaattaattgcaggtaggactagagcatggtgcttactctcggggacgagaagcccagagggagctgagggcacggaggcgattatggtactcgccaattgccaagaaacatcgagctgcctgcctaattgtcagaattctgtgcatctgatgaagagtctgttgcctcaagttatcagcctggaaatccaatttgacagttgcagttttagtacatgatgaaaggatctcactcttggcactagaaaattgaaaactagagcagatactggtagtaagtttgttttactatgccatactatagttaatcagataagctccaaagtccaaaataaggataatgtcacatgtttaggtgaccattcttttctttgtatgatgtagagataacatctctacatgttgatgccatagcatattactgtaggaaaatttgttccttttcactctttattaattaacatgttggcatgtcgcattattaaaaggataaaaatgactgtttttttgctcgactgtcaagtgattggattgctcatctagacatccacaaagttgagtcaaacagggagagaaggatcagaactggaaaaagggcaggcaacaaggacttcacctgtatgacaaagccttcaaggttggacagcttgcccagggcaagggccatgtaacccatgaagctcccaaggctggcttcgttgaccacggagccgccattggcgacggtctcagctagtgactgatgcagctgctccaggccctgggagagagcttcctctgcctgctgcgatgattgctgaaggctgcagatgccaaccacttgctgttcagtcagagggtctagctggggtgccactgtctgcatcaacatcaagagtttgtaatgaaattagaaaaaccatacttgtacttagaagatgaggtcagatttagcatggttaaaacttgatttggcaaattgttttgcacattgtgaactgtgaagtgagcttcatgtttgatgtcagattgtcaggtgcattttcttatgaaaactagcctagctttaacttatcatgttcagatgtgaggttatgactacataccatgagcatgtttaagcatgatatagtaaaagttttgctttatcatgaactgtgaagtatgctccatgtctgatgttactccagattttcaggtgcattttgtgacgaaaaaacttagctctttttatgatgaaagctttcttttattgtattgtttagaccacttattttaagctattcgttcaatttatttatcaaaatatttaatttatcctataattaaggagataatctgcagcagtaatcggctaaataatctgtttcaataattaaatagcttcgtgtccagaaaggggtttagaaatgaggaggatcatgtctaacttacttaaacttctaattactgacatgtgagcccgttgagtagaagatccacatgtcagtgactcatgtcagacaaaagtaagttagaggataggatctcgagtatgtatataccttgagcagatcggacggttggaaaccgcccatccagaggaagcagcgctcggcgggggtggcccacgtgccagtgatgaggtggaacacgtcggccttggcggcggctgccctcaggcggaagagctcgtcgtagtgggccagggcgtcgtcgacgatcgccctcaggtcgccgtccggcaggtgcgcgtgtagcccgccgtgcagctccgccatccgccgcccgccgtcctccagccaccgcccgtactcggcgtcgaacatcgccgctcctgccacgaccaaatggacagtaaagtaaaacatatatactgaattattactgatctgatgcaaatcctatatgacaatcaaactgaatttcacatttcagatcagtagataaaagctactaaacatgagagattgatcaagtgaaggcaatgcattacctgcgctggtgtttccacctggtgatcctcccagcaagaggccctgaaccaagaaattcagattttactgcattcatgatcctacctataatgtttagtaattagttcagaatgcagaaaaaaattactacctgggaacgagctctctcgagatcctgctccatctgagccagcctcaacttgctgctctcaagctgctggatgtaagcctgcaaattggtatttttgacagattatgctgtcagaaacttattgggaagaagaaattcagttctgaacaactcattttctttctatgcaggtactgaaattctcatggatctagctaggctcaccttctttcgcagccggctcttgcgtgctgcctctcggttctgggctaaccttctcattatctgattacaccaacactagagagtaagtaattgtctcaaactcatgtttcaaacagtctttaattagcttgcactgaatggttctgtacatacatataattgcatgagcacgcataatcatcatcatcatgctatctaattaagcatcaactgggagtatgagagagctaggagagtaggattaacctttggatcaagtgtctttgtcatcctgtggtcactgtgagtggaacttgctgccatcttctgcatgccatgtggacatgaacaagttattgttaattacaagatgcactttaattactacagttttgtgcagttagaaactatacaagataaatagaaaaatagtgatgatatacatgcttatgtgcctatggtgcaaataaaatatactagtatgatctttggatgcacgttacatcaaccagatataaaaaaacagcaatgtatatgggtggaagccacccactctaacaacagacaaaaatattgttctgcttttttgtttatgttgctgtcacgccctaatatgcaaagttctctttcagttaagcgtgagttagatataaacattgggtaataattgttcatccaatgtgatcttggcagttcatcaattggccagaaggaacctaaagcacccctgatggccaaattgccattgttcaggtatcagttggtgcaatttttttgggaccatactttgtgcaagctagagacaattaacatactataagaatgcatacttgtcgcctaatacagcacataagctagcatgcacaagtctaacatatcctttcctagacttatctgctcctcttcttttttccaaagaatgaaaaagatagaaatttgtagtggcaagtaaggctaaatgtcaaagaaaatgcatgggtaattactaaagtgatcatattctgcatctgattcttcagaaaaacgctggtcccttggatgaagcatcaggggaacaagttggaactttctaatgtagagccaaataatacacctaacttgttgggattggtgatcttgggagcagcaagatcttaaatgaccctgaactcttctagtactactccatgagcatcttgagttgtgggctagctactgacatgacaccagactagggaacaacgcattgcatctgcaccactgcatggctttattttcttctcgcgatgtaggtatatgcatgatcaggaatcaggagatccatgcagaagcaaagacaagatgaacacctccaagaacaagcgtttacaacaccaaaacgcatcaagaaactcaagaccaagaattacaccaaaacgcacatcaagaaactccagtgattgatgagaatgcaaaccttgtgctgcttctgctgctgctgtgggatctgatcaaactggctcgccatgtcggctgctgctgcaccctgatcgccgttgttcttgctgctgctctcggagtccgttgtgtctgccgttacatttgaacatccatcctacagaacacagctgtaactttgcctttgctttgcaaaaatgaaaaatgcagtagggatcatgctcaagtatttaccttcggtgttggaagagagctcctcctcataggccaggatgggaagatgtccagtgtagcaggaggcctagctgttgctgttgctgtagctgcagcagcagcagtggagaaggctgcaagaagatatcataggggaggaggagatcaagaaatgcatccaatcctgcaactgcaacatcagaaagctactaccagctgaagcactgcactgggatcacaaggggcaagtggggcccatgtggcagtgaaaggtggactggaatttattccctttgaggagctaggagtactgcacagactgtgtgctttgctttgctgccatggcagggagctagccagagctggtactatagtactttggagaattgttgcactctagagagagagagagagagagatggtgatgatgatgaggagagtcacaaggcagtcacaccactacacacaaggtgacaagaagcacaactgccactcctgctatctgtagctcttgctttgcattgcatgtggtttggctagctacaaagtttttgctgttctttttttttttccaaatggatttgcatggttgcttttgactacactgccctaacctcttgggaaagttggctcactaggttgtgtgcttttgttcttggtcagagaaagagagagagagatgatgttgtgagtacgtacgagtggtgtgtccatggtgagaggtggtggtggttgcagtttgttgagccctcctcctgagtgtggcaacctgatgaacaagagcttcttctagctctccaaaataggcagcgccacctcctcctcctcctccttgctcgctgtcagtgtcaggccaatgcaaattaagaagggaaattaaaacatgtaacatgagatcaacaacttgttgggaataaatttgttgaccagaatgatctgaagaaatattcatgaagaacagtaatgagaaagcaatatgaaaagaacaagctgagaagagtgctgattcagcaaccgatgcatatagcactcttcccctgaacgtgaaagagaagctcatggttcagaacttcagatcatgtttatgttgcacagtttgcacttcgcaatcaccagagagagagagagagagagagagagagagagagagatattgggagagaaggagacagaaagatgaaaacgagatgttgggagagaaggagagagaggatgatgatgaactgatcttacaagaggtttgcagaagccatggagttgggcaaggtggtgccatggaagccatagccaagaacatgatgaggattctgccctctcctagcctctcccatcctacgagccacaaaaccacagctcgatctcccagtatctccaagaatcagaacgaagcgctagctcaaatttcttcgatctacctccacaaagaacaacaaaaaagaacatcatgatcgctgctactgtacatgctagtatgctacacgccagatgatgtgaagaattcaagatgagagagtcaaagaaagaaacataccaagattgtggtctcttgtgataagcaagagccaagagctactatagcagaaaagtgaccggagtagctttagctagcaagaagtgcaagaagcaaagcttgaccggttcttggctctcagctggagtagctagctgttcttggctcttgctattgctgctcactcctatagctttagctctctcttgaatcttgatatggagtatctgaaagtgtagcagcttcaccttccggtctggggcatgctaatcacacagttgatggaaagatcttgtccttcctttctcctatgctggtttttttcttctttgaagagaggaaaggagagagaggtataggtcttgtctctacttgaaggtgttttgtcatggagtctgccacaggaatccctggctctacactcttatcatcttggaactgacttctctttctctctgtgtgactggtcccagatgcactgcagatgcaagtctaatttcttctggttcatgcatgtgtaaaccttattttgccccagataatgaatgggatgttgaatttgggttcaagttgtattgatcagtaccactattttttttcaattgttaatggctgttgacaaaacttgcaagttactatgcactggtgtaggaagtacatgatcctgtttgcaaagaaaaaatgattgagattaaccatgttgctactggattgttcaatattacaagctatgtatgttattcagacttcaacggtgcatgcatttcatctgattattccatactctcttcgattcaagattgactaatttacaccgacatatagtttattatatgcaaaaccatagctttcggatagcatttagaaatgttaaccattctgaccacacaataatcctacgttgataaacgcttctctcaccagtctcatgatttgtatgtacgatcttatctagttatagctctctagcaacttgattgcaactttgaataatctatttctcatttcaaatcgaagataaaataattgaactatcgaatcattaacatcaatagtaccgtacaagataaaactgaaaagaggaatagaaaaccaaacctttaaagaaatctttaggttctaaaaaaaataagtatagaactctctatattctccattattaatatatatcctgcatttaatttgcttggcaatattctcctctgttaatgcgtcaacatccgtgccttgtcaaaatatcacctagctaaacccatacctgaccaatcatatccatttcacaatacgaagatcggctaacttaatcaatttggaagttgattgtcacgtctaatatatcaatgacgctagtttaattgatttcctaatacgctcacctatatatatactttttaagtttttgttacgatatgtataattaagagcaactccaatagaatggccaagtaactacccaagctaaattttagcaaatatagggggaaaataccattcaacagtctctccatccggatggccaaatcgcacccctcattgaccaaacttggagagtctctctgcctggctattcgtgggctccacactcccctcccaccccatctctctctctgccctggctagagcaagaaggcggcaacgatgccgcttgtgaacggcgatggctaggaaccgcacaacggcgacggcacggaggagagatgcgccggagccagctgcgaccgccgccgtcgtccgcgtcgtcccatgcagcgactgtcgccgtcgtccacgccgtccctagtcgcgaccgccaccgccgtccgcgccatccctagccgcgaccgccgcccccgcgtggatttgaccgggcggcgtggattcgggggctgttgccatggtcgtcgtcgtcacgagccgccgccgctgccaccctttgctcaatcgccgttgcctcggggagtgctaagagaagaggaagagggagaaaaagaggaataaggggagaaagatgagaaagaatgggtatagagaggatggatggagaggctgttggagtaaagaacgaatttgacttgacaaataaaatggagagttgaccaaatagacatttagagagtcgaatttagagaaactattggagatgctctaagctagctttattaatagtacgtttcaataatgattacctctttaattggaccgaggctcctgtgattgatgtaccagctgtgactaccacagctgcatgcttatgcgtgtaagtgatgcactccctccgttccataatataaaggattttggtgggatgagacatatcctattactaatttgggcagagatacaacgaatatgattatagagtgtatttattgcactaggatgtgatgtattctagtaagcgaggttagtttttttgatggaggaattagctatcatgctgcctatgaattttaaattttgattttgagaataattttaggcaacgacagcggcagaggaaaacctaaaacttaaaatcaaatcctataatcgacgcagtgctaagtactccgtacacccttattcaaggttgactgcctactgttatttgactatttgttattaattgttactacaaattttgggtgaaaatatacaagaaagtagatatattttgttttcttgacaatgcatatgtatatattcaaattatacatcaccaactttatcacaatttattatcattactattgcatatttactacaattcacacatatatctagatctatcgtaatactctaccaattattttcatcatatcaaatttcatctaaaattacttctatatattttcgtagcaacacgcgtggtatcttcttgtatttttaatggtgagtaggagctagttgggatgagtgcaatgtccctttcattttgcacttggaggaaaaaatcaattaagtaaattaactacttcatgctccgcctagccgccaatcaaacagatttatttctcctcttcacccactatatttttcctaacaatgattggcacaataaaatgcgccaaaaacacatgacaagatcgagaacctactaatagctaggagtaagataactgaataattcattcttatttttcttttttgatctgctaattgacacacatcttatagctagtcatcaagtggcaacttcgggggcatgcctaataagacaaaaatagaaatagtagttgaactcctatataaactttggtttttatttatgagaaaattgattttggtggttagtgtctagctagcttctatggattgtataattagctgtggtcttatattagactagtggtttaattaattatggcacatgcatttggggctgaaaatttattgaacaggtagagtgcacgcatcatgcatgcatgcgcgtgacaaaatgattatgtcattcattctgctagctaagctagctggaaacctcaaacacatactcggtcagtcccaaatctcaatatacttattgttgtaggttatttaaatatagattaagatttgtttgaaaaagactataccgtttattattaaatgatgtatatatggtcgaaagtgagagggttgttaggggtagaatggcaggaggtgattgatttagtaaattatattttagagtaacaactattttaagataaattttaaatcttgaaagtgcatctaggcaactaattatgttggtgattaataacaatgtgattagagatgactaacaacttatttgagtatgagtgaatgaatgttagcatcggtgaaaaacgatgttaaaggcaaaacctctaggcctcaatgaccttgcaaatctcgaaatacaactattatgtcgcggagatagtattctactaatataagattatatatatgaaatttttttcaagaaatacattgacaaacattcaatttcaagaaatatcatcgataagtacgacttttataaaatgccactgtacaagcgactttgtctcggaaataccatcatcgttagggtttcgttagtagtcctccgttaagtattataggataaacggtgcatttaacaatggggatggacggaaccttaacagcaatgatatttatagaacaaaatcgcttgcactcgtcgatgatggctttgattgtttgttaatggtatttctggatgttctctatatgtatgggctcattgataacggcactatatgagtgacaatgagaaacagcgtgagcgaatctgtatgagatgacgtacgcgatattcatatacaggcattgatacaaacttctacacagtagctagtgttgctgaatatagcttggtcgtgtactccctccgtcccaaattaagtacaataaattttggttagatggaacataactataaatctaaacatattttttcagactcatattactagaatgtgtccaatcaaaatcttatatattttagtacgaagggagtagaccgtatgttgcgtccactgtatgttacatgtcgcccactgaattaaatatgaaactctgaaatattcaaagacgtcatcgggaagtgtgttgtaagtcagaaattattttgagctggggaatattagtttaatttcatttgcctctgatataatttgtaaggtgttttcaattttgttcaacgttatacttctctactttcatattagtgggccgggtgctttagcttaaactgtcacggagatataaaagcctatctta

SEQ ID NO: 55523 - DNA, 12719 bp, Oryza sativa
agattgttgaagataaagtcatttctcctgctctagatattccagcaacaaatagcaatgacctccatgaagaaaggataaggaaagttgttctttgcttctgagatcgtgttcataacatccagatgaaaatttcagttaatgcctaaactagaccagcattgctgagcaaaagggcaggagaaaaaaagatggtgggagtcctctatgaccactgatttcaggtaacacatttgatgcctccttgggtgttgaaatgttttctttgcaagagttccttggtgttcaatctgtccattagaagcaaccaaaggaagactttcagtttcagagtgcatttgcatttccaaatccaaataagaggagccggtgggtgaatgtgagcaaagaacaaatcatagacttttttggaatgatattgatgagaattccactgataagtccagcagtccaagtcattaaagttatccagattttgaaccagatcgtttaagatttgccattgttgaattgcttgtaccaacatgggtgtatgaaaagactgctcaatactattcagatcgaggaaacctttaagtgagatatcttccaattttgcgaatgagaataggatgcttaactcctcttgcaaaatgcttctagtccaattatctttccaaaacaaagctgtttcaccagaaccaacagttacctttgagattgctctgaaaattgggattaatctgaaaatgtccttccaccaaaaagaacccttttctgtgtgtgcatgagggggtaaatttgaatgagagtagtatttgttccaaatgagatttacccaagggagatctttcttattgaaaaatttgtccagatgttttgtgagtagggcaacattttgaagaggaggggaaatgagaaaactaaaaatatatgtaaaacaagataagttattagtgcatgattaattaaatattaattattttaaatttaaaaataattaatatattttttaaataaattttgttttttttaaaatatacacgatttaaccgtttaggaagtgtacacctgaaaaacatcatatatccctattgacactcccacctctcactcgtgacgactctatccaatccttctccgtctcgtcatggccacggtagcgccactcacatcagagccccaagatctcgaccctcatatatgggcccttatatatttaacctattagctagaaacaaaagtttaattaattaaatcccttaaaatatatgttggatctaatatgtatcccttaacagcaaagctatgtataatgactccatcaatcatcaataccggtttagtttgcgggccttctcaaatggtttggatgacagttttgctctgcgtggcgcacgttgatctaatctctatcctacgtctatattatattataaaataaaatagtaggacccatgtctcatcctcgcctcgttctctagctccttacacactttgagaaagcagggtatactggaagcagagagggcaggagggcgacagtagcagcaagccgaatcctggaagagcggcggcggctcctcccctcttctctcctaccgttcggttggggcacgggtgcgctcttctctcccttcctcctctctctctctctctctcttttttctttgagagcacttcagaattttctcaattcgctcctttgttatgtaacgaattttctcaagttcccttggatcagttacaaggacttgaacacccaattgcacttttgtcttctgaaggttgaaaccaagacatgcaattcctcctccctctcttggcttgattgtatacgtgcgttgagctttgctgtgactttgtgatgtcaagtttccaaacgctcattgtaccattgcaattattcaaatgaagaccggttgaagatagggatgaaaatggttggaaaatccctataccattttctttttcatatatatatttctcgtaaacgaaatcagaatggtagatctggaaatggtaacgatatcggtaatattggtatatcagaaacaggactgtcggaacgaaatataccgatattggttggaagtcgaaattcatgtcagaatcagcagagtgtggcatagcacacatttaactatacatgtaaatgacattttaactttattcttttatcatcacacaccacataacaccgttatatgatgattaataatatgataataagtttgatgaacagtataaacaaagtttaacaatacttaacatcgataagttgagaagactaaagttcagcaaaatccacatgccacatcatagggttaattaacaacatttttctctggtcactttcccttttttatgggccgcaagcctactagacttccttcattcatggacttctgatgggttaggcaggctaagccgctagagaacttccagaattttttcggaattttgacgaaaattatcatacaaatacggttaccgacaaaacggtcggaaaaacctccatctcatttccgctaccatttccagaagatattaccgtttccatttccaccactgttggttaccgataccgactgaaaacggtcggtgtaaactagaaacggcagccggaaatttccataccgttttcagggttgatgaagatcgatgatgacggtgctacccgagctcaagcttgtagggggctcgccagcatccctgttgttaccttctttcgcaggcgagtgtccaagcacgatctcgcgcgggacagccgttttaacggttttgcaattgagagttacgaatgagatttgacctgtatttgagataattaaatcggacattttcttatctggcctaattagctgaccctttgtttggaccagagtcattcttaaaagtacacaccttggcctttctctttcgcaaacattcttgaacagttgcgtacgagttgggcttttctttatatagcttaacgtttccggcccatgtatttccttctctcctcctaatcgtttcggacgatgcaagaggtggccacgatggtgtgctcagctgccgtacgtcgtcgtgccaagacgagtcgccggcggcgagctgggcctgctgctgaagctgacgccaaattaattaagctcccaaacggccgcgccggaggactatactcacaccgttaataaatatttgacgccgcttattttttaaaatatatttgatcgttccttttatttgatttattgttaaatataattatatgtatacatatagttttacatatttcacaaaagtttttaaataagatgaacggttaaacatgtgctaaaaaggttaaatatttagaaataaagggagtatatttttcaaaaaaaaaaaaagcttcgtggccggagctctgccggccggatttaaaagagggaaagccggaggattatatatggatcgcattcaggtctataccttcctgctttcttcctccgcgtggcgtcgatttccgccgtgcagatacgaggacgccggcgccgagtacgagttaaggcctgaagcggatggacgagaaagcctataggcctttgcagcccatatatacattcctgcagtaaaaaacaaatctatctctgtaaacatcttgttttgtcgtcagagttgcaacgaacagaattgacaacgggacacacgtacagaaaacgaagcaacactgagtgtgccaattctttaaatattatagcatgactacaagaatccaggatttttcttttgacagacacaaaccactaaggatagcatcaaaaccgttaaggtaacatgttttgccggccaaccgccaagtttatagaccaaggaaaattccattttattggcggctaactgttatggaaagagttttttttttgtctccccaacaagaaaattacgatcatttccaactttcgaaagcgccaagaaataaaaacttgtcagttcggattgacaataatatactttactttagatgttatcgaaccgccaaggaaattatcaagaaaataccttattcatggccgctacaaccaccaaaggaagtatcaaggaaataccttattcatgaccgctacagccgccaaggatataacttggcggttctacgtaaccctcaataaaatagttgtatccttatcaactagttatgatcatcaagataacgaataatattggcggctttgttttggctgccaaaaaatcttggattgttgtatgcgcaggagaaaatcgatcagaacatatataagagggaaactttatatggtgaaatagctaagctataagctcaagaagagatgttttcctccgccaaagtctaaggttttggcctcttccttgatctttgctattagcttgattatcgagagtttcttatgttggaacattcattgatttctctcctatattttccatgtcgtaagtaggatgagagtgcacacccccctttttctgataggcttcgacctgtgagcagtgccacccaccattcatatactatcgaggttgtgctccatatttatgggctgagttgctcctgggatgtccaggtggaaatcatgtccatattctcctcatatatctgcactctggacacaagtaggtggaaggatgcttctaaggtgggtcggcaaagcgagtagtacaagtaggtggaaggatgcttctaaggtgggtcggcaacgcgagtagtaggtattgtttggccaacttctcgaactgttaatctctgtcagacgtccgtactaatgttatgtataattagggcatgtttggtagagctccaactcccaggagagctggagtccagtcaaacagtttcaactccatccaatgggagtgaagctggctggagtgctctcacaaaatgattaactagagaggtggagctgggtttggttgctccataatttcactccagatccagttcttgatgttaaatctaagagttggaacctaccaatcaggcccttagccaagcgaagatcatgtatttctttggagtctaaagcttccaaatgaaatatgatagttctgttaatggagccgaagaactgtgctcagcttctcatgaaattgagtcaaacagtagatacaatgaagagtttttagtcataatctctcatgcatgaacgaaggcatgataaaactatcatcttgcttgatttccaggaccatctttaccccttcttacatgcatatgtttaatcaagaagaaaagacaaagagaatccttgcctcaaaattccttatcaatctagctattatatacccctctatctctctctaatatacatatataagctaggactgctcttgttgtccatgaatacatacataaacttattcaagagatccaaaatggtaaattcatgcatgcatcattctttgttctgcatgcagctagaaaacgctgccttcaggtatgctctgcagggtaggctgccacactgatccgcagctctcctgctggtgcagcagctcatctgcttcagcttgtttttgcatgagagacaccatgtcgttcagggagatggcggcggcgtcgttgtgcagcagcatcttcttcagctcctgctttctgaccaccagcttcaccctcacgacggcgccgccgggtgggtcgtcagccatgtcggccgtcgccggccggagtgcctcgtcgtcgtcgtcggaggagacgccgttgaggggtggcggcggcggcggcagcttcaggatctcgccgtcgacgtccatgctcatgatcttgatctccctgttcctatcttgaatcaccatgcaattccccatgatgatacgacgacgaagacgagttttgcaaggagatttgggatgatgaaattacgaggtagctagcacgaccgaatgatcgatcgatcacaattcacaagttagaaatgtgtgtgtggtgtagtatttcttggcgaaagagtagggggttggaggggaggagttatgtgtggtatttaaaggaattgtattaggaggatagccacaaactttggagcatacttcatctctgtgccattggactagccaagtgagctttgcttacttcatgtcatgcctcaccaaaagcaagatatagccactgagaaagtgagaattagtgaaatcgaccagccatttcttttttttttgtctctatcttgttgtcgtccttgactgttgcatgctgatttgcatcagggcggttccgtgaaattcgaggccggttgcgcacgtcaaacatctcggaataaacttgatgtgcattttcagctagattttactattattgtcttttcagtcttattctagtctactataaccttaattttaagtactatgatgttgttgaattttctatatatgtttaacaatttgtcttactaaaaaatattaaaaaaatataaaagtcatgcttgaagtgtctataataataaaactagccacagtaaaacaaataatatttacatatttgtttgataagagaatgatcaaatatatgtccaaaagacaacgacgttatatgttaaaaatagagggagtatatatttttttataataaacaagataaaaaaggtatagaagttattaaataaccgttgaattaatggagcaaatcgactgtaaactacaccgacacttatatttatgacaacaaatgcttcttcctagtgccaggcatgcatatatatgatctcattcttatccatgcatattacatatatgtaattagatggcaaaatcataattttgtgctgagtagagggttttttttgaagatatataattgaattagcaagcaacatacccaggtaaagggggagagatcacaaaacattagtagtaggatacatgtggagcccaacatttgggcaggcctaatccatatccttgtagtggaggtaagaatcatttgcacctcttgtcaaatctgcaagtgaaaatggatttgtgtactggtcatcatgtggtttaatttgcaagtgaaagtgaaactaatagagaccatgcatccaatgcgtgttactggtcatatatatagacaggccgaaaacgatcgatatgatggatcctcctctccatcaagcactaacaaccaatataaacatttgttgcacgatccgcatcatttcaattcagtaagaacgctatgtaccccggcatctatagttctatttatatatacacgtgatgtgttatatatgcgtgctatttgactacaagaatccagaattttctttgcggtcaaaaacaccaaggcaatatatttttacgactacctgccaaataataaccaccaaatttagagagccaaggaaatccagattaatttcttggttgctaatcgtgagggaaagttctattagcggtctaaccgccaagagaactacggagaatattaaacttttgaaaagccaagaaatgtaaccttaccagtctcgaccgacaagaacacatcttaccttaggtggtgtcgaaccgtcaagaatatatggtcattgagtgaagctggagacgatcgattaatgcatccaaggctatgtatccaactatatatccattatatatatggttattgtaatgggataaggcaagagcaattattgtgttttagaattcacaatgttcgcggttgagttttcttcttctccttttaattgtttgtagctaacacagaccacacattaattcaatactttagtgaattgcacattatatcgcatatgttaggaaacgataagcgaacaaacgataaagaacaatagatcaatcacagaagacacgagatttaacgtgaaaaaccctcccaaaataggagagaaaaaaccacgggcgccagccagcaaaatatcttcactatatctggggtgaggttacatcgccgcatggcggcttacaagagatatatatatatggtggaaccctaaaagggatgatgatccgtacgggagacgggcctccgctccactacggaagctggcctttattaagtgcagatgaatttcgatcacaactcaacagcatcgaccaaatattctccccgaagtttcctcttgcaccacaattaattaactaatggtttcgctttcaatcatttttcattcttttggtttgctttggaccctagctgttgttgttgttgctacttccctagctcgttgtcccctctctcctctgatggtgagttagctccaagatctaatcatcgatcaaggcatcctgcataaggtaatggggacctgaaccctgatccttgatgggtaaaacgtccattaagaacaaaatgagactcactcacggggttcctaatggcaaaatactcccccattagtccaatgcatcctcctttggaggatgccactaccacacgccacctcgttgctcccatcctctacttctactaacatggtgactgcgaaaagggtgcatagggatggatggtgtaggtcaactcacgcccatctctctagcggtgtgctctagcaatattgtagtggttcataggatatgaaagagtcaaagcaacggaaaatacatggggtgcaatgcaagaagatatatgaagaaaggaggcgtgtatgtagtattgtacagaagagagaaggccaccagaggggggggggcagtgccaatgactttccttcattcagaatatatcacatataggagaagagaatgaaaaggctcaaagttaaactaaagggaagaaaagtttgtccaaattggaagaaaaaattaggtcaagtaacctaagataaaacttggtatgcaagaataagtgatgacctatatacatacgtgtaattcacttttaaattttttcaacaaggctgccgatattccttaatagaatacagttttgtatgtgttgcataacagattcattggaccctaggcaaaaggttgaagcacaagaaaacaaaaacttgtccttgttgaatgtcgatatcaattaaagaacacgtcctttcacgcacattctaaaccccactatactttttatgatccttcttcctgtacttttctttgtttatacatttgcttttgtagtgctccccataaaaaacactttaatcaagataaaagctttgttagcattagaaaataaagtgaaatgtggacactaatatggtgatcgagtcaaaattatgtggaagactatttcaatccctttaacgagagtgggttgttaatcacgaagagctctaagtagctaattgaaacatgatatatagacaggaaaatactacgagactgtctgcatggtatagacgtagctagggttttgacttctagattatcctagaattgatatgcaactagaaataacaagctttagaaaaaggaaaaaaaaagagaaaccatcagctttcagaaaacacaatattatataatagtaatcaatgaaacttaatggaaagacttccctttactcgctcactactatctccgtcttaaaatatagcaatctagtataaaatgagataaattctagtactttaaatctgaacaggcataaacattaatgtaaatgtgagtatacattcatcattgtaagacattcacacataattactctgctatatataaacatctctagctgagccgacacatacgtcttggtatatattcacaaaattattataaacacttctctcgctatcgattggcatgtcatctaatagaaaaaacttaactaaaatagctgtggtatagtaaactaatatatatatgtgcatgtatatagccttagtggctagtgatcgatggtgcagcattagagcaagtataataggaggttgtaagccgactaaatactgaggtggaggagagaagagagaagaaagaggagaagtgggctgtaaacttacagccggcttggacacataagaaccaagaaactctgtgagagagacaagtgatcatgtattaattgtaaagagctactctctccgttccataatataatgcacaactatttttttaggatgttcataaggcatgcatgcatgtatacaatttattaggacttcttctccattaaattattacttttttttaaatcctccaccctcaagatctcaaattctattggatgcatgcattatatttattagggtgattcaaactaggagatgataataattgtttcttggtctttgggttaatggtggttgtgccttatattttggaacggatggagtaactattatatgggtgagctgagagaaggctgcaaataatcttacagctaacaagttagctgtattattagtcttgctcttgaggtagcttagctcactataatatgtgcaataagcactactctgtccgtcccaaaatatagtaaccttgtatactggatgggacacatcatagtacagtaaatctggatagaggtatgtccagattcgttgtattaagatatgtcctatccagtataaggttgctgtattttaggacggagggagtatcttattagctcactcctttgacctatatctagctaagctagctagctatagctactcgcccgttgaacgctttttaaccacgcgtgcatatgcacacgcgctgagatcgcgcgttttgacgattttacacgcggctcgttttggcgacgcgcggcggacggcgagtggccggcaaggctagtggggcggcaccgccgcagagactaagccggcgacgtcgccgtcgacgagacgaccggccgctatagctattagctgccggaagacgactgccgtccgtacgtcgtcgtcgttggtggtggcgtagtacatacgtatatatgcgcatgctagcttgcttcgcttttacttctccggtcgccgcctcgccggccgacgtcgccacgcgtataagaattgagaagttcggataaactgatcatatagtagtatctactcatcagaatattataaggttaattaacaaaagtcgatgcaattataattatgagatattaaaaaagactcgactcattatgagtttctcaatggagagtagaaaaccccctcaagaatttgaactttaggaacagatcgtcttataaaagtccttgtgatctctctcactcatctagctttgttatttggtgtcactaatagtttaattgttgtttgtgtaatcctctccccaattgccgctattctttattcttagttagtttactcgtaatctgagattttcggaatatccgaaaacatttcaaaaatatccaaaaatattaggaaatatctgaaaagttctgtttctgtattttcttcaagaaagttttaaatgcctattcatcccctctagggaacatcaagatatatactatatatagatattattatatcatttttacaaacttatatggttaaacttgaaaataattgacttatattaaaatcaagacatcttgagttctaaaacaaaagaagtactccctccatttcaaaatagttactatttcaggattcaaaatttatcctaaactaatcattattttaaaatactatttttccttgtcaatcaccttccattttacctcaaccatcatctcacttctattcaaataagtgtcgctatagtcttttttttttcttctcaaaccttaatactccggaggcagttgtatgtaagaaaaacgtctcaatctgtgattaattagcagtttcaggggctgaaggggatgtgttggatagacgtggttacctagagatctctgtcgaatctcagaaataaagtgcatcagaaatttttgtgtagtcgctttttatgtcgttttgctcttaacgacactcgtgcacgcatgtagtcccatttttctgatctgtcgtcgtagagtactgttcaccatacgcacggaggaaaaatgaggctcgtcgcgtcgttctgtttggattcttttgagtagccttgatcgagatttttcagtatatgccatccaattcgcaccattttcaggatatgccacttaattcgcatgactttcagaatatgccattggaagcacgaattccttcattccatgccatttttctctattttcccaaatttctcagatttctaatactttccttcatctttctcacctgaccggacggatttacccatgggcccacctgtcaggagagtagagagatagcctcctcctcttagggaacagatcgatctatcgcaacaaaaaaaagggaaacatatcgatccccttcctccttcctcccggccgacagacgcaacgccgctacgagccgccgccccgaccgcgccccgcccccacacctcgctggcagctccgtcccccgctctgcaccgtgcaaccgcgcctcgccggcagcttcacccccgccccgcgccatgccaccacgcccagcaatggaaaccctaaatatctagggtttgaaggaggagatggagaggggggagacagcggctcgagaagagggcgtgccgcaggcgacggcctcattgctacataatgagctttcttcggggtaagatcatgctcccctgctatctattattgcagaatcgaggtgcaagctcaagagcgtgtaggtcagcaacgattaagcgggcaaactaatgatttacttctctcgtttttgttgttactattcgataggattgatcccgatgcggtgtttagggtgtgcgttcagtttggtcaatttacagctaaacttgttgatggaacttgtgttcatgtgccacgaaagtgcttggaatgggttgtg

SEQ ID NO: 55524 - DNA, 3102 bp, Oryza sativa
aatatggtagctggagagatcgtcgcctgtggcgcccgtccccgcattgtgtccctcgcgcatgtcccctggccgaaaaggagatagagccgcgtcccccaaccagggcgcgcgacgactcgtgaggggacgacgcgggcggaaaaactcatggcgatggacggcgtgctctggggtgacaagttagaggtacgcactacacatgctataacggcggcgtcagttaatagtatttgggtgaatagtgtagtggaagccttgctttgaaattccaattggacacgtgtcgcataggagacaaagtctttcctaggagcaaaggaccgcagtcctatgaaattttcttccgccgccctctcgtctccccctcgcaccgccgccgccgcctcccccttgcgccgtcgccgtcgccgtcgccgagggtgggcttcaaggtggacgcggagaaagcgaggaggcgagctctcctctcttcccctctcgccggctcgcgaatcagtgctgcgcggagagatgagatctgacaggaggaagccgtaggcgttagctgctactctgcgttggcgatgtcgagggttcgcgacagggccgaggacttcaaggagtccgtccgcgtcgccgcgctcggccatgggtacacggaggtgagctcaacggcggcgcgattgcgcgcattctcccccatcttcgctggaatggaagctatcacagatatcgcctgaaagaatattgttgatccacccttgtgttgatttccttctgacagtctcagttagccgcgctcatgtcttctttcatcatccggaagccgcccccaaattaccctttacaaaggctgcaatcaagacggtacgaattctgtctttgctgcaatgctgtggtgatgatttggtatggtagcttgctactatatttatggtttgttttcgtgtagcttgagagtatcagggaactggagaagtttattgtgaagcataggaaggactatgttgacatgcatcgcaccacggagcaagaaagggacaacattgagcatgaggtgaatagtggttacttgttgattttattctttcttttcctacgagcattatggacatctaccgtaacctgctatcatgttaaaacgtactctgcaacctggtggatgagttcattgaaaattttgttgaactactctttcttttccgacggggttacattaggacatcaacactacactgcaatcatgttaaaacatatactttgcaacatggtggatgagtttattgaaaatctaatactaaggtttgtttgacattgcattggagtatctttctttggtactaatactattatcgcatcctgatatattcatactggtaaaatgtgtgcatttttttttggcaattttcggctatggattaggcatgtcttctcaactttttatctgtctaggtcagtgtttttgtaaaagcatgcaaggaacaaatagatatcctaaagaacaggatccatgaagaaaaaggtggaagtacaaagacatggcttggtacaagcgatgagagctcccggttggatttgatagctcaccagcatggtgtggtatgccttcttattcttgccatggatcaactattttgctaatttccaatacaaaatgcagtagcactcttgtgttttcaatatctgcacatggaggattgtaccagtaaaatctcatttgttctgatatatgtttgctacttcattttccattttacagatattccgggcattattatttgttaatacagtttgtaatttgtatatatatattttaaactaatcaactccttgtggataatttatcttctccccttgcacaaaattatcttttactgagacaagttgtttaacacacagataaatctgagtattatcctttaaatagaagaattgacaggtccagcatttattgtcctgatgaagttggatgatgtgggtagctggtagcaggatatccataccttagtttattgctattattggacattagatacgacaaaacagccatgctgcaaccatcctgtaaaaataggtgaatttgaacaatgtgaaattttgttttctgattcagtgctgctagtataggcaaccacatggccatgttgctttcttagtacgaatttatgcaaattacatggtcatgtttgctaagctgtgtgttttccatataatttcaccaggttttgattttgagtgagcgtcttcactcagtaactgcacaatttgatcgtcttcggaccatgcgttttcaagatgctattaacagagcgatgccaagaaaacggattcagaagaaacgagaaaccaaagctgctgaaccatctaagccaaaccttgtattaaaatctgatgtttcaaaggttgaagatcaggaggtctctactgcaccactaagagttcaagaacaactcttggatgatgaaacaagagctcttcaggtaatattttggtgtatatgtattatgctgatgaaattctagtgaattgtcatgcatgattaattatttgcatccttttactcgtatcttaggtggagttgacaaatcttcttgatgctgtccaagaaacagagacaaagatgatagagatgtcagcacttaatcatctcatgtcaacacatgttctacaacaagctcagcagatacagtatttatatgaccaggtagaaaatctatttaagccagtacaccgtatctgttatttctttcttgtagattgtcttcttatgtgaacatacatgtagatattcgtggaaaaaatataaatgacactcctttgctgatgtactgataaacatgatgtgtctgtcatctattatcatccactgatctttttattgggatccatggaacacacatttccctcattaaattaaatttcccttttctgaataactagcatggtctctactttgcatttccctctttataataccatctaacgaaataaggtactccctccattccaaaatataaggcacaaccacccttaacccaaagactaagaaataattattatcatattgtagtttggatcatcctaataaatactacctccgttttttaatagatgacgccg

SEQ ID NO: 55525 - DNA, 8342 bp, Oryza sativa
cttcttctcaggcagttgaagctacaaacaatgtggagcgtgggaacaaggagctatcccaggcgatccagcgcaacagcagcagtagaaccttcctcctgcttttcttctttgttcttaccttttccgtcctctttctggattggtacagcaaatgaagcttatgtaaacgccgtgatttttttttcttttcattctgaaagtggatcaagttatcagtgcatccatgtctcgctaggtttactggccttttacgtgcaatgtattactgcattcttcatctgagactctgccgcaaacgtgacaaagcacgttttgtgaaatggacaagatgctaaccattttatgaaatgcaaagctgcaatcttacgaacgaaatgtaatttttgaacttcaatacagtcagtcactttaatttgcctggtttgggggcataaaattcaattaatcggtgtttacccattttaaaatttgccatgatgatagacgcgctctgaagcctgaaatgattccatcagtggcatgttatcacaagtctacgtttaaataattctggcaccatctaataatacaaattgcgtttaagtacagtaaagtagtaagggacaggtgcaaggcaaaccaaaacagaccaaagctcagatggtttggacgaggcaacacagttcctgatattagacaagagaagaatgaaatgtgcatttaacctctagtcttgtcacattacatctctatctacatcagcatgcttattgcagaccaacacagtgttaaccacccctcttttaccgggttcccatcctgtgccgttggggggagaacggcagaggcgcacagtgaaacgtgaggaagctacagtaacatgctgctgatgcaatgaaaactgtagctacagtaaaaaatgtttttgcttattttcgtcgttactgtagcgtttaatctcgaacatccaaaacttatccaacagatataaatgccccaacggcttgacactgtagctctatgccatttcagttggaacggcagaggatgcgaagccctcttttaccatatgcacccacccattagtgtcttgccttcccgtatttacaaaagtaatagacagaacaagagcaggcacaggcactgggcggagctagagaaaaaacgagagggttcctaactttctttgcttaatatcgacatgtatagctcaacaatattatactaaatagttgcatacccaatacatataagtatcatctccctaattaataacaatatatgaaaaagtgcatggaaaaattaaaaaaaatacgtaccataatgaagaaaccaactgataataatatatatgaagttaataatgtgtcatgggctccatacccaaaacaaatgaatatatcatgcaaaatgtgatgtcaccattttcattcctccatgcaacaatcaccttaaaaaagagaggcatagtttagttatcaacaaacaataagtcatgaaatgatttgacataaataaaaacagttatctattgatatttatcaaatttgcggtggttatattcatgaaccgataaaccacttgctgtaagtggtggctatcggatgtgatttttgatagaagcacttgtggtcactaggcagatttgacgagtcaatgagggcaaaccggcgagctcgtggatccagccattgccggccagcttgctgctgccactgcccagactgccctgcatggctgcgttcatcgcaaaagcaagcaagaaaattaagattaaatcagtggtaaactagcaaaattggaagagggaagaagcaggggtacatgacttacggagtggtggattggatgataggatttagggctgtcataggtcgcggagtcgccggagtgcgtgggaaacgggcggcgtcggcaggcgagcgccgggcggtcgccgcgttgagcacgggctgtggcggtccgcgggcgaacggcgacgtgcgcacgacgggatgtagtcggagatgtcaggcgtggtcgccggtcgcggagtcacgcggagcaggcgagcaggagcggcgacggacgaggagaaagaaacaatcaccgaatcacgcgcttcattttgggagatgaaacgatgccgccgctacgccgtgtcgaactgtcgatccaaccacgtgcgcgattcctcctctcctctcagttgggctgtctctaataaatacacagcgatgggccttgttttgggccagacgaaggaggagggggttccaggttttgggctgagggggtgcccatgtggtgatttataggggtaacaaggtatttcagaatttgggccgggttcctgggaacccccctcgggcctattgggctccgccccttgaggcacagcaccacagaaactaagaggaagaaccagatctgatgcagcgacctctcaacttccatctgctgtctcctcgctctcaaggaatagggctattttttattgaagccaaaaaaatgtgaacttatcaatttattggcatcttgaatagtgatagtgtatgttggatgaagccaaataattgataatgctcattaacaatttggcactaattggtagcaattcaaatatgtaccatgtatctctaccctaccaaagaattggtagtgccaatatagtgaaaatttggcgctaccaaagattataaggtaaaggaccaaacaaccccatagtaactttaagttggcaatggtggtttatcttaaagagtactacatccgtcacaaaataagtgcagttgtgggaatccgtgttgaacgtttgaccatctatcctatttgaaaaatttatgaaaatattaaaaaaatagtcacacataaagtattatttatgttttatcatgcactaacaataaaaatactaatcatagaaaaattttaaataagatgagcggtcaaacgttagacgcgaacagtgcaaaactgcatttgactgcgttcgtttggagaacaaagggagtttgtttgtttcgttttctacgtgcacgcttcccaaactattaaacgatgtgttttttgaaaaaaaaaattatatatgaaagtttgcttttaaaaaaaacatattaatccatttttgaagtttaaaatagttaatactcaattaatcatgcgctaatggctcacctcgttttgcgtatctttccaatcttctcaatcccctctccctcaaacacagccttattttgggacagagcgagtattgactttgcacacataggaggagggcataataacttatcttcagatcgaggctgcatttggcacatacttttatatatattataataataataagtagtggttaaaattgtttttagacatgtctttataaaaacgataagataatcaacctagagaaaatatttgtttttttatataaacttcccagcaacgcatgtggtgtgatccagtttctctttaatcaaatttccatcaaaatttcaaaccaaacatagtacaaatagccctcagacatcataggggcagatctgggagagagtggctttcgctgcaaaaataataagaaaagaaaagaaaaaaaaaacaaaaacgaaaaggcccctcggcctcgccatcgccagccgccgccgacgagctccatccggcgagcagcggtggctgccgccggtaagcacccgcccctacccacgtccccccccttcccccctgcctcttcttctctcatctccctcgttctacccgcacctcatcttctttctcttctagatctagaagctgctttttctctctgtcataaccttggtagtaatgcttgctgttctttgtttttctcccaaaaaattttgttaggtccgcccgcccgtgccaagtgttgggtgttgatttgttcaagtctggaggaaattcgagcgaaatggcttcttccctgagcaaatccgacaagaagaaggtgctggattttgcggcatggagtttcaacatcaccacgtctgttggaatcatcatggtcaacaaggctctgatggctacgcatggattcagtttcggtgtgtgtgttacttgctaccttcagatatcttggttctttattttgtgatgatgatgttttattctaggcttactccgtgttctgaatgacaaactagcagtatcctgtttgatttaatattgaacgaataaatattactagatcttgtgtagtaattgtagactccagatgtttgttcctttggacatgcaattgatcaactgactaacaggcatctgtaaaccttcagtcatttattttcgcaatgctagcacaaattccaatcatttgagttctagacgatcgataaatctttaactgaacttgtatgcctaatctaatgatgccaaaaaggttcaccagataggcttgctttttttgtgatctaacacgagttaaatatgagctatgaggtatcctctggactctcaaagccactctgttctagctgctatgagcctatgatcagaacttttttttttgtcacaagttgccacactgccttctgaacatgaaaaggaccttaatggaacaccgggagcattgtaacttatctgatttcttatatccaaccagatttatgggctgcccctcaacatgtttcatttgtatgataatggaattatctcctgccatgccatgtaactgattatgttctgtgttttgcagccacaaccttaactggccttcattttgtgacaaccaccttgatgactatcgtgtttcggtggttaggcctcagccagccctcccacttaccactgccagatctgattaaatttgtgatcttttcgaacttgtcgattgttggaatgaatgtgagcttgatgtggaactctgtggggttttatcaggttagcaaaggatggttctgctagctaaattccatcatggctttgaactttcaagtttcaaaagctaaagaatccttttgttctcttcagatagcaaagctctgcatgatacctgcatcatgtctcctggaggttgtcttcgatcatgtacattattctcgggacacaaagctgagcataatggttgtgcttataggtgttgcggtctgcacagttactgatgtcagtgtaaatgcaaaaagtctggctgctgctgttatagctgtttggagcacagctttgcaacaatatgtaagttaaaccaacctatgttgtacttgtatggttatgtcccatttatcgctatgagataatactgccttctattcctatagctgtcctttggcaaccataaacatttttacgggggagaaattattgcatggtggcacaacaatgactctgcttatctatgggtctgcttattgacgaatgatgaataattggcagatggcactccctgaatcattgttggttccctgtagtccttgttagttatgaataattggcactccttaatcattgtttgattttgtcatttcttaagttatagccaaatagcaccttaatttcttttccttacctggacgcatagacaatacaattttaactcttctattttcctttgcagtatgttcattttctccaacgaaagtactctctgaactcattcaacctcctgggtcacactgctccagcccaagcaggatcccttctgctagtggggccctttgtagatttcttgttgacaggcaaaagggtggatcactttggtttcacatcgattgctttggtaagaggcaagcctctttacaatgctctgtatctgatctcactgatatacatgttctagtttttccataggtaattcgccttgcagtttggttagttgtgtaatggtgatttgctgctggttggcattttgctggttcacattctgtaatgttgcaagtttatcaaatggcctagactagcattatgttatatcttgtgaccaaagaagtctttactttacagcattgctcgttatctgtaacttcaaacaactatagtctatagctttccttttgtgtgcaatgtcttgctttttagtaatctataggtaaactgtacttgattagaatattgatgaatttgagtgcatgtttgatttgtttgtatgtatttgacctcatattttccattttatcttacgatggcatttttatcattctgcagtttttcctgactctctcatgtgtcattgccattggtgttaatctgagccaattcatctgcattggtcggttttctgccgtatccttccaagtcctgggccacatgaagacagtgctcgtgttgtcccttgggtttctcttctttggcaaggaaggtctgaattttcaggtagtccttgggatgatcctcgctgttgttgggatgatatggtatgggaacgcatcagcgaaaccaggtggcaaagagcggcggagcgttcttccagtaaggtctgagaagcctagtggagcattagacgagaaggatggcagtgagaaatagtatgtgatctgcgatttatatgacaatttcttctgtgaagtttttctggtgatgcaagtatgatatacaaaggaaaccttgccaggcgttttcgtttaccgctgaagccatagattcgccatctagaaactcatcattgtcatagctataggatacagttaatatacatttgtcatcgcatttttttcgttctcctgtacattccttatgggggagatggcatagatgttctacagggttgcaagacagttgtccgaaaagacaatgtagtaattgtttgtgataacacggagttctacatttccatctggatctgtacagagcactatgctactatctgaagcagttcagttgcattgcagatttgcagtattttagactgaaacacacatgctgttctgtactagtggtgttgagctttgttgttgtagtgcctgcaagtgtcaagtgttcagattaactgattaatttgttggttctctgtggcactaccattcttccaaatgatgaaagtcaattgctccggtagattatctatgtcgtcgttggtgatgggcctaatccacagccgatggtccagatcatgcctgccatgcttaattagtagtaggtgacaagttgatttgtacattggtattttttgaaatatggtgcttgtcaataacatttattagattctctctaaagttaaaatcaattttttaagttaaaactgttaaaaccccataagtattaatttccataaccctttgccgagaaggcgcttgaagcccgaatacagggtccacggaggcgtgtctcttggcgtcgtcgtcgtatggaaactatattgcaattttgtttgttcttgtcagtaattaatggttatgtataaacgaatttggttcctatttataaacaaattttgtatgttccttcaacattcaaatttagatgataaccacaggaattgagaaagaatagattaatttgaatgtgttacgatcttgtgagcgacaacacaaaagcactgagcgagggcaatacatcccagtaatacgaatttaattcttcgtcattacgagtgtaaaaagtaccaagaaatcaaatatattaaagtaattccatagatcatacatcttgtaacatatatatgtgcgtagtgttatacattattgatgcgtagtgttatacagtatacaatatttagctaacaacaatcaacaaaacatttttactagcaatcactaattttgagccttatcaagcatcaataatttagttgtggttgttctcccagaattgagcttggagccaatccacggccttcttatccacttgaaatgccttagcaagaacatcatccgagattggtggatttgatccaaatactgcattagcaatggtaatcgctccaggattctggctgctaagtgcagcgatggcaactgctggcttatcatagcttggattgaactggaagtgaatgagaccttgtgggaacacgaagacatcacccttgttaagtgtcttggtgaatagcttgttttctccgtttgcttggttcgatgtaacaaaaccaacatagagtgtaccctcaaaaaccgttaggatctcggtagcacggggatgcgtgtgtggtgggttttgccctttaggagcatagtcgatccttgccatggagatgccaagggtgttgagacctgtgagtttcatcacgttgatcaatgtaacattggatccagccttgctcttggttgtgtccatcggcttgtcgaggttagcttctaggaagaagtcatcaacattcacatccttagcatccttgcaggggaacccattgacacgtactgcattgaagaacatacaaaggtcagatcaaaagctagaaacatatatatgtacaacatgaatgtctcggatcattg

SEQ ID NO: 55526 - DNA, 2820 bp, Oryza sativa
ataacaaaaggctgagctagcttgtgactggttcatctcctctaaagtctgaactgatcttgaactcttaatagattgcatctgggaaagaaactatttaatttgatggattcaatctatcttaattcccagtcaacagctaggttggccgactaattaattaattagattattccagtgcctgtcatgcatgatgcatgcattagatttattatgtcttgcctggctctgttatcaggtgcagagaaacatattatgataaagatagggagatgaattttatctctcaagaagattttaaaaaaatgataagacaattaaattaaattaaaatatatccctttacaaacatacaagtttgatacgacacctataagttgtaaaaaaataaccgtgaatgtacgttaactattactaagaaccgagtagattgaccatgtcttctctatccatgtaaaatatacttggtccctttcgtctctgcatattcaggcatccatgtgtgttacgggaatataacgtctgaatgtctgattaattagtcaagagctagcacacatgctaattaaaagggaagttgataatgtcagtattgcagttaattgctgaatatatcaacacgctctctgttgcctacagctgccgagacagtttcaagctaataactaatggtactttggttaattcagttgaaagctcaacagatcaattacatcatcaattacatcggccgccggctcttcattctcctggccagatgcatatggatagctaggagaggagttaaaacaaatactagcttccaatatggctgtgtttggcaaataggattgagaaataatatcccaccctccaaaaggcaacattgcatcttagccatccattcttcacactttatttaatcctagccattcatctatttccatttcccaatccgacctcccatatcctatttgctaaacataccctatatggaaatatttatctttttagcgcttcttatattatacttcctgtgtctccaggagtgtgttttgtatataaaaaaagggattataaaaaaaaagtaccacaatttttttaagtaaaaaactttcaaatataattgtagtatagttgtaatttaattctacaataattatactataactacaatgtgacttgtaaggattaaaaaatatgcaactttatagctaagttatatcaagattagaatgtaagcatattgtaagtacaatgtagttacaatgtaactatagtgtaattatattatagttatactacaactatgccatagttatatttgaaagcttttaccaaaaaaaaattgcgacagtttttttttagcaatttccaaaatatagatttagtgaaaacacttcaagccgggcgttggatctgggagaaaaaaccggctccccgccaatcattcccatccactcattcaagtatttctctctcccttgtctcgctcgcatctctctcccttatcgcgcactcgcttactctactatctctctctctctctctctctgtgtgtgtgtgtgtctcccaccgaggctttgatgcagcgatgacgcgtccccataagggcagctagcgccgatggcaacgggaggatcaactacaacgacgacaacgaggaggagagcaacccatcgtggcaaagcagcagatggagcaagtggtggtcacgccatcgtagctgacaacaagtcaaggtcatttatggaaagaatcaccgggtcatcacattgcagcgtttgaggttgtcgaagaaagcccgatccaaccattagaggggaggaggaagtcatatatagccaatacattttttttaatgtttaaaatttctaatgtttaagccaatgttttttttatgtttctttttgttagattgtaatgttgtactaggaattttaatgttgtttcatatttttgtcttcagttcattgtaatgtcgtttcatgtccgatcgattaggtcaccaactccgttgttggccaaatgagattcaggatcagatggtctttaaggggttctttaggacgtgcgtggtaattgtaaagtgtgaaattcctacattcaaaggagtaataaactcttgagtcttgagcaatcgtaggtttgaaagtaagacactacaggttgattattggagttattgaatggttcacacctataaaccgtttactagttattgaacagttcacatctataaaccgcccactaagctagccaagcaataaaaagtcaaccaaaatttcatttcttacataatttgtttagattttgttggtttttaaagtaattaatggtcatgtataaaggaatttagttcgcatgtacaaacatttttgttatctttctcaagcatgtagggataattgagaaagaatagattaatttggatgagtgctatgagcttgtgaacaacataagaaatataagtactgaactagctagggcaatgcttccccagtaatatgattttaattatccatctttatgagtgttaaaaaagtacccaagaaatcaacgatattaaattaataccccagatcatacatcatgtgacaaatatatatgtgtactgatatacattattcataaaaagaatcatataaaatatcgagtttaggattacatgaagtatacaatatttagctaatataataatcaacaaactctttttactaccaatcactagttttgaaccttatcaagcatcaataatttagttatggttgttctcccagaactgagcttggagccaatccacagctttcttgtccacctgaaatgccttagcaagaacgt

SEQ ID NO: 55527 - DNA, 13994 bp, Oryza sativa
  unsure (1)..(13994): unsure at all n locations
aagctttcctgaaattttgaagcttatgcagattcatgcattcgacgtgctctcctccagttgttcatggaaatattaaagcgacaaatattttgctcgatgctcagctcatgccctacctcagccactgtggattagccaggctaagccaatttgtcagtgccataagaacggtcagtgctcactagttttccatgttatattggatagtgttcttacttctgtacataatcattagtgatggtgatatagttaatgttttacttgaacaattctaggatctaattgttgtcatggattgccaatctcttggagttcttactgcatacttaacgataaggaattttaagtttagacagagaaggatgcattgagaaaaaacgatccataaagttagctttttagggaaaagggtttgtcctgttgatggtgaggctgtttaacctccccatctgcttgggttcaagtcctaagaccaaggcaccgggctggtgcttatgtcctttggtgaacgctatagctcttgaactattttccaaaaggaagaaagactaaattaataataagccagtttagacccatacttttggaattttgtcacgattgcttacagttgcatctcaaccaaaatcaaaggtaggtcgctggatagactcctatacattatagtgttatatcaaaacaagctactctcccttgaaatatttgaaagatgtatatgtgtgtgtccctactaggatcaaccgtggtcccttcagaagtgggtagaaaaatcacacacatattaaggggatactggtgtttttcaaagtcaatgatatatcttctgtataatccgttgaccgttaacagttcctcacctgaaaaaacaggactcagaagctctcaacagtggtaaaggctatgttgcacctgagcttactgacccagcaacagatagcatcaaggctgacatttacagtttcggtgtgattttgctcgtgcttttgactgggcagaaggcctttgacaggtatatgctcacttaatcttgtacagctgtagtctggttctctaatgaagttctttttcctcttcagttcaagaaggcagaatgagcagtttctagttgattgggcatctcctcatctccataaccttgattctttggaaagaataactgatccaagaatacatgcatctatgccacctcaagctatctctacgttaggcaacatcatcttactctgcatcaaggtaactgtccgttacctttttctggtacacattacttagttgaactatgctaccttgaggatagaagccaagctgcaaattgaaacaccgcatgcactactccttaatgcttagactctgctcctaaatgggaattgaaggggattatagctgaaaaatgtctaattactgcggtcctaatgatttatgaattcatcgaatgaatttcagcaccctatatttgtgatcattactggctgtatttcttccttcaatgcagaaatcaccagagctccgtccgccaatgacagtcataacagacaaactactgaagcttgtccagtcgacaggtcttcaaaagaccagcacgacgacacaacacttggaggttgatgctcaggaaccctctttcaaaacaaccagaccgtatttcgagccatcctttacaggtacctcactcgataacacacacttccatttttgttcttatattcttcatttcgaagccttattttcattgctctaatttagtaagtcaaagtgcaaccggaggctgcatctcccagagataaagcccttccctccacccccccaatttctgtactcgaggagcggtactcaagtatttcaagcgccgcatcactttctgcacaccctgtcagtttcaaacggagaaacccaaagctgctgtgctaagtggactgcacaagacttgaaatttttcatggttgatcacttgacctcagagaaccgagcgaagtggactcttttacatccaagtcacgcgtggctagatgtattaggaaccgtttaactccacaagtttggactcaaatgagccggcgtgagcatggagatgctgctcggaatgctctttctagtgaactctaacaggcaggtccagccttatcttcccctgactaatcactttgtgcctttgtggtcggctccaatacccttatctttcctaaccgtcttgcattctaaaaagatacgcatcctggcagtgtctcagcttagctgtatagttcgttgtctggaaccccgggggtaacgatgttcgttagccagtgaccaatgaactataaacacgatgccatgctggtcctgatcaactcacaatgctgctcgattcagtcacatgcatgacatgcctgttctgctgtgagtaatttttcttggatgatatgtgctgaatccagcagatcccatccgtccgcatgacatactgccaatttctagaaaactcagcgaactgagctttagttcaataacctctttactaatttgtggcattctagtaactcaaacacactagcaaatgcctctcccgtggcaggcaggcatacacgggagctattagtgttggtacatgatcttagtgtacaaatcttaaccatctccaatcttgtcccaaatgcagctagctatcttagctagcgaaactcagatggagatgctgtttgggatgcccctcccggtgaccccgggcgtggagaacggcttgagcagctcgtacggcacgatgccggcgccgcacctgttcctgagctccgggtcgttgttccgctcgtcgacgatgccctcgatctccttcatcctccctgcgaacctctcgaacgccgccttgaccctcggctccgccagccacgccggctcggcgtgctcccccatgtactcctcgtcgggggagtgcgacgacaggatgtccagcgtcgccatgatcgtgatggcctgcatcttggacggcatggtgtccagcagcacgtgctccggcatctccatgaacttcttcatctcctcctccttgttctcctccaccggcattttcttcctcatcaccgtcggccggttcgggaagtagccgccgtagtggtactgcccgaagttgacggcggcgtggtggccggaggtcacccacatgatggtggtcaagacgccgatgagcccgtcccgggtgtccaccgccggccaccacggctcgtccttcttgtcggcgtgccccttggtgcgcacctcctcccaccacgcccgcacctcctcgtcgcaggcgacctcctcgtcggacttgtagtagaagtcgatgtaatccgacgcccactgcttgatggagttccagaccagcagcccgtcgttggcgtacgggtagtccttgatggtgagctcgagctcgccgtcctcctgtcgaacggcgagcccgcggcgcaccaggtcctcgggcagggcctcggcgtcgaagcgccacgtggcggcgtaggcgacggagctgagctccatggcgtacctcccgggccagaaggactcctcgatgatgccgtcggcattgatgaggctctccctggccagggcattgatctccatggtgtagcggaagtgtgggtggaggaggcggtgcaccgggtgcatccggctgagctgccggttggcggcgatgatgtacggctcgacgcagcagtgggtgcggagccagtggctgacgagctggtggtagccggtgtcgtgggagaggacgtgcgccttggcgagcttccacagccacgacgccgtggcgtcgggcccgtggacgaaggcgcgcctccactgcggcctcgttggcgactgcggccgcgccagctcgatggcgagcggcgacagcgtgccggcgccggtgaggaagaacaccgtgcgggagccgtagagcgtcgtctccggccgctcgcggacgcggtgcacgtaggggaggaacacgtcgtggtagtccaggatgaagagccgccgctgcgccatcgcctcctccaccgtcaccgactccacgatctggctctccagcaactccttcgtcagcgccgactccggtggcccgtacacctccgggtccagcttgctcacgatgggaaactcctgcacacgtcgatcgatcgccattaattaattggtgagttcggttttccttagttgctactcacaccatttgagacttttttcctcaaaacttttaaaaacagacattcgttcaatgttaagcaaaatagaaaaaaagggataccactagatttgtcatcaataatactttacgactcgtatgtttgtctatttgcacaaatatttctacaaatgaaaaatagtcatacaaactagaaaagccaataatggcgccatttatttaaagccatttaaaactttttagctaaatattgagagggaaattatctagcgaaagggctaatgtttgcgcactgcgagcggccacactttattttctgctaagtttaattatataactaaagtttatacacctaaaatttttaccacaaaagtttatgtccgattttaatttggattcgaattcaaatgtttttttaatatataaaatgagtatgtattaaaagtttctacatataaattttaaaacctatgcattgcatgggctatttttatgattatataaatactaaatttttaccatatggttaatatatggctatttttcaattaaaatattttttgtatcatttacagcttgttagttatatatacatttttaaattctaaactacatcaacataatactaagttgagagtttaagatgggtataacttcatgccataaattgaggaagaagggaatatgatgctaacaaatgacaaatagtcctagaaattagaaaaagcaatagtgtcatttatttaaagccattaaaaccttttagctaaatattgagagggaaattatctagcgaaaagggctaatgtttgcacactgtgaacggccacactttcttttttgtcacgcgatttttatttttttgttaagtttatataactaaagtttatacccctaaaatttttacaccaaaagtttatgccagattttaatttagattcgaattcaattgtttttaatataaaatagtatgtattataaaagtttctgcatataaattttaggaaacctgtgcatttaattcatgggctacttttatgattatataaacattaaaattttaccgtatggttaatatatgattatttttaattaaaagaattgtttgtatcatttacaacttgttagttatatatatatttttaaatttcaaaaccacatcagcaaaaaactcagttgagagtttaagatgggtataacttcatgccataaattgaggaagggagtatgatgctaacatataggatgcatattttctttttattattgaatcctttttctgctaaagacactaacatgtttttaaatactggagtacgtgatttttaatatacccattatggatcttgggttcgattcctagtctcagccacccagcttttacccaaatattgtactgtttcatttttttgtcatataaagtctctaacatgttttttaaatactacataatttttaatacccattgtaaaaaattttccatctgccactgtaccccttgtttatttttctactgctatatatcttttctctcctaaagacatcaacatatgtatattttttgaaatatttattagtataaaaattctgggttcgccactacacattaaaggatgaccaggacgggacgagcgaaaattcattctttttgggggatgacgtcatcgaaaagtgacgtcgtcctcaggtgaatagtgtatgtggttgggaatggcggtgctaccgttaggagctggatgcagatggggttgacgccagccagcacctgcctcgcgaactcctcgtctctgaaccacgagaacctatctcctgcgcaatgcaaagccaaatccaattgatccattgcttaatcaacatgttactacctcgatagcttaatcaacatgttactacctcgatatttatattttaatatatgtcgtcgttaagtttttttcaatatttaaccagttgtcttattaaaaaaattatataattatcatttattttattgtgacttaattaatcatcaaatattctttaagcatgacataaattttttcatatttataaaaaagtttgaataaaacgaatgtttaaatattagttaaaaagtcagcgacggttatacattaaaatacattcggagggagtactaattagtactaccgattagcctttaatcatggcacgtaattaattaattatcacgtacgctcgaacatctcggggacgtcgaagcggaggacgtggtcggtggtgtcctcgatcatgcggacgaggcgggggatgacgccgccgacgatgttggtggaggtggaggaggaggccgcggcgccgccggccgtggcagtggcggcgccggcggcggcgagctgcgccggcagcgggatgccgacgctgtagaggccgtcgatggccgggaagtgcgggaacctcagctcctggttcgccagcagcggctccagcgccggcagcatcgcgtgcagccccgacctcagcgtcgtcgcgctgaacgtcatccccttcacgtccgagaactgctcgtcccgaggcacgtacaccggccccctcctcttctccgtccgcggatctaattaattacatatacatttaatccattagcagtggctgagccagaaattttttgagcatgattatggagataaacataggctcaggtctaagctgtcctaggtttgtcttcgatcattattactcccttcgttttaagttataaggcgttttgattttggtcaaagtcaaactgttttaactttgaccaaatttgtagagaaaagtagtaatatttttaacctaagacaaatttattatgaaaatatatttaattattgatttgatgaaactaatttaatattataaatattattatatttgtctataaacttagtcaaacttaaaatagtttgactttgacaaaagttaaaatgttttataacctgaaacggagggaataggtgattaatttgatgtgaaaatgatgtaaaatttctgggaggtgaggtggggttaccgatctcggtgtgggggcggccggtgcggcagcggcgagggtaggggtgttcgtcgccgccgaggacggggcggaggtgctcgatcttgaagtcggggtcgccgaggtcgttgtagacgtcgtagtcgtagacgcggtcgaagaacttgcgctcgccggtgccgtcgccgcgcagcgtctccagctccttcttcctcagcgcctcgatccccttgggcgtctgcgccggcaggtacgactgcatcgatccatggccgcgctagacgtcgttgatatgatgcttccaagtgttcatggatggtgtgatggtgagatcgatcgatgtttgtagtaccttgacggtgaagaagatgcggcggtcggggttgtcgaacttggagtggacccaggagttgcagtcgaaggtgacggcggaggagtcgtcggcgccggtgacgaggcagatctccttgacgaacatctcgcggtggtgctcgttctccaccagcacggcgcccaccggcccgaacgtcgccggcacggcgaactccgcctcgtacgtgtcctgcttcatcgtcctgtgcgcgaacgcgctcaccgtctccttctccttccccgtccctgcatgcatagacatggtgttaattactactacatgtgtttgtccatgcatccatggagcttcggctaagccatggatatgttgtgctgctcacttgggtcgagctcggagctgacgagctcgaggaggagcgtcttgccgatgaggtcggtgaggtcgtcgatgccgcgggcggcgtagacgacgccgatgggcggctgcacggtcaccgtggcggtcaccgtcagcgtcctgtccaccgtcacggccgacgacacgccggcggcctgctcgatggtgctgcacctcggcgccgcgagcctaccggcgcccctcctcccgggcccggcggctcgccgctgctgcagctggctgctacagcacgccgccgcgggggaggaggccggcgacgccgcgaggagcggcgagccgacgacgacggtgctcgcgttcttcgccgcggacagcgccagcggctggttggggtgaatcatggtggcgagcgattgatcgggcggcggcgctcttgctcgacagcgcgtcgcccgccggccggacgctcgttgaacgatatgattcgttctgatctccggcgtctgtggtgtggcgccctagttaatatatagctaggctaggctagcttgattgatcgagggattgggacacgtgcgtgtattgccaatcactcatctctctctctttccctccctgtgcacttgctgttacatctcctatatgttctcctgtgccatagagcagctaagctagagctagcagtggcctctcacaagattatttgctacagctatttcacactgtaggaagacaagcaagtgtgtgctcatccccgatttagcacatatatacggtttttcctccttcatgacatttccgaatagccataaaactaattaaaaatcgaacaagatgtatcaattcttggtatatcactccaaacttccatatttagagcactgactacgtacactacatccaagttcaaatttgatctttgttatttgtttttaacttgtataggtcgattttaaacttctatgtttatgtagtggtacataatctattggtctatcttatcaaatttcttcacacgtaaaaataagaggacatgacatccctttccttgctatcatattttgttaggcgttatgaattatggtatatggaaaactaaatggttgaattggaagtgggttacatttttccactgtgccgagagtaaatgacattccctagatctttagcccatttgcattagagaatctccaagtgctacatattgattacgctaccgtgctatcatccgcaaaaaataacacttcatggtttgtacaatattttgagtcgattttctttgcctgggcagtattaattatcgtaccaatacatatatcggatatgtcctacgtatggaaaaaaaaacgactctttgtatattttcacgaacgcgtaaaaagattacacgttgatatattagaaaaaaaatatttcaattacaaaacgcaactgcctggacaagggagagaaaaaaaaaaatcaaaaaccgaaatatctactataggtactacgcaagcaaagttaaaacgtactccatccggaaaaaaaaaacttntcaggatgaatttgaaaaaaaaaataattctttcatgaaagaatggtgtaaagtgtagtcagaagacgtacttcacgcaaggtaaaacgtcgttccatacatacgatattaccatgaacgtacttctcgcgacccaccttttcgtccacaggagtcaggatgattccacatatatatacgtagctatcgtgatgaacaggacacaagctagggaacataaaattccaacaatatacaaaaaaaagtactcccttccttaaacaatattgctaatattgcgtcgacgttgatcactaatttcttttaaaatggttgaaataagaaaaaactaatgcgtatgaagcaaaaaaaaaacttttgtaatacgtaatcttttttagtatttataaatttttgcattaaaaacaagattaaattaatttcaactttgtatatcacaaaactatatatttaaaaatttgtatcacaaaaattatggatttaacataattttcatttacaaaataatagatttgtattagaaaatcacatagatttaacatcagttttatcacaaactaaacttctgctatggatataaactataaaatgtatagttcttaatatcctcataatctgtagatgccttaaatatgcagatatgtgataaatttgacactaaatatgtagttttggttaaaaaaaacgcatatttgttttgtgatagtttggtcaaatcatcgttttataaagtttactctaaaaacaaacattagaaattaaaagtcagaatacccgatatttttttgtaaattcgtgcctatatatcgttcacacaaatatgcatatatggattagaccggcctgctctccccgttacacgtctctatctcaataaacggctggatatatatagatgtaaaattaccagtggagtatgaattgaagcagggtcattgccagagagaccgagacttgccacactactacagtcacagatcgacaagcgtgtgaatcggcacgtacaagtgtatggcaaaatggccaatgccaaatctgaaggtgacaagactgtacatatccttctctatcagactagctatcactgtacatgtgtctacgtctaagctaccattttaccatgcgttaaaaaaattactctacttggcaaaatcgacaatgaaggtgacttgactgtacatccttctctatcagactagccatgtcactgtatgtgggtataccgtttaccacatgcgtgttaataatataattacttggcaatcgatcgagagtgaataattaatatatatgacgaaggtgacatgactatgtatccttaattccctatcacaaattaaactagctatatcacgttaataatttactccaagattctttttttttaaaaaaattcacgtacttatattcgtaggtgtatatcacatcctatagattgcgtcacagatatttgtatatgtatgaataatacttatcttcaattaatctttgtgtaataataatgtacgttgttccgcggttataaatggaacatgttaatattttcatttatgtgaaaaaatagggctcataaatctccgtttaagattcatagtatataacactattttccgccactataattaactactccctccattccaaattgatgtacatatttcatagatacactaaaaccaaaaaaactaataactctctcatactatatttactttagcaacaaactcgatgcatgcaccatccccactatttcctagccaatagcaaatcaagatattgcatgtgggttataaatatttgtgtgcatggatgcatgcattaatgtctatttactccaatgcacaaataacaaatagacttaatgaatgaacataaatatgtatatcatttagtaataatcttaaaaaaactatatgtagatcaatttagaatggagggtgtattaaatagctaacactggacacatcatatcatacactttgttccctttcctccccgcatctccctatcttatcactttagcgcgaggaaatgatggaaataacagtgcgaaacgtggatacagtttcctatatatattagccaccatgatgcatggcatataatagcatgatggttagtaaagtggtaaaaaaacaccactaaaaccactcttagcgctgcatcttgggttttaaaattttaaagtgaaagataactggttgaaaaataaaatcgaatcgtcttctctccttgtcttccatttaaattccatgacttgtcgtactttgatatgatcttttttggctttacttattgaaagatcgccgggaaaaacctgtccgggtacgtgccgtccgtactcggctcactcgtgctcctccgccgcctcaacttgcacggcaacctgcgcgacgagctccgcctctgtttcagccgcccgccgccctccgtcaccggcagcgccgcctgctcccgccctcgcgtggccgccgccgtgctggtgagaagagagagagggggggggggtgggttgagaactgataggtggggcccattgattttttttaagaaaaattgctgactggcctgtcacgtagacccaaaaccactccggattgagtcgggggggttatttgtccggtttcaatagttgagggtgtagaatgtctgattttcgagtttgggggtgtaattcggtcgacctcgatagttcggggggtaattcgtactttttttctaagataaatgattgaacatatgtcaaaaatcaacggcatcatatattaaaaatgcaaataagtagcgtttctgtaatagtacagaaagaacggattaaattttattaaccacaggacccaacaaatacttttttttggagagattggctatcaccgaagaataaaactctcctgcttttcctgtgctgggttaattaaattttatttaccacaggacgtcccacataccttttggttttcacgtgcactggtgatgtttctagctgtcttgcatgagctcaagcatctcatcagcaggtacagtaaatcaggacaaaactgtacttagccggcgtttagctaactactaacagtgtttaattaaagtacatgcatcatgaatggtgatgcctcaagttcgattgagttggattattgttactgctcactaatagtagtctgaattagtacggctgcccgatttctataatctactgaccggtcagtcagtctaagctgtaatcacatcaaatgcaataaatgaggacaaaattgttacccggagtttagctagctacgtacacgttacagggacccttaaacagcaacaggttatatgctaccttgcacaccggacaaatcaggaaaggaagctttggttgtatgtgtctgtgagtgtttccatcaaaatttggaaaaaaaaaagcatttgcaggtccaatttatctcatcaagttaaaatttaacatacgtgtaataccgctaacatcgtcatattgcaaccttgtgttaaaagctataattaatcgagaaaggaaaaccatagagattggagtgctggtgtgcaaggatatgtaagtttttcctttttcttcaaaaagagagagaataaagataaaattatgcgaactacggtagctcaactctagaattaagaaaattctagttctgcgaaggatgaagagagaaggcaatggaaagaagaggtccgatatagcataacacaagcgacaaggcaaagaggtattttagaagaatcattttttcttcatacagagccaccaacaacggtgcctcactacgtgtatgtctttgtaattcattcggtttttttaaaaaatgagtaaacatgttcaaattaataaataagcgcggtggtaaattgaatagatataaaataattcagatttcacattaataaactagtatgatttggatatcatgtatactagtagcaaactgtaggcttatatacaagtgtgcaaccaatgaacggctttgcggttcacagcatgcagtcctagcttgcaggataatacaacatctaatatatagcatgtgctgccaaacatgtggctgcgaattaataataagccgtatacaaaaatattcctctcaaataacatcagagagatctcaaatgaggaaaagatgtgaagtatacatgttgtactgtcatgctcccgtacgtattggcctcctcgcactttcttgaagtgactatagtactgttgttgatatgtccatatatgctttcacttttgaggtcgacaatgaatcggcctgtttgaaatgtgaaaaaagattttcattcatatatatatatatatatactatgagttaaactttttctcatatagctcctaccaatatataagacattattaactgtttacacggtttacaatgcaacattatactttgacaatattttttctaaatatatttttttaaaaagaaaattaacgtcatataggtacttctaaatacaaatctagttataacatatgactttaattattagacaaatgttataaataataatttttctaaaagatagtaatgtcttatattttgagatggaaaagagggacattcttgtaaaaaaaattgcattccatgtccgagactactagagattgggtgttgtttat

SEQ ID NO: 55528 - DNA, 7207 bp, Oryza sativa
aattcctgcagccccactcacgacagttagcaatacaaatccatttagcagctgcaataatatgaactctttcacaatgctccaccttaacaacctgacaacacaaaacatataaagtataattgtcaaatgtacttagcactttagcagaacagaggtaataacagcaaatttgaagtgacaataaaaaagtgtttcttattttccacttggggccctttattctttgttaatgtacagcctatcttatattatgtttaacagtccaactcaacgcatgattaaatctatttgataggaattttccaggaaaagactgtaaaagagtagcaactagcatgtcagtttttggttcacacaacaatgtgtgacatctttcactgtctattgttattattatcatcacctcctcttctatttggacaaaatactcagcactcatgtaccattcaggtgataccaaggcatacacaattgaagtctcaaacagatccggtgcagctaaaatagtctggtggcaactgatgtgtatacaagggtttttctctttaaattgcttagaaaaatatgaggaatatattaatcaatattctgcaacaatgggaaaggagggtgtaaagatataccgattggcatccataccttaccaatagcaccaagaacaacagtagcatcagaacatccatacacagttgcgtacttcaatggtgccaatatgtagataacagactcatggcaatttaaaacctacaaaagctgtttgttaagaaaaccaaaaatgtggagtcccacctccatgatcacaaaattaaatacacaaagcagctacgtcacaatacaacacagaagtgggaatttcttgaaatagagtaaaacataatactgacacaaacagctagaagctggagtctgcaaaaaattttcatcatgagaacagttgtcatatttgttttctcatcccaattctacttagcagcctatttccccgcgtcccaaaatatagctatctaaatttttcgcttcggttttaacattttacatatcctggcccaaataatgccagtttaagccatcatctccttaatcacccagatgtggctaacaatgtttttccctttcaaactaatactccactggaaatccagagattaaaacatattctttattgtactaagagtagcactagaataaattattacattcaagatatgtaagcatatgaaaacacttgaaactgttttaaactagattcgcataaatggttctttttatcaacattaacccccccccccccccgggggatttagtggacaatgcaaacatgtagaaatgtgaaaagtgacatatctttgtagtcttttcagcatccaaaaatagtttatggtaagcagctatgatccataccttcactgaatgtcctttgacatcagacgcgtgcttgacaacagaagttttggagaagccttccacaaatgttgtgtttctgtagtatgcaggatttgtaccagtcggtgtgctgttccttgcattactagcattggcatcagccattgtgacgtctatatcggaagtaacctgctggctaacttcctttgatatggacttctcggtagagaattccagtgaagcagatatattctgtgagatccaatcatgaacctgggcagcaggtacaggggcagcaggcatgtcaggatcagaatttgcaaaaaaagtggctgcctggcttaagggtgttccttctgagaacttcagtagaaatccaaggtgttcaaatgtctccatggtcaatacctgcacaaaaattgtgaaatacagttattttacattctgaagtgtaatggtctaccaaagcccaaccacaaagaatcctaaggaataaaaacctaaataggacgcacaaaggcaattgccttcagaaaatgccctcaaatgtaaggtgacaatgtgacatgtatcctaaatttaacaaaaagatgagttcttacttgggccagatatatctaactgggtcaaatatatgctacctttatatttgcttgtctatatattagtttttaaaaaagaatctgctatctcaaaacatctactgatgggtggtcttcgttttttttctttttttgcagggcaccttctgagtgaagttaacacctaattgaccaaaagcatactcatacatcacaatatatttagaggtatacttgtctgagaggtaggtttgcatataattttacaggatcacggccctggagttccaggcatccaacacggagatgtacttttacgggtcgattctagtgttttgagatatagaaaaacaaataaactccattatcagaacatgctatgcattattctgtcactcttttcccacataaagcttcactctactaagaaaacaagatacaaattgtcaaacagaagagtaatcaagtggatatcacaaatagcaacaagctcggcaaacttaaaagaaagaaaaggctgcgtaccagagaatcatcaccttcgccctcaacagaatcggccaacagagtaagaatattggccatatgcttttgcagataagatagctggtgaatttcctcatcagcttgagaaggcatgaatcgacggctattactgcgtacaagctgcgaaataatataaatataaagagtaagtgaaggaggtaccatacgactcatattagcaaaaggaacagaaggtgtttttatgtcttttgcttgatctgttggtttggggaagggaaattgggattgaccctaaatgtaacacctagaacaattttaacatgtaactgaggttggtagcgtaaaagctttaaatacgagaaattgaataagtaggagaaatcttgattttacaaaaactttatacaaaaaggcatgaatactaaccctctgtagccactgttaccacccaaaccagaaaaggcacagggcataggatttcagtttaaaaatattgctgatagacgaaacagaggtttagcagctgggaattttgtaagtcatatttgaatgcaccatagtctccaaattttgaaatttgagctaaaagagtggaagtaaaatattgtgcctatagtgaaattaccaggtttgcatggttccagatcaaatcgaaagaattaagcaaacatacaattgactgaatctataacaaaatggtcacaacaatgactggtcgctcaattatggcaaagtctgtgtgcttctgagtttactgttagcatacaagtccaaccatcatacgtaatttgatgcaaccaaccattcatttctgacggccaccaataaaaaagataaccttaaattgaagtcaagaagtgaccccagcatacggtaccatccatagcatccaataagtatcagcagctaggatcttcctttgcactatatatctagagctgcacgactttttactgtggagcatttcttatagctcgagtgagttacatcacatatcaatttttgttgtgacagcagataaacggcagcatcagctgcaacatgaaggatataaggtggcacaacagccgccttgtttaaatcgacggcgatgttctaagctcaattgggcacatgattaaggctaagcaatcacacatccaaggtgttctctgctgcagaggaatcatgggagcacccaaattctaattataaagcaacgggggggaggcctagatccctgacctggatcggggagagcgcggagaggtagccgtcgaaggcggaggtggagggccagacgtcggtgacggcgggcgagtccttgtgcgcgcggggcacgaggcgcttgtacgactggatgtagaggaagagcagcacgtcgcggaggtcggccctgcccccgccgccggagtccagcgcggggtcgtccgcggggagcaccgcggcgagcgtggcgagcgcgagcgccgcctgctcgtgcgggatctgcagcgcctccgcgagcgccgccgcggccacgcggcctcctccatccgcggcggaggcgagcttgtccttgacctgggcgagggtgtgcgcgagcgtgccctcggggaagatgagcttggggatggggaggaggccgtgctcgaaggcctcgcggcgggggcggagaaggagcggcgggggggacggggacggggacgcggctgctaccgccggcagcgtctgcggctgcggctccggcggcgggtcgagggggtcgtcggccatcgccggcggcgaggaggaggaggaggaggagatctgggaggaggaggagaggagggggagagtggcggagtgcggtggcgccgcggaaatggcgagaagggatcgcaggggagcgggtgatttttcttttcttttcttttatttattagattatattaaaattgttttccattatagtgggaattttgtttggtatagaaccaaacgactcgtttgttagagctttaaattctaaatttaacttcatgaattgggtctagtataaagttgtggggcagtataaatctagctccacccttttagcagtttcatcttttcacttatgcttatgcttattagccaaattttgaattttcaacgttaaatttggagttgattttgaggttttctcatcgaagtttatttttcaaccttgctttttagatcgttaagaacacgtatataaaagttttatttgcagattatttagcctagttcattttgtgagagcgctctagccagctccactccaatttagatgaaactgaaattgtttggttaggcttaagatccaagagagatgttgctatatctggagctgcaccaaatatgcccatagtaataactaggtgaaaccccgcgcattgctgcgggaatttaatatgataacaaaaaaaataacgtgtaaaataactagataacatcagattaagtaaattaatgtggtttatgataatttaaatttaaatagtatgtagaatggttattcaaacgtaaaaagtaaggtggtatgactttatgaaagaagaaaagtagggagatagtttggaccgtaaattaatcatctaaaggctaaaaataattgatgtgatatgacttaattagaggaaaaaaggagaaagataatttggaccatagattaatcatttaagcactaactaagtgaggatgaactatataagtatataggatatcataaaacataataaaaatatacattgaaacattatgtgaattgtgttgaatgataatttaacatgtttgtatttgaaaagctcttaaattataaaaactataaatatatagcatgtttgcatgatgtttaaatgtgatgattgttagtggatgatgatgtgacatcttgttaattagtggattagtagatgatgatgtggcatctttgcatgttaagcttaaggagttagtgggggataactttatagtaagataggataaatgggttttgtagtttcagacatggcaagaagagttgatagctctagcaatccaacgttggttgttggccaaaatatggcacatgtaaggccatgtacaagtgtacaacccgtattaaatcataagctattaaccttgctaattagaaatatttgtgaaaaaaaataaacaaaatatcgttgatatagttaacaacagcacaatattgattcttagcacttacagaaagaaaacatgattacatgagggtgagaaaaaacaagaaagaacaacaataaacaaaatttgagttttcgtcgtctcaactattatattgtaaagatattatctctaaataatttaagagatcatactaggctctactattgagtatgtcctaaactgtgttttttatatgaggaaacaaatggtttaatctatcatttatcgatcaaaactggtaataatttattgataaattttttatagtcatatgattgtaaaaataaaccatgataaaataattatcaaaatcagtttgaaaattaaatatttaaatttaaattctggctacgggtaataagccaaaagacaagcaaaggagtagtttatactttttgtagaaatataaaagtttccagttacaattttgtggcatcgaaaatattctgatttattttaattgcatcgaaattagctatttattattttgtttggcagttcattttgtcgcggatttttaactctcaaaatttagcagtaccaatgtttgattaggtagcaaactaagctactcttagcattattacctttccaaattttgttagttcagataatttcctttcatacgaacactatcaaactttgctaaggttgtgttttttttttttggggaagagctgggaattactattgctcaaccgactgctaaggttgtgtttgttgttacatttctcaactcatcttcctcgttttgcgcgtacatgctttttaaataactaaacgatctttttttaaaaaaaatacgaaagttgctttaaaaaatcatactaatctattgtttttaaaaaaactagctaatattttattaatcatgtgctaataagttatgcgtaggacaaactaactcagcctaaaaagttgacaatggccaaaggtgtcaataccaaaattgggtatgaacaagcccttagttacactggaaggccgcatttggacaacctattgttgaaatttctagcagtccgaaaaaaaaaagttgaaaaacaggcctaattttggaccgaactgaggcccatagagctgatgcctgatcgtcgctggcccgtgggccgtttcccaactccaaaacccacgctcgctagctgatgagaaacggcatgatgggaaaagagaaccgaaaatttcagaacattttgaaattaattatgttcaataattttgtcagtaattaacttaaaattacattttcctgtcacggtttcaaggaggatgcaggaaatatatattcattttcttagatcgaccgagtagaagattctaatttctaaaagaacaaattaagccgtcgctttattacaagagactccatttgtggttggaaacagttgcttttgtaatggtcaagttcttttcatttttcaggatccaagacttgaccctaattaggacaaaactgaattttccgtgcttgtgaaggaaattcccacggttaattaatcgacatcgatcacttcaattcagattggctcctattggtcaattttatttaggacatcttttttagagctcttatacataggtca

SEQ ID NO: 55529 - DNA, 7508 bp, Oryza sativa
ttaattcccaacctaaatcctgccaaaacacaacaagttgagcaaaattaattaacaagaagaaacagtgataatacttaatttcttctgaacccaaaatacccaacaacaatacaagcactagataaccttctttttttttcttcaaattgacttggaccaatgatgaaacacgtaaagatcaaacaccaattaattaacaaaaatcaatataaaaccgcgctccaaaaccagtcgcagagaccgatcaaccccgatccaatcacatatcgtattcgacctttataaaaaaagtctaattattgcctagctttttccatggccttgtaaccactccccttatatttcttgtacaagcactccacctcaactaagctagctactacaagtcctaatacttttgctacctatagctagctagcttccggtcagaagaagctaaggagaattagaagctatgtctacctagcttggaggaagaagaagaagaggaggagggattgcggcgcgatcgatcgacacgcgtcgtctaccgataaattcctcgcaaaatcaatcgatatcatatcgatcgagtctagaggtgatgagatcagatgtgaagtacttgaggagctgatttggtgataggatcgatttaattgctagctgaggtgatcatcatcaaggagaagaaagagatagtttatttgctactggggatcagtgtgtttgcatgggggataggccatggcagcagcagctgcagccacatgatcagcaggcggcttcttgctcagtcacggccgggatgatgatgcaagcttctgcgacctcctcctccatccatggcaacaacatcatgtaaaaaccctaactcctatacgacttgtgcctttttttttcctccctaattcgatcttgttttatcagaacaaatttgaagcaccttgctcaatgtttagcttcttgatccccttttttgtcttatcatcagaactggagctttaattaactccacaattctctctctctctctctctctctctctctctcttctctctctcttgatgctgtctttcttggcagtgtaatttgtggactcttttacttttctttcgagattatggagtgctttttgaactttcaagattacagaatgtttttcatgttttaatttgtatgatgcatgaatgggttgattactaatggtgcatgtttgcgcaagataagtaactttatcctggttattaagggttccatttggtgtatatttaagcatctcttaattaatttgaagagtggtattcgaagtgggtgtacttattgtttgctccaaatttaataaagcgatgggtgcaactaattctactagctggtgccgaggcttttcattcatttccttaattttgatatcttctaaggatttttacattttctaatactggatttgtttagcaaacaacgtatattccaaaaattcctttttttattttatcccctttcttggagcaggaagcttagcttctcttaccaaaaccttaaaatatgcagaataatttagcaactactacagctatagctactgtcagatcagatgataatataattttgtgatgatttctccatttgtattaatttgtgcaagtgcagcagaaaggatcctgggggaggatacgacatggcagaattggatcacatcttcctctacctcaacagccaggatcaagcatcagcagcaattcaagaacaacctcgtaagccacatatatatatgcacttattactgtcaccaaatcttcagacttttcacaaattatgcattatattcttctccgaaaaaagatgtgatcgacaaggatgcagagggagaataatctttctttggtcatattaattaattaatttcatcagatatatagcaagcaggccggcaagcatctcatctagctacctcgattttgacaagtgaatatatatggtcattatcgaatttttcgacgacagatatggagtattagctatctatagagatcgatgagcaggcagcgatggtgatccatcttcttttttccttctatttgatcgcctcaaagctttactcactgacatgtcattttcccaaaattttctctagatggggaggagagagtgacgtataacaaacacctggagatgtgtgtcgttcttgctaggatgattatcgtatatacacatatatgtaatgctaaagcaagctagatatatgcatttttaaccttaatcatccagagacatttgcaacaacgatttgcatatatatgtatatatactactgctagctagctagctatttacatatctaggacatcaaacatgaacacacacatatatattctctcccttttgttcactttttcatacttttaatttacattaggaccataagtgtgaaacaacagaacttacaaccacatgcatgttgacatgctgttacaccatttgatatatgtgttaatatattaattaatgccatgcattacatatagttaatttggacaatttagttcatcaacatgcatatatttttggacatatgtttctcagtattattctgaattgctactttactgatctctacatggatgcagaaaccctcaacatcttcccttcacagccaatgcacgccggcgagccttctcccaagggatcatcatccatggcggctatcaactcggcgccgtccaataacgccctcgccatcgccgccggctcttccaagcggccgccggcggcggcggcggccggcggccagccgtcgaggctgaataatccggccgatcagccgtcggcctccgggaaggacggcaaggctgccgtcgtcaaggtaacttaattagctccgatgatctcatcatcttcgtcttcagctgatctacgacattctgagtggctcaagctcacgcatgagtttgtgtgtgtgtgtggtcgtctcgatcggccgatcagaaagaaggcggcggcggcggcgggaagcatcacggcggcgcatcgtcggcggcggcgtcggagcacgagggccccaagacgccggacgccaagacgctgcggaggcttgcacagaacagggaggcagccaggaaaagcaggctaaggaagaaggtaatttgttaattaattaagttgcagttaattatagttaattactcttgctctacctggctggtagggtagctgtaaatcgagattaattaattacctgttgtttaattaaccgcactgccatttcaccctactttacgacagcacaggagtatagacttgtgcagttacgacgttcttactccaaatttaagtcaaaattaaaataactaacatgtgtcatgtcggatataaaataaagtcaaaattaaacaaatgagtttgcatgcatgtgagtgtgggggtacggagaattacttaccacctaaaatggaatatagatgtgcaacattactggctacgtctatctgaaaattacgtttctcatgacacttaattaactatgcttttttttttaaattgtgtctcgtatatggatcaatgtgtatataggcttacattcaaaatctggagacaagcaggatcagactgtcccagctggaacaggagttggtgcaaagatcaagaactcaggtacagcatatatacatgcaaatgctcctgaactatacgatgttttcagtaaactaattaattgattgatttgtttcatgatgcatgtctaacgcacgtatcaacatagggtgcaattttgggtggtggagctttttctgccggcattggaggacaaagcccaggtatatataatcatatatgcatgcatacgatcaaaccaaccctaattaattattataattaaatccatataatactcaaaaccacataatcaccaacaaattctctaattaatttgtttactcgttaattaattcatcattagatcaaatatgtcaggaatgaatgcagatgtccatgtgcaaaaacacacaactcttaatttttaaaatacataatggaaacaactaaaatttttaatgaatgcttcctctgtttcacattatttacgttgggttttaaatagatttatacatagatccacgtatgtattttatatatgtgttcaaaacttcaaattcatatgaatgttagtgaatctagacttaaaggattaagagaaaaaaaagaacatattataatgtgtaagggagactaatcatcatcgtcgtcgtcatcgtcatcgtcatcatgcagaggcggcgtggttcgacggcgagtacgcgcggtgggtggagagccacgagaggatgatggctcacatgcgggcggcggtggaggagcagccgcagcacggcggcgtggcggcggcggcggcggaggcgcagctacggcagctggtggacgcggcggtggcgcaccacggcgtgctggtggagctcaaggccgccgtggccagcgccgacgtcttccacctcgtctccgggacgtggctgcccgccgccgagcgctgcttcctctggattggtggcttccgcccatccgagctcatcaaggttagcacataattaattgaatatcttatataatcaatttatagataattatttaaagccggctttatatattatatattaaggattcactaccacaaaatatcatcactgatgacttatcactgacggtttagtgtaaaccaatggtgatatatatagagagatagtactaatgccagttcaccatggttttacccacccaaacggatctgaactggcagtgatatttttacttgacgttttagatgttgatatgatttatcattaccttttcaaatcaaattaatgtttatgaaaattattataaatactccctctgtcccataataatatatatataagggactattccctttttataagattaagaatagcgagagaagactaaaatacccctattaaatgagatttggtttgggtgaggggatagttgagggtcaaaataggtagaaatttgaattgaagttgatggatgtgactgacagtagtacacaaaaatctttgtgagacaattagaaagggcaaaatcccttgtattatgtgatagagggagtataactatatgaaagagttttcataacaaataatccactaatatagggcctttcattttgatgtcattttcaaccataccatttttttcgcaaagttgctaaaaaaatatccacgtttagtgtgttgccaaatttgatcaatacataaaaaatcctgccaaaattttggcaatattgccatcttaccaaaattttagcattgccaaaacttggtaaggtttattttggctataatctgaacagacccataatctcgatgttttgaattgcaatatactttttttttgcatatattgatgagttaggatttcttcatttttaactggataaattagcacgtcatccttctgaaagcagaggtaaattataaaagatgtgttgtagtataggcaccctttagattttgagatactagctagattatattggatttttagggtttaagggcgtctacaatatatgatagacatgatatagtcagataattttgtgaaacgcgtttagttattggacatgttggagtacgtatttggctagctgcgcatgccgcgctctacatatataatacataaaaacttaaaaataaagagagatgggtttatacaatgtaatagctaatgaaggggaggatggcatcaaaatatatggtaataatttttaaagaaaatagcaacatatatagactatatggtgtcattcatcactatatacaaattaaatatgttaatatgataaaattcggtttacgttaaaaataaaaaaataaaacccattgtctatgttccaatatgggtatgtagaatatggaccgagagacagaggaaggtgaaccaagaaaatacatgctagcttcaagtttgactaagtttgtagaaaaaaaataatatttttaactcaacacaaatttattatgaaaaatatattcaattattgatttaatgaaactaaattgatattatatatattactatatttatgcataaacttagttaaatttgaagtagtttgactttgaccaaaatcaaaacgtcttacaaccagatctgtttaatatactagagcgacagaagtagcagtatattagctagctagtatactaggttaatatactgcatctgtttcagatggagtattaattaactagatcgacataactgtatattactcatatattgcatgagctcaggtttccataagcttgagttcaccaattaacctactactccctccgtttcaaaatgtttgacaccgttgactttttagcatatgtttgatcattcgtcttattcaaaaacttttgtaaaatatgtaaaattatatgcctacataaaaatatatttaacaatgaattaaatgatatgaaaagaattaataattacttaaattttttgaataagacgaacggtcaaacatatgctaaaaagtcaacggcgccaaacatttcgaaacggagggagtatatagctagctaactagctacctgctcctcccgatattttttttcttttttgttacgtacgtttttagtatattttgactaaaaaatgtcatcattcttcctccgagatgcacagcaacatatacatgcatgtttgtttgcagcacgtttcttccatcattccatgcgtgccttcggttacttcgttcgtcctcgtgcatgcatgcatatacatataatatttgcttatatcagccagtgcacaaccaaacacgctgctcactatacatggatgcaggcaaccaaacacgccctaaacatgtactccctccggtttcaaattagttgacgtttggagcttagaccttttggatgataaaacttggcgttttagcttccatgtgattaatttaaactgatttacccatgtatggctgcatgcatgcatcaactccggcacaagacagtaaaaagatgctttgggactagcagccagccactaggttaagaggatgtgcttgttagatgtgccatcctaatgtatttaatatggataaaacatgaatatgcaccctaactaaccatttctaagtatgtgagatcctgtccaaaacttcaattaatttaaaaccggagggagtacaattaatagctttacatatatttaataaaatacctgaaataccctatatatacgtgcaatatttatggatctgttagtgctctaaatgtataagtatatatatatatatatatatatatatatatatatatatatatatatatatatatatatatatatatatatatatatatggagtatatatttaagttttagtagtgtgtgtagtagccctatacatacatagatttccattcatgcataagagcacaaaataataaatgtagttgtaaaaatccttggaaaaaagtattatatagtacaccactatccatacacatata

SEQ ID NO: 55530 - DNA, 11630 bp, Oryza sativa
atacatactttagcaagctaattcttctagatggacagagtcctagctactatctaatacttgcaaatctcataaaaagctagctagctacattatattatagtagtactatcatatatatctcataaaaagtagctaactagttagtaattagatatacccttgttaattaggtactctaattttctttgcgtgttccatcatcaatatggtatttctaagatattatttttacgtgtcgtcccattaccgatatgatattatttttatataaagtaagtataacttctgatctctatactaattaatacactcatagcaatatttgtgagtattaatactcatagtcatagtcatgcatccacgactctatcatactaatataatattattaagtgatactacatgaactcgaatagttatatttgattatcttgcgaacctatatataatatgattacataactataaatattcttcattattattgtcgaaaactaattgaaataaaatgattatgttgctactagatgatggcgcggcacgcggagccattgacggagcaacaggcggcgggtgtgtacggtgtgcagcagtcggcgagggagagggaggaggcacttgaccgcgacctccacgccacccaccacgccctctccgatgccgtctcctcggactcactcctgctcttccctcccggcaccggtgccaccgcatactccgacgtcgccatggctcacctctcccttgccatctccaatctctcctccctcgaagccttcgtcaggcaggtacgttgttaattactccatccattcaaaaatgtataacgccgttaacttttttacatcgtttgacaattagtcatattcaaaaaaaatattatgacttgttttatttcaaataaaatataatctttacttatacttttatatatttatactaattttttaataagacgaatttgaacgaaaaatcaacagtgccatatattttgaaagggagggagctaagtagttaccacacgtgattcgatcggcttgctaattgtagttgatttttgtttttaattcagttgatggctgcattaggttggttagttggctctggattaagtggtggattgtacaaaactgtgtggctgcttaggctaattgattatctagccagctagctatagctgttgtactgtctccttttaatcctataactaagaaaccctatccactaatgatcaatggtattggctagctgggcattttaatttgttctgttcccttcaacaagagcccatacttagctagcacctagctagctagagccaggcaattggttaataattaattaattacagtgattgaaataaaacctgaaattggataatctttttcttattaacagctagatctctaattaactaaacttgcaaaaggcatttagtttcgttaccacacaagtttaactaatacaacgaccaccgtcttaaaatataacaaactagaactgaaaagggcatattctatcactacgaaactagtcaaacatttgttcaaatttgtattattaagatgtgttctatccaatatttatattttattttaggatggaaatagtaattacttgaataactccgtatatatatactatttgtatgataaagaaacataatggcgagtgactcttttaatatggatctaataacattcattttgtgttataaaaattcacactaataggatgattgttgctcaaacttttgtcctaacaaaataaaatacttgttagaacctcattggttgctcatactctctaataaaccaaaacggcttattagggaataaaaaataatttatagttaaaacttttagggtgaatagccagttcagtccttcaatttttgttcatgagtcgaattagtccttcatgttttataatgtccaaccaagaccctaaaaattatcatgcggcttaatatagtccttagagccacttaaaacaccacgtggacatgccacgtcattcgtgcatgtaagataacatttaaatgtccattttaaccttcaattttctatcaaataaagaaaagaaaaacaagaagaagcaatcataaaacaaagaaaaatgttaattttttttatctatcaatgctacatatttttgccaatggtcaaaagctttttttttgtgtgttttctcaatagttttcctttatttcctatgaaaacataagggtgtaaaggacatttaaatattgaatttgcatgcatagatgatgtgacatgtacacatggcatatttagagggttaaaggactatattgaatcacacaatgaacttaaggtacttgtttggacaatacgaaatgacagggactaaattgatccttaagcgaaagttcaaggatcatattgggtattcacccaaacttttatatatttgttcgcagcgatttaaaagcactaaaatgaaatcacagtgaaaatatcttaaaatcaagtttaaaaatttaaattttagcttctgcttttgcttggatttattattaggccaaccgacgaggctcttatacaactttaaatataatgcacgagtactctactgactgatgaactgatgacgtacatgcgtatgatccaggcggacgcgctgaggctgcagacgctgtacaagctgccgcagatactgacggcgaggcagtcggcgcggtgcttcctcgccatcgccgaccactcccaccgcctccgcgccctcacctccctctggctctcgcgcccgcgccaccccgaccaacccgcccctcctccgcctccgccatccatcaaccctagaaattagaccacatccatccactggccctggagatccaatggcccagcatctacactgctacaccactgcagttttacatacagacagacagacaggaacagattagtttcaaaagtttcagaatactacagtgcatagagagatgatcaatcgatcaggccttaatttgcttctttgacaagatcagatgatttcatttttaaattaggagggtagcagcatgctgtaattgtgcatataatgtataagaaacagaaactaagctgtatactagtagctgctgatgataattactagtcagtatgaaaataagtgctgagattgatgatgacactgtaatgtttttgtcttgtggcatatggtttgactgactttgcttcagagttcagacttcagacacagaatagagactagagagtttaggtatgccgcactgtcatcttcttcctttcttgtctcaactgcaaattacttcagttgcaaggttagtagtaggtgaaatttgggacagattaacaatggggggcttagttaacaggtaacgaatgtcaatgttacactcatgcatcttcccaatctttgggaaaacacatatattgagttacagacagaatgtggtatttctaggctcccccactcataaaaatgtgatcttgtcatgtggcatgcctatgagtttcacaacaagcacaccaagaaatgccatcacaaagatgagtttcctctgctgttatagtctatcaagagcatcaacaatggccttgcgaaacgcgtcgttgtggaggaaaaacgacgatacgtgccctccggttacccaccggacctctgaacctggccatgccttttggagctccattatcgaatgtttggggatgtagccgtcatcctgaaaataaagagaacatttgcttcagaccaagctccattaaatattatatgataacgaaaaaagcatattgatatctgaaagtacagaattaagcagatgacaacagtactacagagaggcgtgggtaattattggaaaggagcaactaagatgatgtgttgctgcaaatgacgcaggcaataaatctattttgaatgaatgcaaaaataagatatgagtaatagtaggaaaccagaatgcactagtactggaaggtgataatgagttactcttatcaagaaatttacgtgctaggctgaaatatataagacacaggaagggtaaatcatgtttgagaaatgatgatagaacattgacactaaccgttgcaccaacaaaaatgacagcctgtgggttctttggcactggaaatcgagtgacgtcagtcaaagacagcactgatcgcaacctctctcttacttgctcaatagtgattcctgatttctgggccatgtcttctgtcaaagaagttacgtcttgggccaatgttgctgcatctttcctcaatgcatcccaagctgtggcatgcctgtagagcccgtcacagaaaggcaccacagcagaatgcggagcaagaaatggcagcgtagcaattggtgttgggtgcaaggatccaaccattgcagcatgtacaccacctatgtaattagcatgagacgcttgtaagaaataacagcaattttcatatgtagatggtacttaactactgtcaagataaagttttttcccaaaaaaagccatgccagagttaacctcattatctatcatatagcatttttttccgtgtcaataagcaatccaaataaatagaaaaaggagcgcttccgcaagagagaaattaatagaaggggccaaagtacttgaggtgaaataaaagatatttccttgagaaaaatcatctcagttaccagtcttagggaaaaatgtatcacatcaatacttgtaaaggaatcttgaaacgaagttgccacgaaaatgggggtgagtttgataaatgggatgctgcaggttgcttaagacttaaagcattcacattattcaattatagatgaaaactttagaattacatacccatgctgagcccgcatatgcccatcttgccataaccagcctcattctgcaaccagtacagaaggctgcgagcttcatcaatagtagcttttcctaatagtagcaagtcactcacacactgaagctttgacccatgctgcatgcttggtcgccgttgtccataataagggctggaattcatttgagaaatcagatcttgcgggttaggaaaaaagctttggtatcaaaggtggcgtaagacaaccattctggcattctatacaagcctcacctctcaagaaccatagttgcaatgttgtccttcaaaagaggtccaccaagtcgaagtcttctctcaaacgagtgatcaccagtgcctgtaatattagataaaagtttaacttgacccattgtattagaagcccagatcaaatttcaacagctggacaaagaacatttttgcaactcatcagttaataacatggcatgatatgaaatataatatttagaaccagaaagcagatcactcaatatggaaagttgaaacatcaaatctagtcaacttttatttctgtccgatgggatgaaataaacaacattcagctagtgtacaaacatcaatatctaaaggcttgaaaatagtctcttatatagaaaaaaacatgtagatgcatggtacatcaaagtatagaacaaataaataggattaaactgttgtacctgccagatgaatcacacaggccatcttctcaggtgaaactgacttaggtgtaagaaaagcaactcttgcattgtgactctcaggaggcaatgcttcaattagccgtggatcgcatgtagtcctgaaaacaccctctcgcagacaagaactctttgtctcccaaaccgttttccacatgggttgcacggcagttggtggccagttctggcaacgtgcttcagggaataactgtttcaccatcttctctaacaaatcaagtttggtgcctccccatcctttcgagaaaaatggcgttcctaatttggtgcgatgaaggacggtaccatatatgtggtccagtacataatgtactagcccaagattcaccgataccatatccaatgaatgctagaataatgtaagtttcttaggcttggttataaattacagccgtggacactgagatgcctgcaacacaaagtttagcacagaagctagtcaacaagttgagggttgaggtgcattgaactgtaaaggaaaaatactgatcagcatgtgttaagctaacctagccagtaaaaatgcttctttgagcatatgttgtgcataacatatgatggataactacatttgacaaaagtaaaataggacagtacaacttggaattccacgacgcataaccaatgataagatggctaaatttgagcaaaatcataacaggatggtaaactaaggatttccaggagacggtaattctataactccttggtgtcattgtgtgccctatgaggcaatgagcagaagcaaacactccccagaacaatgcagctcaatttcatcagatagatgcacccgcagaaagtaccaacaattccagggcagctaaaagcaacatctttcttgttagccaggtgaagaacctaaccatccagatctggggaaaaaaaaacaacccgaccaattgagctcatcaacaacgttacatctcaacggcgcaatgcaggtgcggaggtgccaagataagccaaactagtctaaattttatatttcaccacgcaattcgaaaactatctccgcaaacaaactctctgtcctcccccaaccaagcgaacaacggatcggttcagaaatcaaccactgtatatagaacaataaaaacaaaaagaattaacatctgggacacacggggcgccggttccagcaccgcacctggtcgaatccgcggcccgcggcgagacgccgttccttttgccgggagccagacaagaatccaccacgggggggcagacagacgcgcgagaccaagaatcgggggaggggaggggaggagagatcccaggtggcaagaatcccctcgatcgatccgcggcggtcgcggggcggcggggaggcgggaggtggggtcagagggtgggggagtcgcctgcggtggggacgcggcgggaggaggaggaggagtgggctgtgattgggggttccgccattggagaggaggggagagaagcgaagcggtgggcaccgcggcggtagtggcgggcgggcgtacgggcgccggatttgggaagcgggtttccagatccggatccggatgctgctctgaggcggggcaggtggggcccgctcttcagtgagtagagcggagcggggcacgaggcacgaggcgcgaggggataaggtggggcccacctgcggcccacggaaaggaggaaggtctggtttggttttgctttgggccgggctgcaaaccaacttgggctgagttcttttttttttcattttcccaaggaataagttcactttggcttccttaactggaggctgaatctaattcgtatccccaaaccataataccggatatctcgaccctcaactgttgaaactagtgcaatttgacttcttcggtggttttggaagacagttccgctgacgtggcgcctacatggctatattgacccggtctttgttccacgtggctgtgatgtggcgcttatgtggcattagaattaaaataaatatgtgtagggccatttgtcattccactatatatatatatatatatatatatatatatatatatataatggagaatttagataatataccatccaatacgcatgccttatatgttttaccacctaatccgcacgccttctacaatataccatcgtgactgcgaattcttctatttcgtagcactttcttcactttttcctatatttctcctcggcgacaacggtgacctcgacctcatggacaacaatggcaacctcccctcccctcccctcggcgaccttgacggcgacgggagtacggattaggccgcacagaacacgcccgcagcaccgaggggaagaagggcgacgcgaggttgctggtgtcgaagtggaaaaccccgcggccagcacgaaggcgatgatggcgatgccaaccaccgatgccagcgagttgagcgtggacgtgaggcgcgcctcggacatggccaccgcggaggtgctgatgagtgccacgacggcgatgtggtcgagcagattgccaccgccgctagatctgccgtgggagggaggcgagagggggcggagggagccaccgacgccgccaccgctggatctggcgcgagagggaggcgagaaggggcggagggccgctggctccacgccagtagggagagcgccgccagtggagcaggtggaggaaggggggagggagtggccgaggcggtggttcccctccccgtcgctgatccccgtcgtcgtggaggaagggagagggggtgaccgagaggaaccgataggagcggtggatccccttcccatcgccgtggaggaagggggagagagtgaccgaggggaaccggcaggagcggtggatcctctccccgtcgttgtggaggaagggggatggagtggccgaggggaaccggcagggtgccttccctgtcgccgcgccggcgagacaggaggaagagggggagatggagcggcgccaccggtgagggggagagggagcggcggcgctggtgggggacgggaggggaggggagtagcggctgagagagagggggagaatggaaatgattttaggattagggtttagacttatgagtttttatatagattgggatcaatcaggaccgtccatcagatcggacggctactgcttctcccacgtcgggtcgggtgccactcccaggccgcccacactattgggccgcatgtacgctccgcgtgaaaaaatttcactttagatccctcaagttgtccccaaattgttcccaggccgaccacactattgggccaccacataggccgcgtgtacgctccacacggaataagttcgctttagctccctttatttgtcccctcaaactcctaaaaccaatgcaaatctttaaattttagttaacccgttgcaacgcatgggtatatttgctaatctacttctacttatactacttaaaaaatctaaaatgtttccatcgtccgtaatttataaagagcgaaaaaaaccaggcagaaaaaaaaaaagaaaacgcaccgtaaaaagaagagaacggcggaaaaaaaaacaggctcaaaaagtccgattcgtacgacacaaaaaaaaatctggaaaaaaacaaaaaaaaacaccggctgtaatcttatcttaactaattaaaatattcataattttcctttcatcacaatctgtttcatccatccggtgattttttgtctgtaggaaaaagggggtcttggatccctgaagaaaagctccaaaaattaaaaaatgacgaacggaaaacctcaacgccagccgtcgccgacgccacgcgggaagtccttcgccaccgccggtcgtcacccacgtgcgcgggtagcccacccgccgccggtcgttgccgacgcgcaagggaagtccaccgcctccggccgtcgatgacgccgcgcggaagatgagagagagacgacggggacggcgccggggcagggctgctcaaaggtggcgccctcacccttgggcgagtgtgcgcaccggcgaggaggcatgcaccggcgccgctgcttttcgccgtccgctccagttctggcgagaggcttgggttttcgccgacggctgggagggatgggcttttgtccctccgacgtcggcggccggctattcgatagaaaccctaagatcgaacggccggcactggctggatcgaaaccggcccaagtagaggcgcgtgctgggcagcttccccagcccaggtccaggttgcggcttggggaggagggagtgcccgcacgtgcgcataatatgccgtgggctgaccggcaggccgggaaaaagtctattctaggtccctcggccgaagaaaagtaccagctaggctgggaaaaagtctgttctaggtccctcagccgaagaaaagaagtttaattttgtgaagtagaaatttgacgaaggctagaattaaaaataagaaatattgaaataataatagcgtagagtcacggtcattgttgtcgcggaagggaagcggacggccagatgcggctgctacctaccgtgctacggtcatcgatcggccgtcgattggtctgagtttgctcgcttattcgctggtcgaccgtgctgctgagccaccccgtagatctacccatatcttcagagtccatgttgactcgcaccgtataaaggtggaaatcaaaccggctttgtttttttatctccctttcctcggaactatatttctttctatcatttgagactttttctagcgagcaaaagtaccaaagcagtgtgaaaataacttcggttaaaatcaaatatttttagttttaatacaccgtagcgaagcacgggtattttgctagtacaatataaaatagagaaagtaagcgatcatcagattgatcggtgtagatagatagtcacatgttacagtacaacatgtagatatatagatagtcagatgttacagttaacatggagattgttggacatcacgctcatggttgactgatggctagacgatccagcgagtggttcaaatgtttcttcagaggatttaagttattttttttggttagtttttctgttacgtgccgactccgatcacaatacatggaatggaccttcggtttttatggtttcggcgcaaatccttggctagtgaaagtgaaacagctagctccactgtaaggctaagtttatttcaattggatcatatgcgtcagaaaatcccaaggaaggatacaacttgaggaaaatttgatggtgcttaaaacaacacttgtatacgatgctcatctcgatcgatcggcttgactgcctacaatcaatacctgttgttaagcttatcagcgttcgtaaaacaaacaaacaaacatacaaacaccaactccacaggcagtaaactttctatccaaagttgaactgaaagcctccaggaaagccgcccccggggaatcctcctcctccatggaatccaccatcgtaatggaatgtgtattgctggccacctcccccaaaaggattgaaaccaccacctcctcctcctcccatattcatctcatcaagatcctctcctcggtcgtatcttacacgtttatcttcgtccccaagaacctgcaaattgccgattgcgcattgttaaaagacacgcgtggcatctgcagcatgtcgatctgattcgaaacaagcatgcctatagctaaatatgggtgaccagaatttatgttattgggacactttttgtctcggacacatgcagtgtctagcatgatatattttgtggatgaaatgcacttcagctagttcttattcatagtacaacaccagggctagaaacttggaatgcatgagagtattttaaattaaccatattaatagaaaatgtcatctcatagaacattaaatacttagtacagttcaattttgtttatttatacctcataagctgcagcaatttctcgaaacatgttttctgcttcttctcgcttatctacatttttatctggatgccactgcagtgccaacttcttgtaggcacgcttaatctctgcagctgatgccgtctttgaaatgccaaggatcttataccaatcttttcttttgcttaacttaagctgcttttcagctctcattagtgcttct

SEQ ID NO: 55531 - DNA, 8677 bp, Oryza sativa
tcataaatacattggcataaagttcgtcttcggtggcccactttattattagtagtactaacaatagtaatgtgcaaatctagttttatcaactcatccactgcatgcataggtgctagagaaacatatgcaacctacgaacccacgctgcaaaaagcggataacaaagattgctggcagaagggcaccaaatagaaatacatcatggggaagtaaaagtatcatcagatgactaccgtaaaaaacaaataattgtttctgcatattgtctatccaattgactaaaactagatgtttcatccatttggaactatgtttcacgataatttgattgcagcacaattacactaaaaatattgtgttcccaaatctaaaaggaaatgagatcagcacactgcgtagccacataagcagattatttgatgggaactcaaatagcaatatgtgtgttttcaaaggacaaaaaaagaagatatgctgatatatgagcacacttatccctaacatttgcctaggagggtaggggaaaaaggagataggtccacataaaacttgcctggggagatttctgggcagcctcttttagatcctgaaccgctccttcccagtcttctgtaagaagcttagcttcacctctctgcaaccagtagaaggtaacatacaacaagcagatgaagtaagagactagcgagatctggctataacaactaattcaattgcattgtctggtgcataacttagtttaccaaacaaatatacattactatttttttttgcatcacttattcactcataaagtcaaaacacattatttgtgcatactgaattacattttttgtggtttctgaatagcagttgcagatttcccaagtcttgtggtttaaaatacagaattagaaggacaggctaatgcgactgcatgtctgcatgctcgcagcttgctcaataatgtggcatcagagtgcggaaggagtccaagattcaacattaattgcagggcaatcagactgaaattcccttctttttttcacggaagtttcaacattgaataataagaactttggtttccactctaaattagaaaaatgtgtatttctgtgcatgccaagcaagtaatgtcacctgtgttaatgcatcaacaagttctccatctatgttgagtgcttctgtacagctacttatagcctccttgcctcttccgagtttaaccagaaccttacatagcccaagataaagatgtacattgtaagaagtatgatctggatccattgctagggatgccttgtagtcctcagcagacacacgtagcttacccttggcagcattatcttcagcctgcatgcacaccatttgatcctattactatgatgcagtaagcccctaatttgttgatacaaagaaatcatactcacactcttagtcttcttcacaagatttttcaacccaaaatatgctttcttcagttctgaatgttcagggtctagacgaaggcctttctggtagtgcctaaacaattaatattgtcatcactgtacaaatatttaaagctagcacatttatctagtactgcatttgtgtgtgcaggcacaaacaagcatgcacttgtccaaacctaaaataccagacacgctttacctggatgcaacatcatgatcagcaaggtagtaatatgctcggccacgaagcaacaaggcatccaggttatcttcatcttccttcagaataaatcctgtttctgagataacagttgagtagtctttaagtgctagcaatgctttagccttgagaagcttcgcctgaaaaatccatttttagtactgcagcttactgagacaaaattagatgaaatatttatctgtccatggttcctactatcctctgaaatatacctttaagcagtctggagaaaaaacaagcacaattttgttgatgtaatccaggacttttgagaagtcatgagactcaaactggccataagcagactctaatgcattttgagcctgaagcagttgagataattccttttccactgaagaactcccaggttttagctccaggtatttgctatagtcaccctccgcttccttgtacctagacttcagaaaaaacacattgaaacgagtaagggatacggaaaggtgacacatacgtgtaaaactgacaatgttataagtaggcacatatgcttaacggttctttaatggagtctttcagatatggatgtttttttaataataaagtttagacatttttaggacaagagaaaatgggagtttagctatctggcggtggcaagtaattatttttctggtcagtaactttgaactgaggaacagatgtgaatcaaacatgaatggattataatctaaagtaacggatacaacttttttttacctgcacttgtgacgaagcacagatgcacgctgcctgtaagcttctgagtgatttggttcaacctccagcacagcatttagcagaccaagtgatccatcatatttccttaggttcatcatttctaaggctcgtttgaacaaagtagagggatcattatcttggccttctgaaaaaatgaggggaaaaaggatacttagtctaccaggaagcataaaggaaacatccattttgtgtagacgtagtgctgattggaatgaaaagaaacttaggacattgctgatccatgaaattaatatgctgaatagaaaatttaggatggagtggttccgttaaatttcatgagatgaacccatgatggagcagttaataggatccaaggctggctctagatccaaatatcttgtgttagaaacgatccaatggtatcgcagatggatgcagagcactgaggtggtcgaatgagatgacgagtctcgcgttcatcttatctgtatgatggatgattcacttccaatatttgccatttgggggtggtggggcgaagaggaagcgccgccccacaagagagagaagacgggggtcgcagtaccttgagcgaagacgaagaagacgggggaggagtgaaggagaagcagcggcagcagcaccctccacggccaccgcgccatcgccaccatgctctcttagttctgcctgctaaattagactcaaattttcaagcaaatcttgttgaaaacttcttataagaatataccttgataaaaagatattgtgtgtgactactcttcttaagaaatttttatgtgagttactgagtttggataagtacaaattatatgagcttacatttttctttctaatgcaactattctaagggtttgtggatgatattcagtaaccaaattacatccgctaaaaacaaaaatcaaaattaacaagttgaaagtaggtggaactgagcagaggcagatctaaccctgtttcggttgaaccagggataacgcttaacgcagaatagctgatgaggtgtgggtagggaaggatgctcaccggcgagcgacgatgcggtggaagcaggaggacgccgggcgccacctctgctcgcggcggaagcggcgggcgaggaggcgaaatccgaggccgaggccgaggccggatgggatggattaggatgctcaccggtgagcgaatgcggcgggagcaggaggacgccggcgccacctcagctggcaggatggagatcggcggcggccggcgggcgaggagacggccgggacggattggggaggcggaggtcgtcgcctgcctatgggtcatatgcacaggcccatgaggctggaatttttcatctcccaaaaaagttcatctaaggttccctaacttcttgttgagtttaaaaggccatgaaacctctaatcctgtaaaaccggatcggatcacttttgatcccaaggtagtattgcttttcggttttgttgatgtggtggctgagtcccacgtggaccccacaagttaaccggcaatcttcttccacttcactcccctcctcccatctcaacccaaacctcctgggcatccgccaatgggtggggagaagggtgtcggtcggcgaggaaaagctcgacggccgggagcgctcacatcatggacttgcgcacgcagggggggtgcggcgcgggtcccaaccacaactgcaatgtcgtcttcacctgcacgcgtgagtgatgaggcttctacctcatcacgctgtccaagctcctatcccccaagctcatagtcaccccctgtcgagctgctcaaaagccgatgtgttcaggtgtccccgagctccgcctctcgtccgtagaggcgcacgtgcggttccgccgcatcgtcttcgaggtcaactccacttgcaccacattgtggtcgcatcgtcctcgacacatgcacccttctccccgcctctcgccactgccaagcttcttattggctgctagccttctccctgtccccttctctctacaattttgtggttagcttcttattactagttgctgcttgtgttattgtaggctcacttgtgacgaatccgtttttttacaaagtactatattggtccaaacatgagacttgcttccgcttatcacatttctatgtaattgtagtgtcattacagtagcggatgtgaacctcatttctatatatttcttaaaaaaactaatggtagtgtcagtaaatttactgccccacctactctaacagtagattttataaagcatccttagaactttttaatatttaaaataattgaattctaacatacaaccacgtataaaatcaaaagttgaatatttccaatagcaaatgatgaataacatattttataaaaagtatatttatatatttatttatatccatggtagagtacatttgtttagcaagtagttaaagttttaaattcgccaatttcactatatctaagccataattgatccttcactagggatttaaaaaagtcaaaactgagaatttcattaaatggaaaatattcattctggtagcaattatgtatattagcttggatacatgataaaagattaccttaaactaaggttttcggtggcttttgcatgatttgggattatttgtgacaacctcctaatgactcctaatgagtaaattttataaaactacatttgatcaaattattgtaaaactacgtacatattgaaatatgtgtatcacaaaactataaatttagcttcaattttataaaatgaaatatatatttcaaacatgaaaactaccttaaatggtgttaaatctattattttataatacatatttttaaatctatattgtaaattaatggtactctacaaattgtactccctccataaaaaaagaaatctagaacactacaatgaatcagatgaatatatagattcatagtattagaatatatcacatctagtattaggctgattttttatgggacggaggtttgttgggaaacacaaccaaaatgatcagcgacgactgagggtgtgtttagtttacgtcaaaattggaagttttgttgaaattggaacgatgtaatagaaaagttggaagtttatgtgtgtaggaaagttttgatgtgatggaaaagttggaagttcgaagaaaaaatttggagaaaaatgcctgtgtgaagtgcacacgcccctcgccgcggccagcttccgttgctgcgattttgacagggacaatgccggcgtcgtaatccgacgacgagcggtagctccggcgtgcaagcaagcggcgctcactgctagtgtcacggggatggccggaaatggatttgttggatctcgaatggatggatggatgcatcaatggtggcttggctttcatgtcgctccttgtcgttgctgctctttgggtgcaagaaatcccacaagccgtcgctctcatcctacccgatgattgatgcgtatttcttgccccctttccgcttatccgcccacgaaaagggcgccgatttctactcctcttctccccaagaatcactggctcagtggttagtggtgactagtcatcggactcggagggagtgatctgtccgaggggataaggagggcttcgtgttcttgaaattcagttgttgcggcttgctttccgtgcaattcttggttgagatcgcccaatcattgggggcataaatggaggtggaattcttggaggattccattgatttgatgcgtctggtagtgtggtggtgttcttgagtcttgattagtgaggagggagtggttcttggcgggaatgccgacgcgacggtaggggtcgtggtggtggtggtggtgttcttggccgccgccgtcgatggcgtcgcggggaaggactgcacgaacgggttcccggggctgacggcgtcgcacacggagcgcgcggccgcggcggcggagcagcggccggacggcgaggtcgaggcggcgcgggtgctcgatctcctcctcccccacggccacggccacggcgacgaccacgacggcgaccgccacctcacccccaccgacgagtccacctggatgtctctcatgccgcggaggctcctcgcgagccccgtctcttccccgcggcgcgacgcgttcgactggctcatgctctaccgcaacctccggggctccggctccggcgccggcgccatcgccgcgagcggcggcgcgctcctggcggaggcgtcgctgcacgacgtgcggctgcagccgggcaccgtgtactggcaggcccagcagaccaacctggagtacctgctcctcctcgacgtcgaccgcctcgtgtggagcttccgcacgcaggccggccttccggcgtccggggcgccctacggcgggtgggagggccccggcgtcgagctccggggacacttcgtcggtgcgccaccgccatttctcggcatcacttgcacagcgaaatcgcgcaattggtctgaatttgcggtggctttgctttgctgcctgttctttgcaggacactacctgagtgctactgccaagatgtgggcgagcacacacaatgacactctcctggcgaagatgtcatcggtcgtcgacgcgctccatgattgccagaagaagatgggatcggggtacttgtcggccttcccctcggagttcttcgacagggttgagtccatcaaggctgtttgggctccttactatacaattcacaaggtatatgggggaatttcagttcctagtgttgcttgatcactatattatatcattgtcttgctacatgagtgcaattcttggtttgcagattatgcaaggtcttcttgatcagtatacggtggccgggaattctaaggcccttgatttggtggtcgggatggccaattacttcagtgaccgtgtgaagaatgtcatacagaaatacagtattgagaggcattgggcttcactcaatgaggagagtggtgggatgaatgatgtgctctatcagctctacacgataacggtgattgtcggtttgttatgagataggaatactgccttgattaatgcaattttctctagtggagttgctaacttttctagttttcttgcatgtgcagaatgatcagaagcatctgactctggcccatctttttgataagccatgttttcttgggttgcttgcagttcaggtctgctgatttattttcttacctgcttttgttcttatattctgtatcatctatgaacatgtgtcaatttatggtgaatgactcagaccaacttacattcaacttcaaccttgtttgtcatatagcaatttacctgttttactaactgtcaaaaattatggattacctaatatccagttttgagttggcacttggcagtttgaaaatcaatataactacatgtttgcgtgccaaatggatctattatttcaattctactgttcattttgtcattatatttttcccactatagcaaagacactacctaaaatgaagtttagaacttttggcttgggtgtctgattccagaggatacaagaatagtagtattcctattgcagtaatgtctctgactgataaatcttgagtgtgcttcaattcaggccgacagtatttcaggcttccattccaatacacacattccagttgttattggtgcacagatgagatatgaagttactggtgatcttctttacaaggtaaaagaacacaaacctttctttctggatatttactccatatgcatacatgaagatgaattatctgtccagggatatggatatgaatgtacaatgctaatagtttagattatcatattggttacttttttttagtggtcatattggctgcttggctgaaaggaaaaggatagctttattctgcttacagattatgcatatttcctgctgatattggtaaatttccagatatgggcctggaagtgtgatagcataatccggggaaaatagtatatttcttgctaacccatgctttctctaggtaaactatagtttttgggcagtattatacctttcattacctattagctctgtagttatccatatgcagtccctttttttgtcagctgtatgtcaaagccatgtgttggttttttactggagtttttttatgctgttttttactggagttatactatctgtttttctttctaattcttttcactaacatcatttgagagaaaagctgattgtaatcataattctcatgaaacagcaaattgcaacgtttttcatggataccatcaattcttctcatagctatgctactgggggcacatctgctggtgaa

SEQ ID NO: 55532 - DNA, 1251 bp, Oryza sativa
ttcctgcagccctattttccctgcatagtgtaatatgaaaactcaagtaggtctcaaaagaaaatgcgacaagctagaaaaggtacattaggattacaaagaggaaatgaattgcgcattctttctccatagagaaatggtacaactatgagatttcgtaggatgtagaaaagcatttttgtctatagggtcaaaatgaaccaacaataagagctgcaaagcagcacattttaatccagtggagttctggaattcaatacccaaattcattctagacaaatgcatacgctatgtcaaagatataggatactgaccaccgctatactttgatggctctttacccagattttacaataggagaacaacgatttgcattgctttaagcttttgatatgatgtatgagtaaatgaaacaaatgtagctttttaccctgacaggcacatatcctcaattatgataatctataccacatttcacttcatccaccacagcaggctaccgagaatgaaggtggacaagttcttaccatggcgatcatgaaatgcgtcctctaggaacttagatggcagcatgttggcaccctcacagaccaacccatggaagtcctggttcggctccacctaaaccaagcccaaaatgtgcaataatcagttccaaggttagctgacgaagagaaaatggggaacgagcaaataataataataataataataataatcctgacctcaaagacgagacgaatgccgtcacgggtgtcgacggcgacgggcatgcaggagcggaagaggccgctctcgacgacgcggtgcacgtcctcctgcacctcccgcaccgtgagcgccgcgttggggcggcacgcccggagcgccgccgccgcggccgcctccagctcgggccgctccaggggctccccgtccttccccctcaccgccacctcgctgatcagcacccgctcctctccccctccaccccctccgccgtccttctgcctccgcggcagcgcgatgggcgccgccgccgcccccgcccccgtctcggccctcgccacgggtagcctgggcagcgacctggccacgtggcgcaccacgccatcgatggcgcggccgatgcgcgcgaacgggagcgccgcagagagcagcgtcggcgctggcgctggcgccggagccgcgtcggcgcaggggagcttcacaccggaggagaccaaacgcacgtctcggcacgtccccatggcggcggcggcggcgctggaa

SEQ ID NO: 55533 - DNA, 5583 bp, Oryza sativa
agagatgagaagtaccctctcacgctgtcacgccatgatccacgtggggaataaggtcattgtttagttcgtgaaaagaaaatttctgcgtgtcacatcagatgtttgagaagatatcgaaaagggtttttagacacgaatgaaaattttaattttataactcgcctggaaaccgcgagacgaatcttttgtgcctaattaatccgtcattagcagagtgggttactgtagcacttatgactaattaggtacaaaagactcgtctcgtgattttctccccaactgtgcaactagtttttttaatctatatttaatgctccatacatgtgtttaaagattcgatgtgatgtctttagaaaaaaaatttggggaaactaaaccaggcgttaatttgacactaaatcttattttcgtccttaaaccgaaaaaccaaatacaataggttcccaacttacaaaagcagtacaaacaaggtccctcggtagtattgtccccggtttttggctaacgtagcacatacgtggctaatttgactagtcttcgtcccacgtgggattgacgtggcgcttatgtggcaatttgatttggaaaataataaaattcgtgagcccacatatcagctacacaaaaaaaataaataaataatggtgagacctaggtgaatctcacatgtcattctcactcccctcctcttctctctcatctgtccccatcttctcttcatctctcttgaagacctaggtgtcgcacgactggaggacaagcgcggcggcggcaacggtggtcgtggaatcatcgggcagggacacagacgagggcctggcgatgtccgcgtcgaagagcgccagggtccaacgtgggtcacactctgcgcggaccaggcggtggaggtggtcggtggtgagggtcttgggccatcttgtcgacgagaggatggtcgatgacattgggtggcggcggcagaatgggcaagcctgcgagtacaagacatagtctgaactctgaagaccgagtctatgccacgtcatgtgcatgtaccgagtcaaattagtcacgtagacaccacgtaagctaaaaccaccatccaaaccatcgtgggatctatattgcaccggttttaacagttgagggatttgttgtatctggtattgcggttaaagggtgacaatcgaattcgctgtcaagttaagggatctaaagtgaacttattcctccacatcgccgtacgcttccgaaattgcaattttgcaaggtttcggcccaaaaaggaatgaaattctcaaatctcaactgaagcccaatacagatagaagttacggagaattttaggcccaaataatgggatgaagcccatattgtactatcgggattccttcagaatttgggtaccgctctaacttttttggttttgtttttcaggacatggaaaaaaaatcaactgcatttgatttttttaaaaaaattactgcgtttgaattttgaacccatagtggccagcatgatattagaacttgcacggtaccgtttttctttttcttcataaattaaccctttgtccatatcattccattgtccctttctgtctttcatgatgcatgctagcttttggggaaaaatattgaccgtcatagagtactgttttctttttcttcacaaattgcaaagattatacttttctgaaaggaatgcaaagattatacttgctctcaatcttcggtattggtatatagtattttcccaatgtagacattcgcacaaattacaagttaaaacatgtcaaattcaccgtggttgttacggcacgaacgacaaagagccacggcgaattcaaagcttgtgtttggactggtatgtgttgatttgacaaaaagtttttgaacgaatcgtgttggtttgacaataggaaaaatgactgcatgacatatcgacaacgatttgaagcatatttgcgtcaaaagctaggaaaaagtaggaaattcgtttgtgcaaccacagtatcatattctcatgtgaatggttttcctagaacccttcatttttgacacaaatcctcgtaaaattacacggtttgaaatgcctcgaacatggtacatgggaattggttttcctttcacaaaataagagaactttcagatgggatcagtcagggcatccacaatgtgagacactcctagagtgtcctcactaactgaggacactcgtagagaaacttggttcgcaatggagggtgcccctggatgaactccttaaaatctgaagcaacccggtgagggtactacatcccacagtgggtgtcctggcccaaggtagcccagtacaaaaatttcacccatacccctcatcagcccactagcccagcaacctcttcctctcctctttctagcattttctcgtctcctccgcccaccgtctcctcctcttccgatctctccctctctctctcttggtcgaacgaggcgcgaacggcggtggcgaacggcgagcgccgcgcgaggtggaagacggcgacgggcgtgtgcggtggccgacggcgatgggcgtgcggggtgtgaagcatctagacccccggtgttaattttggtaattaatgacaagcgctaattgtggactaaccgttgtctttgagctatacattttaagttaggtccacgtcatatgtgcgcatggatgattatcaatggattaacattgacggcgcaaagcaaagagaaagaagacggtaaaactagtgctttaatttagaattgatcgaggtgtagggcgatcaaaattgctagtttattttctagtttcgccgtactattaagaggggtaatgacctagcaaagagatgattgaattaccacattaggtcattgcattttcatttgtgctctatttttcatcacacgcacattcacttgcaaattcactgggttcggcctgaccagggggcggtcagaccggccacatagtggcggtctgaccggcgtgccctggccggtctgactggccccaagcaggcggtctgaccggcggcacttgtccggtcagaccggccctctggatgccgagatgatgctgctcgggatggccgatacagagccgatggagccgtagtcggtcagaccgagccgatggcggtctgactgagccgaggccggtctgaccgcccactcaactctggtctgaccggccaggccgatggggccctctgacagcacttcaacggctagttttctagccgttgcagagtagcacggtctgaccggccacatacctccggtcagaccagcaaagcacaaagttgggagatttcgcccccaacggctagttttggtgggtgggagtataaatactcccccaccagcagcaaggggactctcttggcacccaattcaattgcatacatcccttgcacctctctcacacccacttgagctttgtgttcatccatctagtgtgttagagggttgattagccaagagtcaagtgcattgcttccatttgtagagctagtgtggcacttgattgatcatctccacgccgggtcattgcttgttactcttggaggttgccgcctcctagacggcttgtggaggagttgccctgtgacctctccgagaagattgtagaggaagcccggcgccggtttgtgagtggtttggaattcaccaccttcggagtgaaggaagaactaccctagtgatcgaggcttgggtagtcctctccgtgggccagctcccgccttgcccaccccttgatgaagggggtgtgcggtggcttcgtggttgagcggtggagttgagctcgcctcaacggggagtaggaaaccggcgagtttccgaacctcggtgaaaaatctcgtctccttgtctcatttgatcgtcgcatttacatttgtgcaaatttacttttctagaaacaaactagatatcatatcaccctaggattgctaaacattgacataggagtgtgatttactttcttagagatatagttgagccacaatcaccctaggtttgcaaaacataacttagttgcttagttagagttgaccctcaccaagcctagcgacttaggttagttttgattaggtgtcatttagttttaaatcgcctattcaccacactctagtcgacatctcgatcctacaagttgtatcagagcttggtctctcttgattgggcttcaccgcctagagagaagatgtcgaacgaggtgaaccatgtagggaaggctcccatgtttaatggcacaaactattccacttggaaaattaaaatgtctactcacctcaaagctatgagcttccatatttggagtattgttgatgtaggttttgctatcaccggcaagcccttgacggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacgagtgagtataaggatgccaagcttcatttcctcaagatccaatatgagacattctccatgttgcctcatgagagtgtgaatgacatgtatggaaggctcaatgtcattgtgaatgatctcaaggggcttgggacaaactacaccgatcttgaggttgcccaaaagatgcttagggctctaccggagaagtatgagacccttgtcaccatgctcatcaactccgacatgtcaatgatgacacccgcaagcctcttggggaagatcaacaccaatgacatgtacaagttgaagaagaaggagatggaggaagcctcaccttccaagaagtgcattgctctccaagccgaagttgaagataagggcaagggcaaggtgaatgaagccaatgaggacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgcttccaagtgcccttccaaggatgatgatggagacaagtcatgcaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgcaagctccaaaaagaagaagatggccgttgttgccatcaaggaggctctatcactcttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatggagct

SEQ ID NO: 55534 - DNA, 6401 bp, Oryza sativa
tagatatggaaatctttatttggttgatttcaattctagtgaagcaaatttgaaaacttgtttagttgcaaaaacttctttgggttgcctttggcatagaaggctagcccatgttggcatgaatcaattgagcaaactttcaaaacgtgatctagttgtgggcttgaaagatgtgaagtttgagaaagataagctttgtagtgcttgtcaagtcggcaagcaagttgctactaagagtatcatgtccacatctagaccattggagctcgtgcatatggatttgtttggcccaacaacctataagagcattggtggtaataatcattgtcttgtgattgttgatgattattctcgctatacttgggtgttctttttgtatgataagtctattgttgccgagcttttcaaaaagtttgcaaaaagggcccaaaatgaatttagttgcactcttgtgaaaattagaagtgacaatggttccgagtttaagaataccaatatcgaggactattgtgatgatcttggcattaaacacgaactttccgctacctactcacctcaacaaaaggtgtagtggagaggaaaaatcgtacattgattgagatggcaaggactatgcttgatgaatatggtgtttccgattcttttggggcggaagccataaacaccgcttgccatgcaaccaataggctttatttgcatattctcttgaaaaagactttctatgagctaattgttggaaggaagccaaatgttgcctattttcaagtttttggttgcaagtgttatatttaccgaaagggtgttagactaaccaaatttgaaagtcggtgtgatgaagggtttcttataggttatgcctcaaatagcaaggcataccgggtctacaacaagaacaaaggtattgtggaagaaaccgccgatgttcaatttgatgagactaatggctcccaagaggggcacgagaatttggatgatgtaggtgatgaaggcttgatgagaaccatgaagaatatgtcaattggagatgtcaagcctattgaagtggaagacaagccatccacctccactcaagatgagccatctacttccgctatgccaagtcaagctcaagttgaagtggaggaggagaaggtacaagatccacctatgccaccaaggatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtgggtatttaggaacaaacaagatgagaacgggttggtggtgagaaacaaggcaaggttggtggcacaaggtttcacaaaagttgaaggtttggactttggtgaaacttttgcccccgtggcaagacttgaggctattcgcatccttcttgcatttgcatcatgctttgatataaaactatttcaaatggatgtgaaaagtgcttttctaaatggtgaaattgctgaacttgtctttgttgaacaacctcccggttttgaagattctaaatatcctaaccatgtttacaaactctcaaaagctctttatggtttaaaacaagctcctagggcttggtatgaaagattgagatattttcttttgtcaaaggatttcaaaattggaaaagttgacaccaccctttttacaaaaatcattgatgatgatttctttgtgtgccaaatttatgttgatgacatcatattcggttctactaatgaggtattttgcaagaaatttggtgatatgatgtcgagggaatttgagatgtccatgattggagagttgagcttcttccttggacttcaaatcaagcaactcaaggatgggacgttcgtgagccaaaccaagtacatcaaggatctactcaagaggtttggcttggaggatgcgaagcccatcaagacacctatggcaaccaacgggcatctcgaccttgatgagggaggtaaaccggtagatttaaagctttatcgttctatgattggtagcttgctttaccttaccgcatctaggccggatatcatgtttagtgtttgcacgtgtgcacggtttcaagccgctcctaaggagtgtcacttagtggccgtgaaaaggattctaagatatttaaagtattcctctactattggcttgtggtacccaaaaggtgctaaatttaagcttgctggctattccgattcggattatgccggttgcaaagtggatagaaagagcacatccggtagttgccaaatgcttggtagatcccttgtgtcatggtcatccaagaaacaaaactccgtagccctctccaccgccgaggcggaatatgtttcggcaggtagttgttgtgcccaattgctttggatgaaacaaaccttgttggactatggcatatctttcaccaaaacctcactcctatgtgacaatgatagtgccataaagatagccaataacccagtctaacattctagaaccaagcatattgacatacgccatcacttcttaagagatcatgttgccaagtgtgacatagtcattagccacataagaaccgaggatcaactagccgacatttttaccaagcctcttgatgaaacccgcttttgcaagttgaggaatgagttaaatgtcatagacttctctaatatggcttgagatggtgcaccatggttgcttcttttgcatattgtatatttgctcctatttgttcttatgctttggatttattgtcatttggttcttcattgcgaaaatggagcatgtcacattaaggaggagtcttgcactcttgcatgtgttccacttccttttatatgtgagcaaatcaactaaaagtgctagtagtgttttcaaaatgaccaagtcaacataagtcaaaacttctgcaaaatcgatgcattttgaaaactatctcttggaaaatgttttaaaaggttccctatatgttttccaagcctcacattgcaagaaaaatgatttttgaatgaaaatgccattttggccctcttttgaagaaactagattcttagttttggataaaatgagatttatccccaaaatgagattgagaaggaatttgaggaaagtttcaaaacaaagttggtagaggagaagttttgaaatgtttttggtgttcaaacctatttcaaaaaccaaatcattcaaaagttatttgaaaatcaaattcgcccaaaaacccctatagaccataaaaggtcacctcctagcgctcaagtgagttttgttgcaaatcttcataattttcaaatgttatgaatggttggcaatattttaactcacacatttcaaaattgctccaaaaatcaatttttttattgaattttattgtgtgggggtagccgaactgtgcaagggctatgcacagtcggctgggggccaggcggtctgaccggtgctatatgcacggtctgatcggcctgatggcggcggtctgaccggccacttgggcccggtctgaccggccgcacccttgaggtctgaccggccgataatagccggtctgaccggccagggatagtgggcccaggaatctttctttttcttctctcttcttcccctacctgactccatctcctcccattcagctttcttcttccccaactcgaaaaaacacctcctctctcttttcccaaaccctagtcacctccctctaccaaattccctcggtctgaccgtggatttctctccggttacaccgtaagtgattctcctccgcttcctctctctattccatggattggtttgtgtttttgttgaagtttttgatccatggcatggaaccctaggtgaagcacgaggtgttcttcgatttgcaccaatagtgggtagtttcttggtgtgattcaactccttcaaccggtaaatcactctccctcttgcgcattatctcaaatcggtctatttcaatctctagggttttgggtagtttcccccattattccaatcttgatgaaataggccataccctttgatgttcaagttccaaacttgtgcaatattgttctagcaatattttagactcatttgtgtgattgttggaaggatttggttgtgctcctgtcagtggcggtctgatcggcaggcggtctgaccggcaccaaagcggcggtctgaccggcctagggcaggcggtctgaccggctaggggccgtcggtttgactgacttgacgccggcggtctgacagtccctggcccccggtctgaccgcccctgacaggcagcacccccattccttcctcttcactatgtggcttctaaaattgttgcttatccatcctttgctccttgtttttcagctatgcctccccgcactcgccatggtcgtcgtgagcccatgcccaatcccgtcaatgagaatgaggaatcaagcggagatgagtatgttcaaagtgatgatgacaatatggaaaatgttgagggtgatgagatggaagtaagtgatgatggtgatgacaatgggagtggcaatggtgaagatgatgaggcaagtgatgatgggagtcctctcgattccaccatccaatttgtgtttaatttgaggaatgctcaacaatacactatcctccgtcatcatgatcaattccggaggcctaacgattgtaatgatccaagatttcatacccagttccaaaagtccgtgtatgaacaagtgtatgccaacaaagccttcgccgaacacaagtggatttcttggaggcacattggtgagacaccggagtttgaagatttgcaagagatgttctggaccgttgggattgatagaattgtcaccatgaagcaatcttttgatgaagatctcatccggcaattctatgccaccgtatgggtgtccggcgattgtgatgcaatgaagtggatgtcggggacccttcaatgctctatcaaccgccgtgaattcaaggagctcttgcacattcgcttcaacaatggggatgaccttcatgatgagcacacccacaaccccttccccattgatcacttttctcagatttatgaagacgggggaaggcacacatatggaaaggtggcgggttagagggctctcccaagtgtgatcaaccacatagtaagggccaccatcctcccaagatgcggcaacaatgatgacatacgcggagttgcttggcatgtcattgatgccattttggatggtcgtcggtttgatgttatcaaccttatgatgaaggagattgccatctcaaaggggactattggacaaggaatctattatgctccctacataatgaggttgattcaaagcaagttgggacaaattggtcacaatttaaaagaacataaggagtacaagcctcgtctccaactctcctcccctaaagctcctcgtgtgcgccaaccaacatttgatcaaggtgcaagctcaagtgcagccccccctcctcctcatgggtctgatccaagtgcttttttccatccacaatatgcctactttggaatgcaacccaatgaattcttcaacccggtccttggggctattaataccctaagtgaaagcattcaacgcttatccaccgggcatgaagcattgcatgaagatgttcgtggcttgcgcaccgatgttggcaacttgaatacttcggtgggaagattgcatactagggtgggtgtattggattcttgagtccaaaccttggagagtacccaagcttttggctatcatcgtcgccgtgatgcttctcatccttccacttcggcgcgtcctccttctcctccgcaagagtgaagacctttttggtgcttgatgccaaaagggggagaaaagtgtgttttatgttttgtgggttgggactagtagtagtgaggttagtcacctcatatttaataggttaaggaggtttggactatattttgtatgggtatgggctattactctatattgtgtgttctttgtcgttttgttaaactctctatgtcatttggacccttcatggtcttgtaatagcctacatttatttgtgagcactttatgtggtcttgatgtgaacttgtgctatgatggatggttggtgtgacattgatatacttgtgaccatcttatgcattcggttgattcatatgtgaagttcacattataatttgcatatgtgttgtgctatgttgaattgtgaaattgaaatgtgcattggctccatatttgctatttgtgttggttatccatatgttaagggggagcttttgcttgccaatgcaatatatgtcc

SEQ ID NO: 55535 - DNA, 2047 bp, Oryza sativa
ccgaccccaagcgggcggtctgaccggcgcataaggccggtctgaccggcggcacttgcccgatcagaccggccccctggaggccgagatgatgctgctcgggatggccgaaacagagccgacggagccgtagtcggtctgaccgagccgaggccggtctgactgcccactcaactccggtctgaccggccaggccgatggggccctctgacagcacttcaacggctagttttctagccattgcagagtagcacggtctgaccggccacatacctccggtcaaacaggcagagcacaaagttgggggatttcgcccccaacagctagttttggcgggtgggagtataaatactcccccaccagcagcaaggggactctcttggcacccaattcaattgcatacatcccttgcacctctctcacacccacttgagctttgtgttcatccatctagtgtgttaaagggttgattagccaagagtcaagtgcattgcttccatttgtagagctagtgtggcacttgattgatcatctccacgccgggtcattgcttgttactcttggaggttgccgcctcctagacggcttgtggaggagttgtccggtgacctctccgagaaaattgtggaggaggcccggcgccggtttgtgagtggtttggagttcaccaccttcggagtgaagaaagaactaccctagtgatcgaggcttgggtagtcctctccgtgggccggctcccgccttgcccaccccttgatgaagggggcgtgcggtggcttcgtggttgagcggtggagttgggctcgcctcaacgaggagtaggaaaccggcgagtttccgaacctcggtgaaaaatctcttgtctccttgtctcatttgattgtcgcatttacatttgtgcaaatttacttttctagcacctaagtagatatcatatcaccgtaggtttgctagccatcgacataggggtgtgctgtcctttctaagagatatagttgagccacaatcaccataggtgtgcaagacataagtaagttgattagttagagttgaccctcaccaagcctagcaacttaggttagttttgattaggtgtcatttagttttaaatcgcctattcaccccccctctagtcgacatctcgatcctacagggtggccgacgacgacgggtgcgcggagtggccgacgacgtcggttgccagatccccttccctctgccgcggggccgtcgccgtcgagggtcatcgccatcggagtggcggcggggtggccagatccggcatgggctttccggatctagcctcgggcagcaacggcggtggcttgctggcgaggtcagcgcccggtcgccctcctaccgctcccctctctccctccagccgtcgccgtcgccaaccccagactccgccgccccgtgccgcctcacaggtcacctcgccgatgactccgccgccctcggcacccccgcccagcgccgcctcgcgggtcgcctcgccgatgtctggctcgcccttctcctcttcaaggccgccgagctcctcctcgccgtcacgatggcggctggtggagcggatcgacgagcgggcggcgccgtgggagagaggcaagggtaggagggggatttggggggagcggcgaggagacaggagcctgcagtgggtctcctcccagggacgagggttgtgtctctgcgaaaagtggtcgctccttgcaaagacccgcgttcctctgcttggcgccacgttcctagcctgggagacgactcacgctgaaaaggggatgggaggcaaacggccgtttgcgagggcacgggtcgagggtagggatggcaacgggtgcgtacccattgggttcacccaccccatacccacacccattgaaatgaaatacgcccgctccaatacccacacccgctcacgggtgaaaattcccccatacccacacccgcatgggtgacgggtacccattgggtacccatacccattagagtatcaaattgagcacaccaatgcatccagtcagacagcagggcagcaacatagcag

SEQ ID NO: 55536 - DNA, 931 bp, Oryza sativa
ttgttgaacttaatttaggttttctatatattcattcttaacttttggatagtaagaaattaattctaaaagtattaattaccctaaaaaattactccatccattcttaaataaagcatttctttatactccctcattccatttatatatgacattggttagtaaaaatttaaactaaccaaagtttcatataaatggaagaagggagtatgttctttaacaaagattaaggataaggaaaaaaatatttcatctcaatcacttcatttgccaaatattgaatggctatgataattccatcgtaagcatatgattgtcgcttaaaatgcttagtttcctgtggattgtaatcggtgtcatagaaacacggaggggttatgtgctattttctttatctatactccttaattagtggtggtggtaaatggtgaatctaccattatttgtactaccaactcgatacatttttggggataaagaataatgtggggtctagtataagggcttacacgtcaatcaaccttatcaccaactctttatttttttctttaagaaggaaaaaggattgtgggggctagtgggcccagagagatcacatttaagtaacaaatatatatatatatataaactaaaagataatatttatacaaattaatggtactgacgggttaatgatatttttttaataaaatcctgttacatatggttgtaattgtacaggtaatattatatatatatatatatatatatatatatatatatatatatatatatatatatatatatatatatatatatataaatggttgcatatgtaataccttcaaagaatcatgtctactatctttacattaaatgtaattctttatattttaactttatgctaaccgtacatattggcgtctctacatatataaccatccatgcatgc

SEQ ID NO: 55537 - DNA, 4387 bp, Oryza sativa
ttctcaccatttagattattaaaagtgacatcgttcgattcgtcctacaaataatgtcaagctccattttctggaggccgtacgtgaaattaatccaacccacatcttataaaaatcaaacgatatccacaataccccttcgtcatcgtcgtccccagctagctatatcccctgcagcatcacatcatctgcaaaattcttcatgcaccctagctactaccttagctcgcattgatccatccatccatccatccatggaggactacgcccaaaccaacctgatctcgagaggccatggccatcatcatcaacccgagctcatgaaggaattccctttcctcagcctcatttcatctacctcttcttgcatcagcagcagtggtcagcagcagcagcagcagcaagatgatgatggccatggcggccatgatcgtcatcagctgctccggtacggttgctgcagctgcaacaaacagcaggaggaagaggaggaggaggtcacggttgccttgcgcataggcctaccggccgtctcgtcggcgtcggcgtcgccgtcgccggcgatggcgaaccatggggctagtgcttctagtacaggagttgctggagatgatggcggcggcggcgccatggccggcgtgggtgtggaggtggagagcgtgcggaggagcggcggcggtggcggcggcgggcagtactggatcccgacggcggcgcagatcctcgccggcgccacccagttctcctgccccgtctgccgcaagaccttcaacagatacaacaacctccaggtatttatacgtgcaaaaaacacatatatacttaaataatggagtatatgacaagtgtgttttaaattcctactccgatccccatttgatctatatggtcataaaaagatataccaataaatttctagcaattgagcatatttatgagttatgatcagctatcttatgaaactcccaacaatcgatgaagtttatcattagtcattataatgtgtcttagtgaatgtgcatgctcttgcttacgtcgtggtgtgtttgtgtaattaatgcttgtcatagtggagagtgaattttaaactcgagagacgtcccctcgttgcacttaaatagttataaaaaaataagatgatatattaacatgtgatatatcacttcataaatatgtaacttaaaatttaacttgtacgtgtaaaaaaaaattaactgagaatatatgttaactagctataatttaatttgattttttgtatgacatgtagaaattgaattttaagctacatttttgtagagtgatatgtcacacattaatatatattctcaattcttgttaatttttatataactatttaagtgatatacaaacaacgagagaatatctcacatagtgtgtgtggtggtgtgcgtatcttgcatgtaattaatcgaaaaataaaggttgatttcgtgtatctattgatcattcaattgatggacgcaacctatagagaaaaaaaaaacaaatgcatgcaattaagagaagatgaacaatgggcagctggctgaaaattaagaatgaaaaattgcgttgcgtggtgagtgcagatgcacatgtgggggcacgggtcgcagtaccggcgaggcgggacggcggcgctgcgcggggcgcagccgacggcgatgctccggctgccgtgctactgctgcgcggcggggtgccgcaaccacatcgaccacccgcgggcgcggccgctcaaggacttccgcaccctgcagacgcactaccgccgccgccacggcgcccgcgacttcgcctgccgccgctgcgccaagcgcttcgccgtccgcggcgactggcgcacccacgagaagaactgcggccgcctctggcgctgcgcctgcggcgcccacttccgacacaagcgctccctcaacgaccacgcacgggccttcggcgccgcccacgcccacgccggcgccggcgccggcgccgaagacgacggccgcgccgccgccgccgccgccggtgtgctgcgatgaccttaatttatatatatgtgagtgcgaaattaattagctgattattggttagtttcaggttatttttttagtagaaaattaatttgtttgtgatcgatcatatatatatgtggaggactctcttaattgtttttttgtttggtttgatttgatttgatgtgtattgcatgcaatttgcagtttgggtgtgagatcttaattatattaattaaacactatatatatacagtgtgcttatggtaaatgcatgggttttgaactgaggttagatttattaattcgaactatgtttgacattgctatgactatagtgattattgcatattgtgaaataattcaaacttagctaattaaagttgagatgctttttttgaagttttagatccacaagaaataatagcattgcgaaattttatttagcttatggtagacatcggtagctagtcgtgcaaactttggaatattggttgtaagtaaacgccggaattaatcaatgaattccattacctcgaatttgcttctctgtaacaattcgttccatttgttatggcttgtatatattcaatagtacttaataactcgcaagacacttgttaaataaaataacaacactagctggttcttggttttgcataatttctagaaaattactgaggagatgtgaaaaagggacttgtagaatgtaccgttatcacgattcatgtctaacaaaataatccactaggccataaaacattttttaatcgaacacaacaaccaagcttaccagcgagggacgtcaatggtaggaacataaaaatccaaatttttttaataagaaaatatcctaaaacccgaagaagttgctccggtcaaactgcccgttgagcgtcgttctgaccacctgatactgttggtttgaccgacggtatgccaccggtgaccagtctaaccgcctccctatcgtctgcctgatctcctattgttgtttcctcttgacttgatgccattggtccaaccaccaagatgccttcggtcacaccgtcgtggtctgactgtcgttcctctactggcctgaccatcataatagagagaacataaatcagaaaaattctttgaatgtagatcaactttattgcttctaattgtgtttataaagtgcaacaaaaacgctcctctctcaactttcgactaaactcaaatctaggttaaaccctaacttttctcatgacaattctctatttatatcctgagatgactgcacaaaagccacaaatccaacatgagtaagtagtcctaatccattcggaaactcacctgtacaagtatccaactcaatatcctttacaaatttaaacttcaaacttttcaaacttggactccattcaaaattaactatgctttccatatgcatacaacacctcttgtatgacatacaaaatcttcatcaccacatgcattgtcctctaggattagtaccccacaagatctcctgatcatctagacaaaacttctctcaagttgactccctatccatcatcggcaatactctcctgagatctcaagacacacttacatatgaataaataagaaaccatattcaagcattagttcttttccaacttgactcaatattatcacacaacagtatatataacatacgtatagaaatcatctggaagccataagcaagaagcaatcattgttaatcaaaaaatcaactccaaaccaactccaaacaggagctagtcaatcaaaccgtctggttggccggtttgaccgccaccatgcctacagtttgaccggtgcctactgtctggtcccatacagagacaaaatcacttcgccaataaatcaccatatatcaaaaccaatacaaataaaatctcatgtcaattgttcatcacaataacaatcaaaacattgattttaccgttttggatgtgtaaggcacactagaacttttaaaattttgaatgtcaatatcttttttaatatttagatcgggtgtatgaaaaacaaacatatcaaatacatatttttctcacagtatcaaatttttgtcgggttttacggatatactaaaaatactccaaatcgttaggcctgtccaaagcaacatattttcttgactagagcatatgcatcttataagaactagacgagaaatgttattgttatatatagttttgttaggtctcagttgcttgaaattttcttattttccaataatcttaattcgcatagcatatataagtttgctggaactttaagctagcttgctttatgttatactacattgttatgggttaatctagatgtgtttctttaatatatattcttctctgtttttttccttttttgatttcaagttaaaagag

SEQ ID NO: 55538 - DNA, 4008 bp, Oryza sativa
gtattttctgggttgaggcatatgggtatttttaacccacgggttaatgggttcgggtggatggagaacgttccaggacccggcccacccgatgggtgacgttttagcccgataagagacccatgggtgcaatatttggaatacatttgactcctaatagagtaaaaacctatcgggtcgcgggttatgggtccccgttgctatccctagtcgagggcacccattgtggatggcctcaggatcagttaagccaacagctttgcatatgatggggatatgacattggggcttttgcttcagctttgttggttttgcccctatcctataaagccatggataaaggtgaagggaaaaagaaagcaaatagttcagtggagtatgactaggaattatgaccctagtgcttggaagttgtttgctgaaaatgatccctttgatactgtttattgcaaactgtggaggacacttcagcatgaaagcctgacagttcttgatggcctttccttgagaagacataaatcaaaccctcgtgcctatgttgatggagattgtttggtggcctttgctgtacatacatgtgttcacgatcacaagttcaaatgtttggtcgagtttctgcacgtacatattaacatagacagcgtttagttccctttaaacttccaaaagttacgtcacatcaaatatttagacacatgcataaaatattaaatatggaaaaaaaaacaattgtacagtttgcatgtaaattgcgagacgaatctttttagcctaattacgtaatgatttgacgatgtaatgctacagtaaacatttactaatgacggattagttaggcttaataaattcatctcgtagtttataggcggaatctgcaatttattttgttattagtctatatttaatacttcaaatatgtgttcgtatactttaaacacgaccatacatgtgaagataacataacctaacaaagtacacaaatgctgtaaaggtcataattttcaagaaaattccgaccgatgatttccatttctagaaaagttctgacaggcggagactttccaaaccgtttttttcacctagaagtctatttcttctactgatgtgcaatatttttacgcgttctcgaaaaaaacttttcaaaccttttttaaccctgatttctatttttttgtctatttacgttgactaaaattcttcgtaaccaaatattacctccgtcctaaaatatagctattttagcacagtgacttgttccaaaatgaagctatttttttacctaccattttctctcaaccaatcacaaccgttctcttcacctactttctcttctttatcaatcacaacccttctctaatcatttgtatctacttttttcatatacgtgtctattttaaaaatgtttacattttagaacagatgaaatagtaagatcaggtacaatagcaggttataaatcagctataaacatattttaagaagatgatagacgagagagaacagctgtagcacggactctaagatacagtgtgtgtatgacaggtgggaccatgtattaatagtgtaacatgtaactattgtataaattgattattaagttgactagagattatttagggctaatagttagctatactaatgttattactctaatcctcaagattcacatgttgcagcgcgagttcctgggatgaaccctttttttcatcacattcacgcatatggtcagcagggtgagcgagcgagcgagcaagcagcagggggatccatcgatccgtccgaatatgctctgctctgctttgctttgcggtgggcatcgggaggcgcgccgccttttggggtttttggtggcgcgcacatcgccgtgcccgactgcccgtgcagtgcatgcaaagcgacagaaaaaccacagcgggggggtactcccccttttcgctggagccgcgggactcatggcatgggcgggcgcccgcggcgagcggagcggagcggggaccaaaacaccggaggaaaacgtcgcgctcgcgctcgcgctactgcaactgcacgatcatcgtcagttcccccacacgggcacacccgcgcacgcgcgcggtcctactcctcctgcaccgcacccaggaaggagccactgctcggctaccccgggcggctcaccgacgaaaatttcattaaacttctatattgttataaataaatttatgatgaaatttctataacaaattacttatatattgttatagaaatttaattagttataatgtagttttgtccgcactcaaaaatctttctagctccatcacttactgtgccccgtttttgttgcacctccattctgaaatagtgttttcttttttcccttagtaacttctactctcttatttttcatgcacatattttacaaaacactagatgatagcatgttttcttaaaaaaatattgaaaaaataattttataaattatattaatccattgttaagtttttaagctaatacttaattattcacgtactaatctaccgctccattttaaggtcgaggaaaaggattcccaacttactcaaaggaaaacaaccataataccctactttattaaaacccaatacaactattctcaactttatctactcttagagtccaagtgcatttgttccctgctttcacaattgctactgcctttgtttcgggttataaaacgttttgactctgcttcaagtttgactaagtttgtaggaaaaaataataacattttcatcccaagacttattctacaacggaggggtagccttttagctacacgtgaaacaaataaatcattaacgaatgattaattgagtagtacaacctccgtttcatacaataaactgtttcatttttttctaagtcaaaagtttttaggtttaactaaatttaagaaaaatataatattaattttaacagaacaaagaaaattgtttctatattagatgtaataaaactaatttagtactataaagtgcttctatttttttataaacttagtcaaacttttaagaagttttgacttataaatgtcaaagcgacttataaaatgaaacgaagggattattagctgctcccttcatctaaaaatataggtctcggattggacacaaaataagtggcgtgggttcaatccgatataacgatactaggttgctatatatattttagaataggtgaaatattacaaattcaaaaaataagtttattcttttagaaagaaaacatttatataaaaagttcttgaaaagaatacactggctagaacttcaggaagagtgctcatggaaaacgagaaaattgctaaatcctagtaattcagtacccaacaggcaataagactaagaccgagttcttttcagcaactcgaaacggtgtttttttaaaaaaaaattatatagtacaacacatacactcacaatacacgcacactcacccctatgaacgcacgcatgtaatccctacctctataaacatcttcgaatactgggctgataaatcctttgggattgacgaagtcaaccgaacttaacgtaccgttttgtgaaataaatatagtataatgtattatctctatcctaaaatataacaacttttggctatgaatctggtcacacatttagccagattcataactaaaaatacttatatttgggacggagggagtatatattttaaaaattataattgttacccttgctaatcaccccgtctcatttcgcgtgcgagctgaacggctcaaacgaacgtgcctaaatcaagtttaaaccaagctcaaaataaatatagattcaccgccgttcgtcggcaaccgtttaattatcacggttactgataaatttgatagggatatgcctttcgactatcgttcgcattttgaaaccctggtctgagttgtcattttctcacagtgctaaagtcaacaccaaatgtccaatgctgtccatctatttttattcggaatatatgtgttttgaatactacctt

SEQ ID NO: 55539 - DNA, 2355 bp, Oryza sativa
taaaattatgtttggattgaagtaaaaatagcctaagttcactattgaaatggcctattttattaggcatgccaaaatttggcttcaaaccaaatagacactaaacactattgaaattgccaaatattggtaagtctaatttaggcctcaaacaaaaccagccctttaagtttttgtttgtaacttttgattattcgtcttattcaaaaaattacgaaattattatttattttttggctttattatcaaaagcactttaagtataacttatctttttttatatttataatatttttttaaataagacgaatgataaaaaaaaagttagagtgataactaatttaggacggaggtaatacatacgaaatatgagccagaaaaggccagccaaatttgtgggcagggatatgggggaatcttcttgagattgcccatcatctataagcatctagagacatcctatccaaatttgtaccaccataacctttccttttacataaggcatacgaatgcatattattgagagcaccacaccaactaggctacttatataggtcactgcataagaggagataaaggcatgagcttttgttaagcaccttcattcgttttcaatctacatgaaattttggtcaggtgggtcgagccatggtgtatgttgacgtgccaaatcagtgggagcaatgcgcattaactgagccgattacaaaatatatttaaaaatactcaatatatttttatttatctcctatccatttcaaaatgtaagacttggtcccgttcgtttctgtactgaaaaaagtggatcaaaatttggatatgtgtgacactcttttcaaattgctaaacggtgtgtttcgtaaaaagctttcaatatgaaagttactctaaaatatcatattaatttatttcaagtttgtttggtacgtaaatattaagattaagaaaaaaaatcacgtttcagatcccagtgatcaaattcttctcacggactgattggctaaaaaacgtatggatttttacgcgttgaaataagtacactagaaatgcttatactatgatacaaattttaaataacagaaatacttatattttggaacactaaactaagacatactaatatgcattgtttaggggcttatatgagaaatttcaaaaaacgagggcaaaacaacgaagcaacgaaaacgataaacatggagcggagaaagcgagcgcgcatcggcgccaccccgacaaatggcgatagagcccaaatccaaaccaaactcaaactaaaaaaacaaatcccaccgaaaacgatataaaattcgagcgagggccaaagcgaaaagccgccgaatccacgccatttcccacccaaattccacccgaattccaaaccccaccaaatataaatcaaatcccaacgtgacctcccccgcggccgcggcctgcttcacgcctccctcctcctcgccgcctcgccgcctcgcctcgcctcgcctcgcctccaccgcctctactaaaccctccgccgccgccgccgccgcggtgatcaccggcggccgaggtaagccgccgctctgacgctccctcttgacggacggcgcgtttggtctcgccgcctttggcgttccgtgtttttatcttcgcccggattccggatggattttgattttgattttttttttgtttctgtttcccccaaatacccggggccttgtttgggttcgtggagataaacgcgtagtaggcggagttgctgcgggcgccgcctcttttttttcttgttcctcttttgtcaaatggacagttcgttggttgtcgttggcgcggtggagttggatttgtgggatttttttttctcgggcttaatgcaagtggtggttaaacaatttgcttcaacgctatcactgaacttagaatgtaccaaaaagatccaaacagtttgatttaatgttattttactaacaatttgggggggaggctgcacctgttagtgcttaccaggactatacttttggggatttttaaggagtttacatctgtactgagttcataattatctgtactgagttcataattatctgtaccgagttcataattcatagttcaagttgtacttgcagtacagaagtttgtgctggattatgagaagctattattatatcttaccaattggctgtaaaatatagcatggacatatgaccatctaaatttatgttggtttttggttgttcctgggacagggatggagcagaatggagagaaccatctcaaagatccacttcttcaggcagatggaggcggctccggtgcttctcccgccggggcgtcgccgcggaaggagaggaagacgaggaaggtcatgtt

SEQ ID NO: 55540 - DNA, 10388 bp, Oryza sativa
tgactaggagtatatgtctgcaactctgcatgaatttaattccagcaatatggtggttttgaattccaggagctgaattttatcctgtagatgtcatgatttaggtaattaggatacatgaaaattttgatttcagctttatattggtcattcatataaggtccacgagtaagtactacgaaccagtgactatcttaacaatcttttttgtcagcgtgggccaaacccttgacaatgactgtgcaatcatatgatgacctttatacctcatcgagttcatgttctccaggcctggaatattgaattacttcgcaatcatatgatcttttttacctcttactcagaaatttttactagcagtttggttcgaatcagtatttatcaaggttctaaaaattggtaactggtacttgacagttagtgaccatatagcctgtgatgtcaagttcaggctcatgtagtctcatgttctttgtatacagttgccatcatgcaattgccagttaggctgtatagtcactaatgagtgcaccaactggtaacttttgtctgcatggacatgctttcagttcactaaactcatgtatatttcaagttgcactcatgaagtaatgacaggatattttacggtttggcattattttccatctgttctcagtttggattcttattcttccaggcaagaaccataaaagaagctatcgaaggcctcaatttcgaggtcgatgaacttcaagaacaggaaattgctgtatgcagactccagataaaaggaatggcatgtacaagctgctcggaatctgtggagcgagcacttcagatggtacctggagtgaagaaagctgcagtgggacttgccctagaggaagctaaagtccattttgatccaaatatcacaagtcgtgatcttataattgaggctattgaagatgctggatttggagctgatctcattagttccggggatgatgtgaacaaagtccacctaaaactagagggtgtgagttccccagaagacatcaaactcattcagtcaagactggaatctgtcgaaggtgtgaataacgtggaatgtgacacagcgggacagacaataatagttgcatatgatcctgatgtcactggcccacgattacttattcagtgcattcaggatgctgcacagccccctaaatacttcaatgctagcttgtattcaccaccaaagcaaagagaggcagagcgccatcatgaaattaggaattacaggaatcaatttctttggagttgcctgttttctgtgccagaattcactcgttctccatggttctgccaatgatttctccttttggggattggctgttttacaaagtatgcaataacatgacgataggtatgctattactgtgggtgctgtgttctccagttcagttcattattggttggaggtacaatcccatctctcgaacagcttcttcttgatgttgtttcatgttccttatctcaagtcttttgtttattgtatttagcctaaatataatgttgccttcgtttgtttccttcattgcacacatgcactataaatcatgtgtggttattcactatgtgttattttactgacagattttatgttggagcttatcatgcgctaaaacgaggatactcgaacatggacgtgcttgttgctttggggacaaatgctgcatacttctattctgtgtatatagttctgaaggcactaacatcagagtcatttgaaggacaggatttcttcgaaactagtgctatgttgatatcttttatattgctggggaaatatctggaggtggtggccaaaggaaagacatcagatgctttgtcgaagttgactgaacttgcaccagaaacagcttgtcttcttactttggacaaagatggaaatgccatttcagaaacggagatcagcactcagttacttcagagaaatgatgtcattaagattgtccctggggaaaaagtccctgttgatggtgttgtcatcaaaggccaaagtcatgtgaatgaaagtatgataactggtgaagcaaggcccattgcaaagaaaccaggagacaaggttggtattttttggatcctgattgtatttgctcttgttatgaactagtatcctgatggttcaattgacttgtttttaacaggttattggtggtactgtaaatgacaatggttgtataattgttaaggtcactcatgttgggtcagaaacagctttgtcacagatagttcagttagttgaagctgctcaacttgcaagggctccagttcagaagttggcagataggatttcacggttttttgtcccaacggtaggttcgcttgttttctcctgcaaattcccttcgtgctatttcccaccagcgtttacaaaattgcaacattgctatattctacctgcctagctactggttaataacaactggctacggaggtaatcgaggtatttatcctagacagtagacacatagtcaactgcactggaaactttacctgtactggtcactagttatcgcactaataatttcttggtatttctaccctagacttagtcagcattcatctggaaactttcttgaacctaccccagcttctactgtagaatcgtagagcaaattatattcaatttagtggagtagcagttttaactctactccttaccaagttcacctcctctgtaaacagctggttacttatgagaaatgttaccctgattgatacttgcaaatgtttcctaactacttttgatgcttctcatgcatactttctgtgagatcgtctctttcttcatctcatattggtccctctcattttaaggttgtggtggctgcatttcttacatggcttggctggttcgtagctgggcaattcgacatataccctcgagaatggattccaaaggcaatggatagctttgagcttgctctgcagtttggaatatctgttcttgttgttgcatgcccgtgtgctcttggactggctaccccgactgctgttatggttgccactggaaaaggtgcttctcaaggtgttcttattaagggtggcaatgcacttgagaaagctcacaaggtaactgagatgatttctatgtcatgtattattttttctcacatcaaatgtattctattttttttatattgtgacactaaactattccttgtatttctttatgtgcaggttaaagctatcatatttgataaaactggaacgctgactgtcggtaaaccttctgttgttcaaacaaaggtgttctccaagataccgctactagagctgtgtgatttggctgctggtgcagaggttggcttcttagatgcaaatgctaataatttttgttgaatgtcgtgtgatgttcctagtttgctgtctcatgtcatctaaccttaacttttttctaactttgtcaggcgaacagtgagcatcctctatcaaaggctattgtagagtacacaaagaagctcagggaacaatatggatctcacagtgaccatataatggagtccaaggactttgaggtgcatccaggggcaggggtgagtgccaatgttgaaggcaagctggtgctggttggaaacaaaaggcttatgcaagaatttgaagttccaataagttctgaagtagagggacacatgtctgaaacagaagagcttgctaggacctgtgtgcttgttgctatcgacagaaccatctgcggagctctttctgtgtcagatcctctgaaacctgaggcaggccgtgccatttcatacctcagctcaatgggtatctcgagtatcatggtgacgggcgacaattgggctacagctaaatccatagctaaagaggtcgggatcggcacagtatttgccgagatcgatccagttggtaaagccgaaaagatcaaggacttgcaggtgcaatcttttctccttgcagcaaaaacaaagttggaatagatcacagattttaccaccattattccaacttacatcacatcatttgttcacagatgaaagggttgacggtggccatggtcggcgacgggataaacgactcgccggctctagccgctgcagacgtaggcctggcgattggggctggaaccgacgtcgccatcgaagctgccgacattgtcctgatgaggagcagcctcgaggatgtgatcactgccatcgatctctccaggaagaccctctcaagaatccggctcaactacgtctgggctctgggctacaacgtcctgggcatgccggtcgccgcgggcgtcctgttcccgttcaccggcatccggctgccgccatggctcgccggagcttgcatggcggcctcgtcggtgagcgtcgtctgctcgtcgctgctgctccagctctacaagaagccattgcacgtcgaggaggtggctgctggacccaagaatgacccggatttggtgtgaagactgaagaagcgtcggtcttgctgtgctgactgaaactgagcatgaagcaaacgccttgtttgcagtggccctcctgactgatttctgtacagtagtcatgttttgggattctctgtttttttttgggtacttctgattgattcaataataatttggggagcttaattgctatccagtgatatatagatgtgaaattgtgtttaaacagtggagaacagttgttgtattttctggcaagtgaccattgcgacgttgtagcattggactagttagtaactagttgaactgtaaactcattgcaaaagtaatctactctttagttatcctttggaacactgcatgcttatcttgcggaaaccgaactgaatcctctgaaaatcctataacatttcatctcaaatttgtaggaatatgttcgtcgatacgcgctatttcaaacaataaattcaaaagagcactgctacaccaattaaaattttcttactaaactcttaccctcaatgatctcaaccctcaattatctcaaccgattgatttaactatatgggattataaaaaatctaggatatattaatagcatgacacatcaatgctaataagagttcagtaagaaaaacgtagtaggtatagtcttttccaatcaaaaactttctgctctaaaatcatgtgaaaattcgtcgagatgtcaggacgggaacggaaggaaaatgatcggtaggcaacgacgaggaggaagaagcagcagcagcagccgcgcgtcccgttggttcgcgccaaaaatagcagaaaaaacccgcgcgcgcgacacccgcgtcgtcgtccgctcgccgtgtctaaacatagctaagctccccttcccgccgtatatataatccggcggcgcgcccctcctcgacatcgccgtacctacaaagatatcaacatggtttcctccacgagaaggacgacctcgtctctatccgccaccaccgccgccgccatcgcggcggcggcggcggcgctgatggtgtccgtggcgttcgccacagcgcagtacacgccggccacgccggcagcgccgggggctgcagcggcgggtgcggcggcgggggcgacgccggcggcgccgtacacgccggccacgccgggggcggcgggggcggcgccgtcggtgccggcggggccgctggacatcgcgcagctgggggcgaagggcgacgggacgagcgacagcacggcgttcgtgctgcaggcgtggaagaacgcgtgcaacgcgacggggacgcagaagatcgtgatcccgccggggaactacctcaccggcgcgctcaacctcaaggggccgtgcaccagcagcatcatcctccgcctcgacggcaacctcctcggcaccggcgacctcaacgcctacaagaccaactggatcgaggtggagcacgtcgacaacttcgccatcaacggccacggcatcatcgacggccagggccccctcgtctggacccacaaccagtgcaacaagaactacaactgcaagatcctccccaatgtaagcaacccacacccccatcgtctctctctatagctacctcctcctccgtttcatatcataaagtagttctatttttctattcaaacttatttaaattcagctaaatttgtatatacaaaaaagtaacacctataacatcgaattaattagtttcgaataaatcttatactctctcgtttttcatgcgcacgctttacaaactgttaaacgttgtgtttttttataaaaaatataaaatagttgtttttttaaaaaaattatattaatatatttttaaagtttattttagctaacgtttaattaatcaaatgctaatagatcactccattttgcctttgggaaggtggagtttccaacctccacatctgaatatagcctaagctggtcttttaaccagcaaacactattgagtatcacagtccatttataattaattgacatgggcaaaataaccaatgctgtgatagtaatttgtattgttatcttcttgcttctctgtatgactaataatgggcaattaattaaaacaatggatggatgcagagcttggtgatcgactactcgacgaacgtgacagtgagggggataacgctgaagaacagcaagttcttccacctcaacatatacgagagcaagaacgtggtgatcgacaaggtgaccatcacgtcgccgggggacagcccaaacacggacggcatccacgtcggcgactccaccaacatcaccatcagctccaccaccatcgccgccggcgacgactgcatctccatcggccccggcaccaagatggtccgcgtcaacggcgtccgctgtggccccggtcacggcatctccgtcggcagcctcggccggtacatacatacatacatacaactgcccctttccttccctatagctaagctagctagcacctgtttagatcgtgaaaagaaaattttttaatgtcacatcagacgtttgaccggatacgaatgaaaaaactaatttcataactcgcctggaaaccgcgagacgaatcttctgagcctaattaatctgtcattagcacatgtgggttactgtagcatcattcgtagtattttgaatatctatttaactattcgtcttattaaaaaatacgtaattcatatttattttgttctaagttgttttatcactaaaatagtactttaagcatcttatgcaattgcataatttttttaataaaacaaatgatcaatatgtgtctaaaagtcaatgacatcatctattaaaaaaccagagatagttaataactacttagtagataatttgtatgtatagaacccgataatattaacttctgttgtgtgtggttggccatctctgcaggtacaaggacgagaaggacgtggaggacatcatcgtcaccaactgcacgataaagggcaccacgaacggcctccggatcaagtcgtacgaggactccaagtcgcagctgagggcgaccaagttcctgtacgacggcatcaccatggacaacgtgagctacccgatcatcatcgaccagaagtactgccccaacaacatctgctccgcgtccggcacgtccaaggtcgccgtcaccgacatcgtcttcaagaacatcgtcggcacgtcggcgacgcccgaggccgtcacgctcaactgcgccaacaacctgccgtgccagggcatccagctgcacaacgtcgacctcaagtacgccggccaagggaacaccaccctctccgtctgcaagaacgtcgccggcaagtccagcaacgtcgccaaggagctcgcctgcgtctgattttcatcttattatactactcttccgtttcatattacaaagtcatttgtttttttttaaagccaattttttcaaagtttgaccaaagttttttaaaaaatatagtagtattttcaatatgaaaagaacatattatcagaatatatttcatattggatttaattagactaatttaatattttatatgttgctatattttttttataaatttgtttaaactaaataaaaattgactagaaaaagtcaaacaacttataatatgaaatggagatagggggagtaattgtcgtctgattatatagttgtaagttaatcatcgttccctccgctacattcccctcacttgtattcttcatctaattattttcctctctctccctcttcggatttttttaattattttcttctatttatttttatgtttgcttcttcttcgtttggaatatatgattcttgtcctgatttcatttcatttagtttactcgttaattgattaattaattaattgttatccgtttagttgtcgtagtttaatctcttcagttcaattatttttttgtttgattcttatttgtttggaatatatgtttttctttttctgattctgattcggatggaaactgatctgattcgtacaaaatataaaaataaccataccataagccgtataaggaacaaacaaagaatgatcacatgagctctgtctaaatctagcttaattcatcatggccatcttgaattttgcaaatcaacgttctcggtgcttgtttgagaccatacaaggctttcttcaatcggcaaacaagaggaattgctatgagattcgtgcgtacaaaaggtgatttgcaccagggtttcccaaaccgccggggccggggttaccgcgcggtaaccacagttaaccgtgaaaaaccatgcaaaatttatcaaaaattcaaattattttttaaatttatttgaatttaagaaggttaccgcggtatttatattaccatacacccgcggtaaacctagtaaccgcgcggttaccgacggtaagtcgaaccctgatttgcacccagtaaaacattttgttgtgtttttacttttgcttttaccagatagcttgctaccacgtactagcatagccctgcaatacatgcagcatgcacgagtggtttcaccagctcacctccaaaatccaaaccaaaattttggcctcaacgttctgaaccgttcgatcatgcgaccaacattacatcgattttcacatccagcattgcatgccaaaatcactgagacaatgacgacttcaaataagttcttattgtaactggagaacattaattacatcccttctgtaaagctcagggaagcataccttattagtatttttaccatcactaagcactaaaatatagatgtaactagctagatacattgcctcattgcatgctttcttcagagattattgacacactgatgagatgaaagcaggctatcctctatatgttggatcatggaagtgcaggcagaaccttcccagtgcaggttccgaatccgacattgtagccttcaccctgtaaaaacatgtagatggatggcatcaagatagagcatggaatcttcaaagatatttgttttagacgaaaagagctctaaatttggtttgatcaagacttatgagattgctgtaccttgcaacaagctgtcaagatgacctcatccccatcttctaggaacttgcgggtcgagtttccaactgatatctccttctgcccattccatgttagctccagcaaacatcccaaagattctgtctcctgaaagaaggcagatgtttagttgtaaacatgcacgataacttctagattggtatgtttatggtgatatttgaaatggttattccatacaggtccgcttagtgtgccagttgcaaacatatcccctggtctcagattgcatccattaacagtgtggtgtgctagttgctgtgttaaagtccaatacctgggaaaaaatagttacagtaaggacaaagctaacaaatacatatggtaatgaaacggcaatcggaaaacaggaagcatccttacagatgcttgaagttactctttgcaaccattgatggttcactttgctccttgggcttaatccagaccttacagaaaatgaaatgcagtaataatcatcagtttatgttttaatcaaatatctattaatataaaaatataaaagaagaaatgccatgagaaaatcctacctcaagaggaatatcgtagtttacgtggttcttttcagctaagtaaggcaaaggttcaggttcctgccacgcaaagcaatttaatttatccatagaacaataaaatgatgattctcaaggaaaatatggttaactatatactataatactaagacatgctcacctgcttaggagcttcacaggtgaaaggctttagggcatccatagtaacgatccagggtgatactgtggtacctaaaaatcacaaagtaggaaggaaacatgttacattgacgaaagataaaagcatagtccattgcggaaatcatggaagaatccactcaagtaattgtcgaggccacagtagaaatatgatcatgagcatttgtaaaaactaagcaatagggctgcaggaatt

SEQ ID NO: 55541 - DNA, 17104 bp, Oryza sativa
aacataaaaaatcataagctaatagtgaatatgaaactgtgacgatgtgacatacaccaactattgtgatttattttagtcagaatattcatctcaatgttaactgctatgctgtgacatcagatgatcggccagaatatgcatctcttcaagcaatcctattcgggccatttgttctagctggcctgtcaactggtgattggaatgcagaagccggcaacaccagcgcaatttcagactggatatctccagtcccttcatcctacaactcacagctggtgaccttcacacaagaatccagtgggaagaccttcgtcctctcgagcgcgaatggctctctcacaatgcaagaacggccgacggtcgatggcactgataccgccatccacgcaacattcagagtacaccctcaggactcagcagggcagcttgacacccagggtgcaaccttgaaggggacctctgtgcagatagaaccatttgacctcccaggaacggtgatcaccaacaaccttacccaatccgcgcaaaagagttcagattccctcttcaacattgtacctgggctagatggaaacccaaactcggtctccctcgagctcgggaccaaaccgggatgcttcctggtgataggcgtggattactccgtgggtacaaagattcaggtcagttgcaagagttctcttccaagcatcaacgggattttcgagcaggccgcgagctttgtgcaggctgctccattgaggcagtaccatcctatcagcttcattgcaaagggggtgaagaggaacttcctgcttgaaccattgtacagcctgagagacgaattctacacggtttacttcaaccttggggcttgaaccttgaaagaggttactcattagtagaaagaatcaagaattcagaataatggttgtccttactatactgtaatttagaatatgcagccaaagaggaaacgttttgtttcttctgaaattgtaggataatttttactgagttcagtgcaatgttgtgcaattatgagttttttttctgtggcattttcgtatcttggtaattgaaaatgctgctgaaagcctgaaatacagccattctgcaacatatatgatgcagtagatgctacttcctctgtttcatattctaagtcattttagatttgtcctaactcaaacatttctaagtttaaccgagtttatagaaaaaattacaacactaaattagttccactaaatttattattgaatatgtttttatagtatatttttaattttgtgttgaaaatattgctatattttttttataaatttgatcaaacttgaaaaggtttaacttaggataaatttataatataaaacagaggaagtatcatttatctccattgttctggcttttgtccggtaaacacaagagggaaaaaaatcatctgttcttatcaggattgcgtgatatacactataatggcattagtataacaatataagatcagagcaggtaacagcagtttaagtctcataaaatacatctccagcgactgagaggacgacaaactggagattctatccaattcaataaactactgaggaatctcagctgatcagagctcaccattagtgcctgcattgtttaatgcatttcggcttaacacccggcaaaggagttgatcaatgtacccatcatgcctaaagaaacccacccaaccacaatggcacaaatcaagggggaaaagaagtcatcctctgcaaagaattttttggcacaacttggtttattctgcaatccatagtcatgccaatccatagtcatgccaatcaagtgatataacaaaatgtaagcatctgtgaaattatccacctaaggatttcaattggataatataaggggggcagaatttggtagcagatgtcagaatctgtgaaattatcaatcgaatcagaactgcagctgccttgcaccaggaaattaatcgaacaaaatggttatcttcgtgacaacaatatgtatgctggttcagatcacaagttaatagatgtttgaactttaaggcagattattaactacatcccagattactgaaacagaacagcttcacatgctgaactttcagtgttacatgttgcagatctaatcccaactattctcagtagcattaaagaatgaccatttggggatagagtaataacctgagaactaacttgtcatttgtcacaatttcctctcagatccgattttcaatctagagtagacccagccaaccaagcacaatccggcaaacttctttgaacatacatgaatttgaatgcgcaccagataaaggtgcatacataaataatctttaaggaaaaatgaataatggacatgttggcaatatgatggaccattgctgataactattactgattgaaatgtagcaagcatgggacatagtacatcacagagctagctaaatgagacaccacaatactgaccgaaaaccaccaagaataaagattacacaacatacccaacacgcaaaccacttgacttgactgagaggatgaattctttcggctgccaggatgcagtgtgcatcacaaagttgaacaatttaagaaatgtagcagccgacaagaagaagtgtgaggatagagcagcaaaggtggatgttgaaatcttgtaggttgcaatccattccacgcccctagccgccttagatcttgtcgagcttctcagccttcaccactgggttggccttggcgatggcatccctagccgcagtccggtagtcgaactggcattcatgcttgtcggagtagcggtgcaacgcacagtacatgttaccgcaccggcagttgaatcccgtcagcccaaccctcttcctacaggtagcgcaccggttcggcccttccttgaccttggggactacagcaacctcctcgctggtgcccgcgacatcggtaggctgcacaacgagcgtcttcgcctcgacctgagccaccgccaccgccgtgctaccactggcagcaacaatatgctccttcccaccgtcacaaccattgacaatgctatcgatggaggaggcagcaagcttggcctgctcctccttcatgatcatctccttgtggcacttggagcacatgttcatggtcgccgcgctgccaaagaagccgcagttattgatgcaaaggattgggccctcgggctgctggcagccagcctccttgtgttccatcgcaactgtgatctgttcatcaaacaaacaatgcaaaactcaataccgaaatgcgtataagaaacaaatttaaaatttaacatacggataaatcaactagtgtccaattaaatcgggcggtaagataatccaagaagcacctagttgctacaattttcctatcgaaatttccatataattgtgacttttaaaataacctataacccactgcggcgagcttacactttatgaaacaagatcctaatttctatgaggcgcaacgaaatcgccatcacaaaagtggattcctcatcttatcaaccaaacgcgcctatccatttcgacgaaatcaaattcaaacaccgtaaatctgctgtaacacgttttacccactcacatttaccccgagtaatgattaatcgcccacggttctacaacaaatcaaccccaaaaaaagatcaggaaactcacgcgaatctaatcatttcaacctgaaagatcacatagcctaatacacaaccgaaaaaaaaaatcaaacataaacgctttcccctcgagcccaataaccaataaccaaccacatcaaataccaaatcaaacaacgaccccccacatcagatccccgcaccaacccaaaaccgatcccccctccccaacaccagcaccacgcggatcgatcgatcgaatcgaatcgaccccaagaaaaaaacaaaaaaaagaaaaagaagcccacagatcaaacgggtcacccacaaactcaaggggggggggtggaatcaggcagggggagcaagagggcaaaccctaaccctggtcgcggcggcggcggaggccgaggcggcggtggcggaggaggcgtgcggggattggaatcgcgagctcggtgcgcgtggtggcgtctcctctctctctctctctctctctctcactctctctcttcaggggaaggtgggggtggggggagagagagacactgataaaaaagaaagcccccgatggcgacggggaaattaccggtttgcccctcgcctcgacgtgtatttacgccacgtggtggggttgtgggccgttggatcgtggttggacggatgggaatcggagggagggtgtggggttttgcggttgggtccctgggagatgtggggttataaaaagtaggggctttttctttcttgctggggaagaagatggaggagagggagagcgtgtcccttttccttctctttattgttggtgtgatacttgtgtttaattattaaatcctttcttattatagtgctggaatttagtttttttctattgcagtaatactgtgaaataatatgaaccggtataaaataaaaagataacgtgttcatatgataatcgtataaattgttgctaacttttgtagatgaaaagaacaacatgttcataaccattccctataaaatcatattgccttataaatgaaacatataggttgtcctagatataaaacaatttttgcctgcttgacactcttgtgttcatgaaaattatttttttaatacacaaaagagttgcgcacctatgtattaagaacaataaaatttataagcggagccaaataaaaagaagaagagagccacatgtggagtagatgaaaaactagaggaccataaacctattctcatggtaagcaagagacgacctattgtgacatagcactctaccttattgcgtcatgtatataccttatcatgtacaaaacaataaaaataaagaatatggtcagaccaacttgcttttaactatggatgattggtagtattgatataggggtaagaatacatttttaggatttagttcaatcataagggtttggattaagtcgttgatttcgtaccagctaattaggtatgctaggtataaacatttggcatagcatacatgcacttagtaatataggtgctcaatgaaaagagaaaattgacatttagccatcgtcaggatggggtttcgccagaatgccactcccaaaagtggtttcgttaaaatgccatcctcaaacaggggcaacatgttgtaatgccattttatccatttcttctcaatttaatgatttttgtagtgttttttcttgctgagatgactaaaataccctttatcctatctcatctctctcttcttcctctccgttgcatatacacagcacggctcgatggcgtggctgtggacggggacgacgccagctaagctggggacggggacggggaaggggacgacgccggcgtgggtggggaaggctgcccccaacctccggcgcgtgcgccagccaccgcgatcgaagacggcgacggcggcgagcctgacctggacctccatggtaccaacgcccccgcccttgagcggcgcggcgtcgtcgggacccacgtatgcgccatccacctcgaggcggaaggcgagcgtggtgatgttccgcggcggctgcgcgaagggcgggagcgtggcgacggcgatgggggaggacggggcgagggagacggaggcgagcggggagaagcgatgggggaggacggggcgagggagacggaggcgagcggggagaagtaggtgacagtgagcttggagtttgggttgtcggcgaggagggaggcgtcgatccgtccccagccgcgccggtgccagggcagggatccatctcctccacgcaagtcaactaaatggtcacaggggcaattttgtcacaccacggtggaaatcatttgcaaatcagctaatttggtcgaaatggcaaagtagcaatgtggcgtcgttcgaaaatggcattataacgaagccacaatccggagtggcattctggcgaaaccccatcctgacgatggctaaatgtcaattttctccaatgaaaagggatcatctgacttaactgttgtgtaattgagccactgacacatggaaagagactcacatgtcagcatatgtactttctccttgtctttttcttaaccaacgcttgtaagatcttgtattgtactccctccgtcccataatataagtgattttgagtttttacttatacggtttgaccactcgtcttattaaaaaaaattggaatcattatttacttttttgtgacttactttattatccaaaatactttacacataacttttcgttttttatatttgcataaattatttgaataagacgagtggtcaaacactacaagcaaaaactcaaaatcccttatattatgggacggagagagtagtattcatcaaaacgttagatacccgggtgaactaatatatgttggtatgagtcatttcagcatactcctgtgagaagcagcaaatggacaattacatgtatgagagtatctgataaattttatgatccttgcatatatagaacctgaaatatgcaccatttattccattctattttgcaaagaagaatgtgtaaacggtatcagagctcgaaaattttcacgcatagggctaaactaatgaagagctattttttcacgaataatatagcatttttttaaaaaatataataagaattacggagcgatttcagcctaaacaaataagagctatttttttcacaaattatatagcatttttttaaaaatataataaggattacggagctaggtatagggtttcaaccctagttgctccatgtttgttttccgccccagtgcgcagataattgttacctagctctacatattttgtttaaatagcatagagtatagagcagatgatggacacaagtcgtctgcagtactgcaggctgacatgtgggcccacagccctcgggcccacatgtcagcctgaagtaccgcacatgctctgcaggggatctcaattgagcagatgatattgatctcttaggtctaaatttcataagtaaactatttataaggtattgtttgagttgttgataaaacctaactaacaagctttaatacgtagagaaaaagaagattcctacaacattgtactccctccgtccctaatataaggattttaactttttgcctgtactgtttgaccattcgtcttatttaaaaaaatttagaattattatttattttatttgtgacttactttattatccaaagtattttaagtataacttttcgtttttatatttgcacaattttttttaaataagacgagtggttgaacagtgcacacaaaatatcaaaatcccttatattatgggatggagggagtactgtcttaaccaaattcctcatgttatttcccatcttcgtctactgtggaggagctctaactcattactcatccgttataattatcattttctttaggacaaaactcggtttagtatgtaacatttgatatactacccggtcgaaccgtaccaagctttcttgtaacatatatgatggtgttggagatctctagccaatcttatgccacatcgcatatatttcttttaactatgtatgtgccctaaataaacttagacatttattcgagccctagttttaaagacaaattctatctacccaaattgtaccgattctacctagcacacatgctaaaggaattttgcaaaattatgtatgctcgtgtggctgatctctcctctctactacacatccattgtataaaaacgagatttgaagggagagatacccctctaaacttttttttgtaaaatgaattgataaacatgtcaaaaattaaacacgagattttaaaatggaaaccacacgctctttacaactgcaccgtgaagtgatctctcacctccggtgtacaagcattttccatcgaaccctccatccccatggcgggtggttcattcgacgagacgccgccaacgccaaatcccggcgcgaaccaaaaagcgcgggaaaaatttccccgcacccgcgccatctccacctataaagatctcgccgccgcagccgccttctcctctacactactagtcctcttcaccccgccgcttccaccagatgggccgcaagaggagggctagggtttcccgcgacggcgacggcgaggaggaggaggagcccgcgccggtcgccgcagagagcaagagcctctacgaggtaaatccccaactccaaaccctaggtctatggcttacgaggtgttacccgtacgggtagcggttgattttgcggcggggtggtgttggtctgatcgaatcgtgtgctggatgcctggatcgatgtttttttgttctttttcttttttttccgggattcgagggtgaggagcgcatctgattgttcgatgcgatagcgggatagctttcgttttcttgtttatccggtgtcgcgtcaggttccgcccgttggggaatttcgtggttcgctgcgcggattgatcgtgtgttagtactagtgtacaagtataacccatatttgcataccagattacctcgaattgaagcaactgtgtgtaccatttcaatgtgcaaaaacaattgggcaagattatgctactgatgaacccaaagtacgaagtgcgtacttatgcaataggaaaaacattttgtatcccaaacatggaggcagttgcttgaaggctcacatttcacttgtgaagccttatgactgatatgggagagtgcttattggtttggccttaactttcagctctagttttgggcttcgcagtagtagtacctctccaaggattttatagtgacttaatcttctttaaatcttgctggccttcctgccaattgctctttgatggtatggcattcttgcctttgagctatacctgttcctcttaagtattactgccacagaatttatgaaggtcaactgatgtttaaatctaatttttatcatgttctggaatctggagtaaatgtcaaacaatcaaacagttacgtggctgggtgtgatagggcctctaactctctactatgcacatacattgaggacatagttcaatccttgctagcttgtctcgttaaaaatttatattgtcaaataaaaagggtttctcatatcatctgatcaatcagaaaacaccaatgactgggtaaagtgtgcaagagccaagaggtacaagaggttgtgattggcggttgatctcaagctataccactattagttttaaaagcaagtacaatagcattaccttacttgcataacttaattcaataaaccttatatatgtcccagctgttcagacatcagtattttttttttgtcttgatctgtgctgaaaaattgtaattaattggcgcacactactagactgtttagcgcgttttaaaaaaattctagactgaaggaaatgttgctgaaacctaagcttaatgaagtgccaaagaagagctgaaagagttcatggaaattcatgtaattgactttaaaaaggccacaaatcataagattgcaaccagaaacagtggctcctataggctgagctagctgcaagcctgcaacttaagagccccatcggttggcctaataagccaaagcaaaagccaaaatttgaattttcgaacttgattttaagatattttcaatgtagtttcttttagtgttggattttaagttgctatgaacaaatatataaaagttttacctataaattaatttttatatggcttattagagaatatgggcaaccaatgagacttattgtgctgctacctccctagcagtgacccctagcaaagggcattgctggcttcctgcagcagttgtctgtggtgcaggtgcagctagctcagtggaatcggcctaaattatttatttttaagcgaagctgtagaaaggaacctaaagtacatatgcaatcagaaacaattgttatgcttcagttttgtctttctttataacacaagtaactcatttgatgtttcctttcttcattctgaagatcttaggggttgagaggacagcttcacagcaggaaataaagaaggcttatcacaagttggccttacgtcttcatccagacaagaatcctggagatgaggtaggatcttgtttccaaattttttccatggattaagtgccatttgtctcaattgagctgttatgtgatgtcaggaagccaaggagaaatttcagcagcttcagaaggtgatatctattcttggggatgaggagaaaagggcattatatgatgagactggaattgctgatgatgatgtgagcacctgattccaagtagtgtgatttccaacctttcactcccagtagattttctgaagttttgtcttttcctgtaggcactggttggagaagctgcagacaatcttcaagagtacttcagagctgtttacaaaaaggtatctttttggtccatatcaacaaaaaaacttgtgctatctgttcacctatacaatgatcggtgatgacctacacttctgcaggttactgaggctgatattgaagaatttgaagctaagtacagagggtcagattctgaaaaaaaggacttgaaggatctatatacaaaatttaaaggcaacatgaacaggtggcttacaaaatttagtgttgattaattttctatacagaaggcaatgaattgcaagtgaataattgggttccatttctattttaatttggtgcccttgtatgcaggcttttttgttcaatgatttgctcagatccaaagcttgattcccatcgctttaaagatataattgatgaggcaattgctgaaggtaaatgattatatgctgttgccatataattttatcatataatattgaatacctttttctattccttttctacaatgaagcgctggcaaagtgtttagcttatcatgctaactcaatctattccctgaaacttctctaatggttaaactcctttccatttccttcccttttgtaggtgagctgaagtcaacaaaagcatatgataaatgggccaagaagatctccgagattgaacctcccacaaacccattagagagaagagtgaagtaagctctcattctcttatctcccaagtaatccgccttccgagatgttgtctaccatcagttgctcactactgcatttgcctcaaacctcgtcacaggaagaacaagaagaagagcgaggagaacgatctgatcctcgcgatctcacagcgcagggcgcagcggaaggaccggttcgactcggtgctctcatccatcatgtccaaatgtgacccaaaggggagcagcagctcggagcccacggaagaggagtttgagcaagctcgtcagaggctcgagaaaaagcgttccaagaaccgcaaatgattcgccttgcagcctcccttgtggcttgtgcaattctgtttcatcgagtttgttaaccaggcctatctttgacagatcagattgtctgatattctgatccctagtatctatgtgagattggctgcttctgttgtggtgcaagttcaggctggaatctgaacttcctgctcttttgctgaaactggggccgatctttagcatcactgcatatgtgtataatcaaaatcttaaatgtttcctggatgtgaacttgtgatctagtttctgtataagttaatccagtagctgtcttgagtttttacgcctgtaaacgatataaacaagaatgcatcatcaacagggacgagaggcgggtttgcaatctcgttttggggttgaattgtgaggcacagcactattttcactaaattctgatgaaatttcaaacggaactattcataaaactgaatggtttgggaagctcgaataaaattcgcatgaacaatcttgataaaaactggttggtttttgcgaaattttctgtgatttcgagataggctagaaatcatatttttgagaagggggggggggggggtcgaatggtatttgaaaattttagggtttaaacagcaaaattcgattgaaatttggcaaacgccattagattagaacttcatcgagcaatcacctccactaatcaccaccacccctatcttggcaaacccactaatcaccacccccatttttggcgaagctccaccccgagcttcgctcatggccgctcgccccgccattaaaatcccccgcgcgcctcgcctcgcctcgcagctcaacgccaccaccgcgcgcctgcagcccgagaagccgtcgatcgacaacatcacccgtctcctcccccaccccgcagagcccagcacttcgccgccgccgcccgggatggagatgaagaagatcgcctgcgccgtgctgctcgccgtggcggcgtccgcctccgcggtcgaggcctccgagtccccggcgtccgcgccgggccccgggtccgccagcggcgccaccgccgtcgcggccgcgcccgccgccgccgccgccgtcgtgctctccttcctcgcctactgcctgcattgatgacgaggagagagagagtgagagagagggtgtctcacgtgggagaaggcggcgcggctggtttatttgtgtttttttttaaaaatatatgatctaattcgttggctaatttgattgtttttggtttatattttaaatctacgtgtttgtgaattgtggttgaatatatatatatatatatatatatatatatatatatatcatgttgcttaatttgttttctgacgttgtacctgctcaaatccacacttgtaagcttgtaaccgttattttatggcaatttaaatatagcatatgaattgatttgttcctttttaattgttttttttgtttaaaatacattcagatcgttatagatttatcgaaaacggtaaacatctttaacacaagtcgttttgtggcatggagaaccatctgccgctcaagcttatagaatggacgcaggagtaggtgggtggatggcatgattcatgtggctggctattgtattagcccaactacattgtttcagttagcttttatgaaactgataaataatattgatattactactccctccgagttgataatatttgtcgttttaaaaatatagtctaagaaacatatttgaccactattttctattataatatatatagaaatatcacaaatatataattttattgaagtacatttttaaaactaatatatacatatagttttcatatttctaagataaatattttataaattatttatagtcaaagatttgaaggtttgactttactctgcttcaaaatgataagtattaccagttcgaatggagtatagtacattgtttctccttaaaaaatctacatcatgttatccgcgtcacattactaaaatcataaagagatgtgacacttcataatactacgaatctagactaagagacggttcagattcgtaatactagaaaatatattcctccagaatcgcttatattatgggacggacgtaacatatagaagttgatttagaatattaaaactcaactaatcaatcacatggtaatgactttttcttttgtttttggtggcttaacttcatctcaaccaaatctaaattcgacctgctatatctgctcatccagttagatctcgaccgtcgaatctgcacgatccacgatatcaaattcgcgatatatatatttttttaaaaaatacaaaattccaagaacacaagttgccaatatgccctgacaaagacaacaaaaaaaagaacagaagaaaaaaaaaattaccaagacaaaattcccctatctattgactaacccaaacccaaagcacataagcatgtgattagcaaaagacgccgtactctctctctcatcaaactgctgacgtacgcacgccgtgagacgccgccgcagcaaaagcttcccttcccccatctccctctcctctcctctcctccccgcctccccccgcctcgataccctgcaagccctagctctctctcgccgccaatggagtcgcaggtgctggtggcgctcgccctctcgctcgtcggcggcctcagcacgtccatcggtatggccccgccccctcgcgcctcttcccctctcaacagtttcgtttcgggggtttggatgctgctctgcctgcggtcgggcgcggtttcctagggttccgcgggtggatttaaggccgttttgtgtagcttgcgggctcgctgcttgaaggaatcgccaagtggctgagcatctcgcaatctcgcgttcctgggaatttctgtgtttctggtgagtttcaggtgtcgatagcgaattctgtcttgctaccgctcgtataggtgacttccatgcgaattcagatgcatcctttattagcaaatcgaaaattagtgtttaggatttttgttaagaaagagagttcagaatccagtgagtatctcccttttgtaccattttggcttgtgagtgatgaatgttttgctatttaggcctctgaatatgaaaattaattgatcacaatgattcatcagatttttttgttttaaggtcagcaatggggtgttgtaatttgtaaataagtggcataactggacaggtttagtggcagggtgtggttttctcttatgtgtactatgtataacaggataagtaataaatgtcgttgcatggtcaaaaacttttaacccctagggttcaacattgtacttccttatgtttggttaacaatttgcgaccgtgaatgatctcaggacattgagcgatgagtactctcttttaaaactgtccctaatactatgtggagggtttccagcaaggcttctttgtgccattttcccactttagaagctccaattttctgtttttcaggtgcgctgtttgtgattttgaatccgacgcctaatcttaagatgcttgggcttctacaggtgataagctttgttctctatagtaatggagcaacttcactatcttttaagcaagttctggttttgctattggttcttggtagattgatctcttgctgttactgaatacagggttttgccgctggacttatgttgagcatttcctttctagatttggcacacaatgcattgaattctattggtttcttgaagggcaacctttgggtcagtcatgctttgcctatacttatagtatccatgccaatgtaatgccgatctatctcatacaataagcagcaaccattgttaactaataataatattttgcagttttttgctggagttcttttctttggtttggttgtcaagtttattccagagccaactgttgtgccaacagctgatgcaggcaagaagcaggttgaaataagcagccttaataatgttttcacaatcatattagtctgttttcaaataccaaggctgaacagaatttagttctctatgtttggtttgaggaaagcagactgacgatgatggttcgggtaaagatatgatgaaaaaacatcgtcggcaagtattattcagtgggatcattactgctgttggtaagaaaataagacttctgtatcactaagcatacaaccagacatgcattcctattgaacttacaccaggccattattcgaactgtttcttgatatatgttgtgtggctttgcttccttgttccttgagatactacaacaatctgatttgatacttattatgagcctgcaggaatcagcttgcataactttccggaggggatggcagtatttttgggatccatgaaggtattgcttttgtatattcatcattccaatatagtggcatcattcatctgttgaagggatctgtaacttgcatttttttcatctaatagaagttacttgggaccaaccacctttcaaagcctttactagctctggtctataacactatataacatagttttggtgttccaatagttactgtatttgagtagttggcttggcctagttgctagttgtatttaatatcattctgtgtcccaatagatatcatgttggatatttgttagcttgccctgaatgtgttttgttatgatgaaaaactgcagggccttcgtgtgggactgaacttggctattgctattgctttacacaatataccagaggtagataaatcaacttatcagcatttctggtccatgagaattcttaactacagtttgatgttgcatattgctaattaggataccctagcttgttgtatgtgcttgcagaaagatttgaatgccatctaaagtttgcctcttagaaaatatctggtatttcatttatcagtttaatatgaatcgccaacgttatggcaaactaaatcatgacaaggaaaaaaaaatctcaagtttggttaattatatatgcccttaagctgcaacatttatgacattttctagatctcaacaagtcaatgtagctgtatctgaatcattgttgagtgtggcaggatagagtcttggacaacttcttttaacttctacagaacttggttcatttactgtagtatttatctgaagccctaattagttgttttttttttcaccttctcagggggttgctgtagctctaccactctattttgctaccaacaggtacctattttacccatgtagagaggaactgaattaagttatatggttcacagtagccttcagaaatgagttcattaaagaatatatgttatggctttgagattttctatagacaaaagagtgtactagttactggtaaaaaaagagtgtactagttactggtaaaaaaagagtgtactagttgaagtcatgaattgaggataggtgtgtaagatttgagaactagtcattggcgaaccactcttatctgctagtactacattccacctgttgcacttggaggattacagagcattaataatttctaatggttttgctttagcgaaaaggcaaatgatgcttaaccttttcaatttgcaataatagcatgtttctgatagttctcttgtaattttgtaacactttcttctaccacagtaattatatcttgttccttttttcacatgtcaaagcaaatggcaagcatttaaagttgcaaccctctctggtttcgctgagccactaggagtgatcattgttggta

SEQ ID NO: 55542 - DNA, 1997 bp, Oryza sativa
  unsure (1)..(1997): unsure at all n locations
cattatcccatcccgcgggggtttctgatgttcaggctgaatctgcagctcgtctagatcctgatctattcacaaactttatggtacatcatgtatattttgggccttctgctttgctaaacttcatgaatataggaagacagatagacgaatttattcaatctgcaccatattattttctgctggctgtcttgatgggattggtgcataacatggcatacattaaaactcattcattcatcttgcttgcattgtccatcttatccactgcacttgaatagagaggccattttgcaaacacatgctagtagtggtggtagggagctgctactttgttaaagtaggagctggtgtttttcttttataatacagctaactttttttttctagtacagtgttgtatcatgactgttttcctcctgcagattcctagttggtttgggactgaagtgcaagaacctacaaaatgctgtccttttccattgcctgaaatttattgtgcatcccagagcaaaaaggtatggtgcattgttaaattcatcaaagcttggtcttcaggtgctcttgctctgacttgattaattctaattatgtcccctactgttcttaaaaaaaactctttaaaggtcattgttcagacttcggactacctgcatgtgcattgctaatttgtctatacttgcgctggtgcctactttagaatgaaccctcgaattttttcccactccatgactttgtgggcttgtggctttatgtacaaattgaacaataccattgaaataattggtgcttcgatattcttccacaattcgcatgtctaaattgtagtagcttagtgtgtacgaatctagctgcattagggatgctggagttatggagcacaagatctggttattatttgtgaagtaggagaaaaatgtgtcctgttgtttttaccactgacatttgcctcatttggatttttctaattcaactctgtgtttacaccattcatattcagcttgctgcactggaagatattaggaggactattcgggagctgcaaattgatgacaataggaagaaggaattgacaaatgccctccatgcacagttcaaagattggttatatggtaagatatcatctgaacattcagatgctaatgcatacatatctactttatgcttgctttagtgccattcgcctatgatggttttgcctaagtcattagaattggccttgctatctgaaatttagactctgacaaagaaacagcgtcacgaatcacattgtctgctttgaccatacaaacaaatttgcatgaatggagcgctcagtcatgagtcattactgctcagcatgaggattcttatgtactgtgggatagctacaatcatatgtgctcactactacacgtcacacctgtcacaagaatatatgattgggtcaacctagtagcttcaataagtgttttttttccaatataggtgtagtatagagtatgacggccatacataatgaacttgaaccattattctgggcttccaattccacatgattctgaatccgttttattcagcatgtcagctggagtattaagtacaacatacctacatctatactactttaaaagcctcttgtggtggtggngagnggnnnnnnnnnnnnnncnnngnnnnnngnnnnnnncgngggtggggngatggtnggcttgtntgtttatgtggttggtccttgtcttttgggctttcttgtgtgatttcttcccgcgtgcggggtgtaggacgtgacgtccctttccttgctatcctattgtgttaggcgtcatgaattatggtatatggaaaactaaatggttgaattggaagtgggttacatttttccactgtgccgagagtaaatgacattccctagatctttagcccatttgcattagagaatctccaagtgctacatattgattacgctaccgtgctatcatccgcaaaaaataacacttcatggtttgtacaatatt

SEQ ID NO: 55543 - DNA, 4155 bp, Oryza sativa
aggcgcggccatgcggtgctggctaactcagttgggggagttggccatggaggagaggtgtctgcggctgggggagtttctggggagagtcgccgcgatagctagtgttagcagatcgtacatgggctgcgcctttcccaccggagtacggcggtctggcaggttgtctggtaatgtggtatacccgtgctgtattgatggaaacgaataggagatgttaattagatggaaaatctacatcgatatggcaacagtattcagtgcttctggcaagctcaccaggctaaaatggttttctaattagataattttggacttcaaaatgtatgtgaaactttttttaggatcccattgcaacataccggcaatcacctacgtatgtgaaactaattctttgagtttcgttctactttatctttttcatgcacatcattgctgatggtatatatggcttgctcaattttggtgagctctgggttcccctaaatcacattttgttaatttttcagcttcaggcaacatccgccagctctactgcctgcaaggcgactgaacatgcgatcatctgctttcataaaatggacctgtttactcaaaatattcgaccgtgtcggttgaagctgaccttactcccaggtgcgaaccaataatgtaaaaaaaacatgtacttcatcctatttctgcaaagtagtttgatgtatttctccaattcttttcccatttgctgtggcgtcagtcgttgggatgtcatctttcttttcattttctggtgattacacatttttggcccttccataaataacacggataagccagtgtaatagggattaattaattaattaattatgaaccaactttggagaaatgacctatataaacacttgatttccccacgtggtggtccacatatcaaatcattagcattcggtttcctatcatttcccttgttggtatcttaattatgtctcgttccaaatgggaaatgattttctttccaattgaaatatgaactgtatatagcccgataagtgggatttgcggtgccgttgggtcacatataatgcagatgcatgattgagtctctactgtactatgcgtggctgcgtgcagcctttggaccaggatccaagctacagtccctacaggagaagtccagacagcattcattcatgtttatgtgctcctaaatataaatggatttttgttggatgggacgtatcatagggctgcgaatctagatgggaaatattttcagatttataatactagaatacgttttatctattccaaaatctattatattaggtcggagggagtatatttgtatgagcagcaggtataaatggacgtttccggtttggtgatctgcatgcacaaacacatgcagctagcgcccaccgacgaggattacatgtatacgacctccggtcctaaatggtacacattctaaggacctgttttattatttcttgttttcaaactgttaaatgttgcattatttaaaaaaaattatatatataagttgttttaagaaaaccaaataaattcagttttcaaatttataataattaatacttaattaatcatgtgctaaggaggtttctcgttttgcgtgccagaattgtggagatcgaacggggcctaatactatgggtgtgtttagttcacgccaaaattggaagtttggttgaaattggaacgatgtgatggaaaagttgaaagtttatgtgtaggaaagttttgatgtgatggaaaagatggaagtttgaagaaaaagtttggatctaaacaagggctatgaatcagacagattgtttaagatatgtcatattcgattataggttgttatattttaacatggatgaatcagacagactattcaggatgtgtcactactgaagaaatgatctttgttgggtcacgcaaaaatcatattattcccggtttgagtaagaaccaggactaaaaatatctttagtcccgatttaaaaatccacaggtactaaagataaatctttagtcccggttgtttataccaaccgggacccaagctctaaaaaccgtgaaaactcctgagccgcgcgcgctgtgcctctcgtccttatcccatcctcctctcctcctcccctctcattttctctctacctccccctttcttccccctcctcactcctcctccgacggcgacggcggccaggaggtggcggccgggtggtggtagctgggtgcctgggcggcagatccggccgggaggtggcagaggtcaggaggaggtggccgggcggcgccaacatcaggcagccgcgaccgggaggcagtggctgggtggttttgtgatttttttttttagatttagggatgattttgtgaatgacttggggattgtggatgatttttttggatgggcaattgtagatgatttgttgtgcataatttgtgaggatttgagggtgacaataaatggaagcagaaagaaacaatgaaccaatttttccaaaaaaaaaaaactaaccaaccaggactaaagatggtagcgccagccacgtggtgttaccatctttagacccggttggtattatcaatcgtaactaaagatttatcttttctcccagttattttaactgggactaaaatgggtatctttagttttaaattggacgtctcggtttgcaatccgggactataaggggctataaaccggaagtaaaaagactttccctattagtacgtacattctgatcctacacatcttatctgaccatacatggttctacaggcaaattgatcagcctccctcgtgatgcacggtcaggtcgatcgtatgcacgtacaaagccttaaacatgtaccagctagctataggcgcgttgtggggcatgcagcatatcaatgcaatgatgcagcatggcaaagggcttatgcatgcatattcgatctttggcgatcgatatgactaattacgtggataaggcgtgtacatacacgtccttaagcgtcttctaattttaacacacgcttaaattatggtttggcgaatggtcaagtgtgtcaaatctctacggtcctgtttccaagatacgaagattaattagcctgtgacggtgaatcaataacgtgctagcgatgatctaaagacacgtaggcttacctaccttctaagggcatgttcaatgatagagacgtgtatggttttttaaacaactatgaaggtggcccacgcgatacgcgggcatccatgctatcataatagaaattatattttataagggcaaactataggtcgggcatatctgaaaaccattgacttagaagatagatcaaggtcatatgacatttgaatttacttttggactaagtgagtaaatatgatgtatacgcgttcgcgaaaagtaaatattatgtacaccatttaaacacatactatataatattgctacaagtaaaaattgcgatagcaaggacttaaaattattgtgatcgaatcgtctcatgaagatgcacgatttagtgacaaccaaattaggatagattaacggttggattgtttttcccttcgtagaagttcaaaattttcatattcttttccaaagttttaaagaatttttgttaggacacaaatcatttgcagaattgctttgttgggtagtgcaaaatatcagcaattgtttgaagcttttctttttttttctttttcgcatgtttgattgttttcttcgaaacgatatttgtttgaaataagagcaaaattatataaatttaattggtatgtatagtgtttatcggatcaccatatcaccttagctgcctcaggtacgatgcttcatcacacgtgcagaaggcaaacatacacatgtgcgtggtctttagaagtttcattttacttttataaaagatagatatggcatgcttgttaataggtccttaataggtctaattaatagatccatcagtttaagtgaaaaccgatatcaaaatattttgttaaaaatagtataaaatagtgggttgagtaattaatgtaaaatattagttaacatagatcataaatgggcaatttactggtagagaatattattgcgtaacatttatattaaacaacatgtttttaaaattttcatataaaataatgatttgatataatagatgcatcggttt

SEQ ID NO: 55544 - DNA, 1158 bp, Oryza sativa
gtgtgcttatacaggaaataaattgcatttatagcactcctgagaaagtgaggatgttgcgcattgagagaaccaattataatccaacattagttgtgtgcattgctccagaccaacagcttattcagcgaatttgccaaagtagatttcacctatgctcctcggtcttgtaatacttctgcttatgaactagctcaaattgcggtaagatgggacccgggtcagtctgttgtttggactgatcccctcccggagtaagtaaattgcctggtggctcatgattccactgagccaattgagtaataaagatgtgtgtttgacaattaaaaaaaagatggggcataggtgctggaggaaaattatttcaattattaattctaatgtgtcatggtctgaaatcagtgatactatccttaaaagcttaacaagtcaggcatttcttttgcacagatgagggagcaacaaaaaaaattgatgtcttacatcagcgtgatgctccaataaaatcttcatcgtgctatattggccattcatcgcagctgtcagcaatggggtcccagtgatagaatctaaatccacatcaactcctcttgaaagaaacaactctactatttcgcagtgtcctgcaaaagaagaatttctaaataattaataagaacaaaaggttcagctcaatcaggaacaccctagaaacagtgttaacagtgattcctggacaggaacagagtttccttcaacagcagtctgttggaaaacaataaaatttggatttaagttttcataaatttaatatctaaagcttggcttgagcaaaattcaacatattaacagcaaatatgcttataataaaggacaataataatgaagtgtaggaacaaaagttgttgtccagaaacttttagttgtttctttttcatccaaatcatcaataaaatgtgaatcagagccaagcaatcacccaagagagaagcattgttcaagacttcatgcctttgtcagaattctatatctgtcaacaatttttagtaacaaactatgaaaaaaaaacttactaatgacaaaagactgatgcaaggagttagtctctatgtgcaatttgccattagttgtgagaacttgtagcaattgtttccacaaaatgacagaaatccagagtca

SEQ ID NO: 55545 - DNA, 28709 bp, Oryza sativa
agtacctatacatttttcgaaagattattatgatcgtatcacacagatttttaatctttagattaaaatctgatagatataataaaaagcaaaaagcaattaagaaacaccataatggacactaaattaccatatcctcaagaaaaagaccaaatccaatacaaaatttaaaatttatatgcgaagatttaaaaattacagtataacttacaaagttacagtgtaagtttcataaattacactgtaacttacaagaaaatgcactgtaaatttgagtgagaaaatcgagtgagagataagaaaaaatctttcgtgtgagatatagcaaaatcgttcgcacaataatcataatttaaagagtagtaaaggtgaactgaattcgcacaataatataaagagtcggttcttaaatttaagcggaggtgttatataggtccgtaaacttgaaattttcacgttaaaattcataatcttgttttaatgaaccatagctagtccaaatgacgtttgactagagctgaacggctatgtggtactccatgtaggcaatagtttttacttatcccttgttgctacagtagtcatcgaaatccatcaaaatatcccaaacccctgcgtccctttgcatcccccagacgctttcgagggagaggcctgagtagggcgaggacgatgccgacgatcatcggtggtgcgaattgattgaggtgtcaatttggatgcgcgactagcagcgcttgataggcgatgcataatgcgccttcctcgccttcagtggagaagatgaatcggcgccccaaccgccattacctcgccgcctccggataccgccgttgtcatcgcaaccctagctgttgtttggaatgcaaagggatgaagggattttttttttggggggggggaggggaggggcgggggatttcagcgactactgtagcaacatggggttaagtataaaattaccaccatatatgtcaagatgtgaagggggcggatgcaaaatgctgcctaagtagagcaccatgttagcggtcagctccggtcaaatgcgcttggaccggctatattttattaaaataagatcatggaccttaatatataattttattaatttttaagtttattgacctaagtggcatcttcgctcaagttgaaggaccgtcaatgtatcttaatctaatctaaaacagttttcggaaacaccaaatcttaatctttctttgattttatctaatgaaattacctggatgttttttaattaagatctagattatttttttaatatttacgagtgccacgttactcacgcaatttctcacaattctaaggggcaagctttaaaacgcgtgatttgaaaaatgtagaaatagaaatagtaaacaacagatgtgtgaaaacacatatatagaaagagaagccctttaattacactgcataataaaataaataagcagagaaattttgcaagaggtataataaatattagtagagaaaatattcccaagaggtatacctcgtacttatttttcaaaaatataaccgcatgcttaattttctactaataatcgtgtacgtgcatatgaattaaatcaaacatacttcaccgcataggcagacaaagtgaaagctttttcagtttatcaaattgtacaaaatcacatccaacggtactatgttaaaataatccaacaaacaactagaaaaagccatttcacaatatcacaataatagaagagccatttcacaaatttaaaatggtgccaaaaggttatttttttctaatatgggagaaaataatctctaccattataaaaatataataagtatggtttccggtttttttccatccgtcatttagctttccgattttgtggaagatttctcatctgattgatcatagcgcataaaaaaaaagaagaagacaccccgtcattttttttaacgactcgcacaagacggtgtgaagttctattaatagaccagaaaaaaattacaagattacaaccctggaaagtcgtaactaggaaaaggaaaaaagtataccaccacccacacaccggcagcgccaacacacaggtccaagagaaggatagcaccggaccggccgttgctaagcgtgatcgatcgctgctaggctgacaacgaaacatggccgagatcgcccaaaacccaacccttacagtcaacacaaacccactctatccaagacttcaggagttagggagagagggtgagagagaagaatagaacacatctccccctaggccctccgacgtggccaacttgtagtgtctagcacaccgcaacaagaggatgaaatctagagcgagcttgcatcaattggttggggggtttcggctaagggatgtctaaacaacgtcttcaagaagagaagcgacggaaaataccaccgccgccgtccgtcaaggtttcaaagagaaccgagactgggctttcgcctgacatccacacttgagggatgagacggcatgacaacgcccttaggaggggaatgacgcttcgaacgtcatcgttgccgaccagggcgagaccaggctgggttttcacccgccactcaccacctgcgagtccacggctggcacgatgccccaccactgtcaaacttctgccggcacgtgggaccactgcaccggcgccctcaccagccagccttcttgcgccgtagaccaaaccgaacccaccggaagctcctcctcgtcgcaccgtgctcgcctcctccaccgccggcaacgcctcgtcgcgccttgcccgcctcctccgccaccaaccgcgccaagccggcctccagccaccggctgcacctcctcacgccaagccgacctccactgccgccggccgcgccacctcgcgtcgtaacgctccgctgctacctgtcacgcctcaaagcatcgtgccaacctctgacccctcctctagccgccgccatgccggccaagtgcggtcgtctgtcacgcctcctcggctaagcgcccgtcgtctgtcatcgcccgtttccagccgacgacatcgcgtccgcacccacacctagtcttctccttctccgctgcccgactccttgatgtgagcaatggttgtatccgtagtagccatggtcacatcatctccgtggcccgatctttcggtgagttgtagataactacactttgggagaaacgttgacgacccgactacaaccgtacaagacgttgttgtattgcgtcttagcgatcgatacacctctccgtgggttgttgatcttgccggtgcagatcaaccttattcctgtaagcaaatagaagaaacaagcaagaacaagataaaagcaatctgaattgcagataggaattcaatacaaatgataaattggggttccgtaacgagcaaaccgtcgatctaaccgatcacgggattacacggcaaagtagcgaagctaaactttaatctaaacaaaacccgagaaaccctgaagtggtacctagctatttatggatgtgggaggacgacctagggtgcctagggtcgtgctccacctggttggggcgcccccaacatgggtcccacatgggccggggttccaaacaaagttacaagcccaaaggcccatgacaggtgttacagcaccttgtttctttatttgcagatggctagggtggaatttggtgatgtggctagatccgttggaaagaggactccgagagctttccatcaagtactcacgggtcaaaaacggaggtcgtatgcagattcggtggctgtttgaagtcagcagtgtagcaggtggccgaattggatcctagcacttggaggacttgaacttgatatcttgttgttcatccatgatgtgaacaatggttgtatccgtagtagccatggtcacatcactccttccccgcctccacttgctgccgccggcaaccatctgcacgatgtcgccagccgctgccgcatccgccgacgtcgccagccgccagacgccgcctccaccgccaccttcattgccgcagccgacgtccgtcgctgccgccgtctcggtgtctccagccgtcgtcgccagccaccgccgccgcaatcacattcgctgcctcttcgccatccaccacctcagcagtcagcatccaccacaacaccgccaccatagccaccgccgccgtcgccagccgccatcgccaaccgctgccacatccgcgaccgccagccgctagccgccatccaggtccgaccgagttggcgcggatctgggggactccgccaccgtcgccgccaaaccccacgctgccacgtccgccaccaggcgtcgccgccgtcaccttcactccccgccgccagtgacccctccgccagatccggctgggcccggcctggatctggccaccaattctgccgctccgagcaacgcccctggccgctgagcgcgtggagggtgagacaaggccccgtcgccgctgtccttgcggccgcacggctttgccggcacccgctcatgcggcggcgaggcaggggaggaggaggaagttggcggtgtcgcctcccgagtcacctggggagggcgatgcgggaggaggagggaaacgtccttgtagtgttggccttggctaatgatttacgtaccccgtcatatattgtactacaccagatcggtttggactggttcatcaatgcatgcatgtcggtttcgtcatccagtcatcctttcccttcgcaagtcgttggtttggactattattagaacgaaatactccgaggatggtcggtgccgcatcccgcatggcgtcactgttgtcgtgcgatgaagacattgccgtctgctgtacatgacaacatgccgatacctgctcaggttcagtcttttcgccgagctcgcctcaccaagagctcgcctcactgtacatgacagcatgccgatacctgctcaggttaagtttcgcgcgttgacgtagccatgcactaagtgcttccatccagcgtatttcttgagccccattgccggagtacgtacaagtacaacgcgcgtgtgtacgcaaagcatgcattctataattaacaaagtaaaactcactagtacacaaaacattttcctggacagggacccatttaaattgcagacaaaccataactgatcgcatctgggaaaatcgttctcccattttatgtgcggaatcttaagagttttcgcgtgcgggcatcttaagaccaccgcacggaaaaataccctccctagctcctttttccctcacaacacttcaaaaaaaaaattccatcctcacatccttatcctcacctcacctctacctctctctctctcctctcctctcatcggcagcgcgcgggcgacgactctgctgccgccgccgccgccgaggtggccaagatccgacggcgcagcgcagcgcctctccgccgctcggatccggtcttccgccgcccggatccagcggcgccacccctctttcgccctcccccgcgcgacagcgacgatgacaaggtggccgggattcggcggcgcagcgcctctccaccgctcagatccggcggcggtgcccctctcccgccctccgccgcccggatccggcggcacgcccctcttccaccgtaccccacgcgacggcgacgacggcgacgatgacgaggtggctgggatccggcggcacgacgcctctccaccactcagattcggcggtggcgcccctctcccgccctccgttgcccggatccagtggcgctgtacctcttccgccatccgccacgcgacgacgacgatgaggtggctgggatctagcagcgcggcgcctctccgcctctccccgcagcgcgatggcgatggcgacgacgagacaagctgtggcggcggtgacggctacgtcggcgacagcggcgacgatgacgagctgcggcggcagctagggtttcgattttttttttgtgatttttattttcttttttggatttttattttcgcatgcgggcgacataaccgccccgcacgagaaaatgtgactttcgcgtgcgggtgtgcctcccgcacgtaaaaatcgcgatgttctcatacccctgcgtgcatgcgggccgcccacccgcacacgaaaacccattttcaccatatgggaaaatcctttttctagtagtgactttgatgcgccgatcataatgttgcaccgtaattaatctgatcagcatgtttggataatttaggttgtgacaaactgaaggattaattagttaacataagtgtaattgcacaagtgctaatcagacacgacacatgtatgtgtaaactattttcaaagttagtgtaagatcgccattccgtccagttccataattcttaatgttttgaataagattgaggccaaactttttgaataagattgaggccaaacttttataatctaacatcctagaaattcatgttaataaaaaccactaaaattcgattttcttaaaacttttgcatcatacactactggagaaaccatctttggtcggtcgaccaaattccacaataatcccggttgcaataaaaactaggactaaatatattctttagtcccggctcaaaaggttagagctactttttgatctatagtcccggttggtaacactaaagatcatttttagtcctggttaaaaaacggcaggtggtgtcagacacctctattatctctatgtatagtcctggttgcttaacaatcaggaaaaaagatcggcatgtgtggagaggatgaggcgtgcgcgcgagatcgatcaggaggaggtgcacacgatcagttactaagttctatctcctagcctccctcacatttatctcttccttctctcctctcctcactcaccccatctcttcctcttcctcctccagatccgccccctcccctctcctccccacttctcaggcggccgagcggcggccgggcggcggcgaaggtggcctcgtgcggcagatccgggaggggaggtggcaaggcggtggcggcggcctcgcacggagggccgtgcccggtggaggcaggcgacggccgacacggagaccagtgcagcgacaggcggtggaggccggtgcggctgcacggatttttttttcttttttctttaatgtgtgattcgatctgtgttgaatgattcgatctatgttgattagatctgtgttgaatgtgtgattcgatcactgttgagaatgaactatgttgttgtgaatgattttgagaatgcactatgttgctgtgaatgatttgggatgaactatattgttgtgaacgatttgggatgaactatgttgctgtgaatgatttgggatgaactatgttgctgtgaatgatttgagataatgggcgtgagatatacaaaatagaaaaaaaaactgggactaaagatagcgatcttttgtcccggattcttactccggttggaaaatcgggactataggaggttatcaaccgggagtaaaaagcatttctccaccagtgatacgccggatggatattgtggttgctagtgcttgccaaaccgtaaattgtcacaatgggggaaataaattaaagatgtacaatttacaaggatagattatttatcaatcatacaaccatctatgcaaaagacagaaagccaaataaagaaaaggttaattattaatttttgtaatataagttatagatcaaatattaagtaactgaaccatgtcgatagcttgatctcaggggaatacaaaaattaaatctaatttgcctagatatattttcataaaacccacccacatgaaataatagttgtcggtgatatgggcccgaggttacccacgttagggggaaggagcggaggagcccttcctcctagccacgtgtaagtagccgagagacgccccacgtccacctaggggcctcggggtaccccgtcgcacccctcggtcccgacgggttgcgccacctcgagacccccgctcagctgccactcggcggctaagtgggtggaggagggggcgccgctggcgtatttatgaacggcgtcccaaccacgcacgcgcatcggcgtggctggtcgtgcgacgccgcccaagtgattgacgtgcgtcaatcacttggaccggtctgtgaccggtggcagatggataggacgggtggcagcgcacccacgccccgccctatgtcaggcggcgtgagggcaggtttgccccgtcccatcagccattagggctcagcacgtacggccggtgcattcccagtagcatgtgcctacaaaagtcttcaaggtttaatgagggaatgacaggggatgtcccccgtgtcagatgggagacggtgctgggacccacctcggagcaagcagccatattgcttccggtctaaggcataagcgggagtagaacccgaggaagagggaccccctccaggaaagatgagacgaatagaggcggtgcatgtggtatccccttgaactataaaaggaagaccttacccaccaagcaaggggacaacttttgatagcctgaactctaagggaagtacagttaggttttcccaggagcccaagatctcttgtaagaacttaagcatagttccacacacagaagtagggtattacgcttccgagcggcccgaacctgtataatctctggtctcactcccggtcactctcgaccaccttggtcaaatcttcggctaaggttggctcttaatcactcgcgccctatcgcctggtcgaactcacaaaggggggtggtctcatgtcctcccgctagagagggttactcctcgacagctggcgcgccaggtagggggaaacccgcgcgtttgtgaaggagccgcttttcttccgccccaagtttccctccatcctcaacgaccatggttgaggtagtggaggaagaggtggtggcgtatactccctcaccttccggaagtgaggacggtagcgggagtcgcgaccctcgccaccaccgctggaactctccgacccctcctcgtcgatgtcccggacggcaggaggaccccaccggttcggaggattagccctttccccgctggcggacaggggcaggttacgccgcgccggggtgcgacgccgcctcaactacaatgatggcggcacaccccacggcacactctaggctgtgggggctctcctgcggcacccttcggtcgttctagagccggaaaccctagtccggcggtggctggatgacgtgacccacttggtcaccaccgccccgcgacagctggccgccgacgccggcgaccggcccgcgaccactggtacttcgcgtaccacctacaaccctctcctcatcggccaggaggagggcccgtcgttccgccatgatctcacggtggttgacggtcccgacgtcatcgaggcccacggagagccacgggcgtcacgacagtctgtacggggaacaggacgctcgcatcaacatcgagcgccgcagggacaagcaccgtgctacccgcgtggggaaggcacctcctcatcaggaatgtcgcgccaccccacacgaggtggccggccccccacgcccccgtccagtgaggcagggtgcaaggctttcatggcaagtctccggaatgtccggtggcccccgaagtttcgtccgaaccgcactgagaagtacgacggcaacgtcaacccctccgagttcctccaaatctacactacgatcatcgaggccgtggggggcgacgatcgggtcatggcaaattattttcccatggccctcaagggtcaggcacggatctggctcatgacccagccccctgactccatccactcctgggaggacctgtgccagcagttcgttacgaacttccagggtacgtaccctcgcccgggagaggaagcggacctgcacactagggatggcaacggggcggggtggggccgggttgggctagaacgcccgcccccgacccccgacttcaccccccgcccctggccccgattgttgatgcggggtcaaattatcccccgtccctgacctctccggggcccctcaactcgaccggggccccgcattgggtagcatctttatccaatcaacaccaaaaatacaagacaatcatcaatttggcaaaaacaaatattgcacataattgacacaccattaaaaatagcatgaatcgtcgaccgtcgcgcccttgcctgtctcgccggccgccgcaacctcgccggccaccgagcccttgccgcaacctcgccggccgctgcgtccttgccgcgtgaccgggcgtccaggcctgtgcgccgccccgtgcgtcgtttgcattgtcggagggagaggtggaggggacgagctcgggagtcgggaaggagaggtcgaggggacaggacgggagcccggaggggagaggaggggaggggaggggagaggccgaccggcgacggcgagatctagaggtgcgcagtgccccctgcgccgcgccgccgcctccgctcacttgtgtgcgtgatgcggacgggaggggagaccggtagatggggataggggaggctggggagaggataagattagggtttagtaattttgtttatatatctcagtttttgttgggttgggctgttttgggccttctatgggctatgtctcccccgtcccctcctcgcccaaatgcgggtccccggccctgactcccccatgggtcaaaaatcacacccgcccccacccctgtaggacgacgagtccctctgctcgtgcatacaacgtttctgccaggtccgcaacactatcccgtgcatcccggcccacgtggtcgtctatgcattcaggggcggcgtgcggcacaaccacatgctcgggaagattgcctccaaggagcccaagaccaccgccgagctcttccagctggcagacaaggtggtttgaggaggcgtgggcctggaacatctctggctcaggcgcagcggcttcggctgcccccgagccctcttcccgctctaagccgcgggacaagagaaagaggaggaagtcggcccgctccgatgatgagggccatgtccttgccgtggatggtgcctccaggcccctgcgtaaggagaaggccaccggcagcaagccgggcgccaccacccccgacgaaagccgttcagcggacaagtggtgctcgatccacaacacttaccggcacagtcttgctgattgccgcacggtcaagaacttggccgagcgcttcaggaagactgatgaggagaggcggcagaatcgccgagagggcaaagcccccgtgacctccgctggcaaccggcaaggggaggccaagaaaaaggcccccacgatgatgatgacgatagcgaggacctggagttccaggctcctcagcaaaccgtcgccacgctcgacggaggggcgtacgctcacgcctcccaccgcagctttaaggccatgaagcgagaacttctcgctgtggcgccaacccacgaggcggcccgccgggcacgctggtcggaggtgaaactcaccttcgaccagagcgatcaccccacggtgctcgcccgtggggggaagttggcattggtggtttcccccaccgtgtacaacgtcaagctgaagctcgtcctgatcgacggtggggcggctctgaacaacatctctccggcggcctttgaggccataaaggccccggggatgaagcttcagccgtcacttccgattatcagcgtgatgccaggacacacgtggcccctgggccacatcgagctcttggtcaccttcatcgaccgtaccaacttccgcaccgagcggctagactttgatgtggcgaatctcaatttgccctacaacgcggtcctgggaaggcccgcgttggtgaagttcatggccgccacccactacgcctacctccagatgaagatgtcgggccccaacggccccatcaccatctgcggcgacgtgaagatcgccctggtctgtgcggagcagcgcgctgacaccctggcggcggcctctcggccagaggaggacggcagagccccggaggcctccacatcatgtgcctccaagaagcggatcacctcgagcgacgaggtgcctgtcaaggagataccccttggcggtgacccgtccaagaccgccaaggttggcagttttctagtctcatcacgaggcatagaagctaatcccgagaagatatgtgcaatagagaggatgcgccccccccaaagcaaacttagggatgtgcagtgcgtcaccggatgcatggctgccctaagtcgcttcatctcgaggctgggagagagggcgctacccctgttcaagctcctcaaccgctccaggccgttcgtttggatggaggaggctgagcaagctctcaaccagctgaaagcttacctcacctcccctccggtcctagtggccccggggccagaggaaccactgctgctctacttggccgcgaccccccaagcggtgagtgcccccctcgtagtggagtgcgacaaagaccatccgtgaaccacaagcgacgagcccgatcatgggaagggactaggggccccattaatcggtgatggcccctcgtctcccgacggcccgagcctcgatgctcctggcccctaggcatgccccgacgccaccatgggggagcaggaggccctggcgggtggccccgaggtcccttgcgcggatgcgggaggaagccccctggggccccaagaattgactgccctgagactggcgcccctgacagcaaagatagaccccgccgaaaggtgcagcggcccgctattttgtcagcgaggcgcttgaaagtgtcaattaggcctagagggagaggggtgaataggctaattaaaaaaaacaactaaaagcggaagcagtaattttcggatatttccgaaatttttggatatatccgaaaattttcggagtcagcacaaacagcaaagtaaatcctagatctggttgcctacaacaagaatatgctagcacaaacagcaactagacctatagcggctcaaacaagaaaagctagtggagagggaggaagtgaagtcaccaaagatgaagctcacgaggttgttcccgaagttcgaatccttgaggggattctactctctgttgaggagctcactaagagccgggtcttagctaaccctttcctcaagaggttgcactaagcactcctccttccactaagggtatctcttccctttcggagataagatccgaccttcacaaacttctcccggccaaccacaagtagatcggtggctcgggagcgacacctagccgcctaggagtcctcaacctccaagagtaacaaatgaagcaaataactcccggagatgatgcaagtgctcacaaatcttcacgaagtcaacaacaagcactcacacaaacttgaatccacaactctcacacacacaccaaatccaaatcgaacacgggtgagaggggaaacaagaaagcaaggctcaaaagtgctagagagagagagcaagccaagggcacaaatgattggaatggaaccagcagccctcacaagtaaggggagggggctatttatagccacagcccagattctgcccgttgtgcacaataattgagattttcggacatgtccgaaaattccaactcagcaccaacagctatgtcaacgaaggatttttcggacattccgaaaacttttcggacaagtccgaaaatttccagtaccaacaacatcgttctggatgttctcggaaaagtccgaaaataactttcggacaagtccgaaaattgactctactaaagattttcagaaaaatccgaaaatcagtttcggacaagtctgaaaatatacagaaccacttttgccttcgcagtctttttcggaaagtccgaaaatcactttcggatatatccgaaaatttccagaagcgaaaatctggttctgtgtgttttcggaaagtctgaaaatgagtttcggaaaactccgaaaaaatccagaacacaccaaactgaggagaaacactttttaaaaatagattttgagcactttgatcactcctcgtatgtcaatgcatcatccctcttaatagtgcggctttcctagaactcaaggaaacgaaaacgtacaaaataccgtttgctcatttgccgtatcacatcacatcaacgtattcggcgggatatgcattacgctaactcattgaggacataacaaccttcacatctgcttaaataaaaatgttagtaatctttaatcgcattgtaattaatcaccaaaatcattaggggcctagatgcactttcagcgctacgggacgcaaaaacccgataccctcaagctcagaaaatgctttatgcagttctgatggcctcgaggaagctacgccattactttcaggcgcatcgggtttccgtggtaacgtcctaccctctcggtcgggcagatcctgcacaaccgagagggtactggacggactgtgaagtgggccatcgaactagcggagttcgatctgcacttcaaaccacgacacatgataaaaagtcaagtcctagctgactttgtcgctgagtggacaccaatggacgatcccgacctacccctcgacccttccccctccgaaggcggggaggacccgaacaccgacatcggggtaatgcactttgatggttctttgaaccttcaaggtgccggagccggagtcacactaacctcgccaagcagggacgtccttaagtacgtcattcctctcgatttccgagcaacgaataatatggcggaatacgatggactcctcgcgggattaagggcggcagcaagaatgggcatccgcggcctcctcgtcctgggcgattctcagctagtggtgaaccaggtctacaaggagtaccagtgcaccgacctgcagatggacgcctacgtccgtgaagtgtgacgcatggagcgccatttcgacggactcgagctccgacatgttcccaggcgcgacaacgcagtcgctgatgagctatcgtgtctcgtgtcagcgcgagccccactccccccaggagcctttgaagaaaggctcacgcagccgtcggcgcgctcggattccccgagggtgcctgatgccgaaatccccacccgacgcctcgcgagccatagtcctcggggcccgagggggtcaaccccgaccccccacgtcaggtcgcctagatggccgacatctgggcatacctcgacaatcgcactcttcctaaggatcacgcggaagccaaaaagctcgtgcgcatctccaagcgctatgtgctagtataagggaccctctacaggtgcggtgccaacggagtcctcttgaagtgtatctctcgggagcaaggcatcgagctcatcgccgacgcccatgagggagaatgcagggcccactcggcctcgcgcattttggtcgataaagcttttcggcaaggcttttactggccaaccgctctccaggatgcccaggactgcgtcaggcgatgcaaggcttgccagttccatgccaagcaaactcatcagccggcccaggctctgcagctcatccctctctcttggcctttcgtggtctggggtttggatatcctagggcccttcaaggcggcccgtggcgggtaccaacatctgtacgtcgccatcgtcaaattcaccaagtggcccgaagcttacccgatcatcaagatcgacaagcattcgaccctcaagttcatcagaggcatcacatcccgatttggagtgccgaaccgtatcattacggacaatggcacccagttcaccagtgaactattggtgactactacgacaacatgggcatcaagttatgcttcgcctcacccgcccaccccaagagcaacaaccaagtcgagcgcgccaacgccgagatcctcaaaggcctcaagaccaaaacatacaacgtcctcaagaagcacggggactcttggctagaagaactgcctgtggtgctgtgggccaatcggaccaccccgagtagtgcaacaggagaaacccctttcttcctgatatacggcgccgaggcggtcctactgtcggagctctccctaggctcggctcgagttgcgctgtacaatgaggcagatcaggatgggctccgtcgtgatgacctcgactatctggaagagcgaagaaggcgcgcggccctccgggtggcgtgctaccagcagagtctgcagcgctatcatcagcgccacgtccgggcccagttactgcaagtccatgacctcgtcctccgccgcgtccagtcgcgcttaggattgagcaaactctcaccaatgtgggagggagcatacaaagtgatcggcgtcccccgaccaggctcagttcgattggccacggaagacggcacagaactacctaacccctggaatatcgagcaccttcgccaattctacccgtgatgtcatgtgtcatttcttttgggctcgggccaacttccacacacccctcgggctgtgcgggcttggccgggggctaccaagtgtcaattcttgtatttcgacatcctttctagcaataaatctttctatttatttaaagccatcacgtgttttctcgttcccttcctgagttttatttcggcttgggagtggttcgtgcttactctcatccctaggcggcgtcgggcaacctgaaaagcgccggaggtagcccaaacgtgggccgtgccccgggccgcggcgaaccccgggggctctgaagggcacactcgatcgtccccgacccccggtcgccgcgactccggcttggccagtcccgctaagcggctcccccgaggtgacggctctgcccctcgccatcagggtcccgagtgctaagcgcgagctcctttccccatccgaacaaacccagggggaaacggaaatagcattccacccgctaagaaaataattggcgaacctcccgatttttccattgcaggcattcacagattgaaagagtgcaagcaagacgaggaaataagatttatgtacatactgggggcggcacgaaagcctaaagtcatcaagtgttcatcacaaagacacagcaaaaaagaagaaagggggcagtcatcgggtgcccgggcctccaagtcctgcgccgctgacgacctcgtcccagtcctcgccaccgccatcgctgccgctgtcttcgcccgagggtagtgcgaggttgaaccgaggggccgtccccatgaagatcgacacaatcacatcggccgcctcttgaacctgctcccgggccaccgcctcagtccccggagggaagtcttcaagcatgcaccaggggaggaactagggatcgtgggcttggtagctcgctaggatgagctccaccgcggcccgcgccagggaagccgacgacgacttgaggaccgtgtcaacctccccctgcaacttctccaggtcgaccgccatctcgtctagccagtgtgcgagcgctggactagtagatggtaacttcttgtcccagcacatcgagatgcccacccgtcgtcccgcgcgctccagccgttcgatggcgtcgtggaggaggccgggccccacgtcgttggtgagacgaagggccctgatctccctggcttggtcctgcatcaggcgttccagagcggcgagtgcgtcctgagccgtggcgagccggtcagctagatcggtgtcactgcgctgctcgcgcgacgccagcgccttctccctaacctccagctcggacgcccgcgctgccatcgctgcgcgctcggcccgggcgccttccaggtggcgagcctcgcggccggctacggcctcctcacgctacgtgggatggtcgcccagccgccgtgccgccacctcgcaacgggtgatctcagcctcgcgctcggcaagtgcggcatcacgctcccgccaagcctcctcccggaggcgcagttcctccgcgcgtcgcgcaaccgcggcctcggcggtggtggtggtgcgggcatgctcggcggcggcctcctcgcggaggcggagggtggactgcgcccagtccagctcctcctgctcgcggtgggtgcggtcgaggacctcgacccaccaccggatcgcggcctcagactcctagatggagcgagcgcgcctctccaggtcagacgcgcgttcgtccaaggtcctgccttgggccgccagcgcctcctcccgagtccgcagggaggccttgacctccgacgccggccattcctgggccgcgaccgtgttgaggaccccgcgggcggcctcagcccgctgcaccaagtcctcggcgtgggcctcatactgcaggcggatgtcgcccagcgcctcgtccagaatgctggaggcgacgagggccgcctgccactccacctccgtctcgcgcatgatggagtccagcgtctcctcgcgcgcctggatctcagccagctgagcctggtgcatcttgcgccctggctcgaccagggcatccacggtgcagcgcccctcctccactcgtgaacggtctgccgcgacctgcgcccactcggcctccagggccacacgctcatctgccagggcctgaacttggacgttgagcccctctcggacagtggagtcggcggcggcgaggacctgtagaaatggctccatgctcacgggaatcggagtagagaagggcggggtccaccctcgtgatgacggagtctagctggtcctcccacgggattgcgggctgcgctcggagcccctcctgcgtgtccgaatccgagggcgccccaagtgtagaggggtgtgggtgctctcagcaccctccacctcgggaccacgagccgactcggtctcagccttgggctcgcgctcgggctcagcctcgacctcggcctctgggccgcgctcctcctcgacctcgatttcagggccacccccgaggtcgatctcgggggcgcgtctggcatccccctcagcctcgctcctggagccgccccgagggggacctcagggccaccgccaccgacccccgatagcgtcctctcctccctcaccgggacggtctcagccatggtggactcagagtcggacctagtgtgaggccctcgggccctgctggagggtcgtgtggtgtccgcggtcccggtttggccggcctccggccaccccgacctttcaggcttagatccccggggagactcactgtcgagccccctcgggaggggatttcgctgcaataaaatcccaggggcgcctgttaaaaaaaacatagagagaaaggcaaagctagagtgaagagagataacggaatcggaaggcggcagatgtacctgcgggcggggagggggggcgtttgaaggtctactccggggctcgatgaagctcccccggcacggctccgtctgccccatcttccggagcctcttattcttccgctccggctccgccgcggcgggacgcttgtggctggtcggtggccggtcgactgtgcgctcggcgccgccgccgtgtggatgggaaggcggctcgaacccagaaaccttccgcttccctttcgggttggcggccgggcctctaccagccccgtggctcgggccaggcgccctggagccaccaccgccggaaccgccagcccgaccgccgcccgcggccacattgctgctcccagcgtcgtcgccgccgccgccgcccccagcggcacccctgcgggaccgacctccggcggtgccaaccgccatcatcacggctaggatactctctcggtcgcggtcgctgcagaggggaaggatcccatccgggatcagcatcggctcgacggtgtccaggctcagcacccgacgaaccaccgcccgcgcgtcttccttgccccaatccaagcattggcccacatgggtgcgcatcgggtcattgtacccagtgtaggcccacgcgccgcgggaccattcttgaaggggcgcgatgcggtggcggaagtagtcgccgaacaccatcgtcgccgtcagtcctttgctccgtaggcccctaaggcggtctaacactgtgtcgtattcctctccaagctccgagaccgccagccagccagcggatcgctcaggtgggccggtggggagccggagacggaggtggtcatgcagcgcggtgtagaaccaatccctcttccagtcgtcccacttcttgcggaggtgggtctcgatgtactgccccatcacccccgcgcggggctgaaagtagcatcctcccaccaccgcggactattgcagctgtgggatgaagaagtactggaataaccgcatggacggcctcaccccgatgaacatctcgcataggtgcgcgaagatgaccaggatcatcatggcattgggggcgaggtgcagggcgtggatctcgtagaagtccaagacctcgtggaagaagccagagaatggcgggattagtcccgccatggcaaaggacaggaggtgcacggaccgcttgtaagttcaagtgccttaatttggttttggtgattaatgacaaatctagttatatgagactaacatttttgtgagcttttgtttgactagtctcatttggatatgaaagtaaaaatgattagaggaatgtattaaacttcacatattctaacttggtctctcttgtggatccaaaatatagtgtgagctccctcattgatcttgattgattatgtgcatatgtgttcctttatatccatatgtatgcacatcttgaggaggaggttattctatattttgtttattataagatttctatcttgatttgaaatcatctttcatctcatctctctatattgtttatatcggattattatctatcacaaaagagagaaaagattgaaagatcttggattaaacaatttgtgtaattgttgctttggtgatagatgatataccgatgtttatgggattaacccctcttttacataagttttaaacaaggttatttcccgataatgagatgtggtagatatgcattctttggtgatggaccttaatcatgacaaggatgaaattcatggagataaagcgatatgtatcacttcttatctcctacttttgataggttcatatatatgatttccatgttattgttatataagtgtgagactaatgtttacttgagtcttatcttatttagtctcctttacattgagaacatggagatcatgaaggtatgtgttttttggtttatttttatcattgctacatgccttctccatgtgtataggataaaccccattggttcttcataacttatgcatacacttgcctctcttgtatatttatttgtatgcatatatttagggggagcaaatcctatacatttattgtgcatgttttagatccacgttgttcacctattatttatattggatctttacatttgagcttgcatacgagtatatgacacttgcgatgttaatgaatactgaacaaacatatccatatctttcatatgcaaccggttggtcaccaagtggaggatgacaaccgatttgttggtactaatgttcttctttgagatgtgcaaaggaataggtctaattgtgatgaggctaatggatgacaccttgggttgatggtcaccaagccaagggcatcgccgtgtcgacaagaatgaaatcaagcttgtgatgagaagaaagtcctgacaaatgatggtaaataccttggtataaacatggttgaatcaaatggtcacaagtgttgatctcgactcaagcttgaccccaagatggatggcgcaaggcaaaggtataatgtagctaagaatgttttcttagtcttttcccggtcttggtgtttggtgtagaccggatttgctagataggcggcgtactatcaagaggggtctatgaagcgagcttgcggatgatcttgtgccatattagctcatatgcatgtaggtgcatttggtgggcttgtctagccaagtgtgatgagttttctcaagtcctaaaccaagaaagaagtgggcatgtccaataggagtgagtgacatcttatgggtatgtccggtggatatcctttggagtgtgagccctttatccttgacttaagttgtgtttcttggatggttttttcatgggttggatggtcctttgaataagctttccatagagtccaagaacgccaaattccgagacccgagtcaagagatatcgccgttttactaacggtcggttgagctgaaaagtgacctgcggtctgaccgtgggccttaggccggtctgaccggacctgttagccggtctgaccggcgtggtaaggccggtctgaccgaccccactggtctgttgcactggtctggtttttggtggcgatacagagccgtggacggtctgaccggctactacactacggtcagaccggccaggttgagtgggctcaatgattgccctgtaacggctagttttctagctgttacaaagtagtccggtctgaccggccactctatggcggtctgaccggcggagcacagagttggggattttgactccaacggttagttttggttgttaggggtatatatacccactccccaacagcaagggcaaggttttggcactccattgcattatcttgaacccttgcaagagctctcacacccttgtgcacttagtttatctagtgaggtgttagagagtgagttgagccaatccaagtgcattgcttcattgttatagctagtgtggcacttgatcatcctcggcaagcatcctagacttgttactcttggaggttgccgcctcctagacggcttgtggtggtgttgcccggtgacctctccgaggagattgtggaggaggcccggcaccgtttgtgagtggtttggagttcaccaccttcggagtgaaggaagaactaccccgagtgatcgaggcttgggtagtcctctccgtgggccggctcccgccttgcccaccccttgacgaaggcgacgtgcggtggcttcgtggttgagcggtgaagttgggctcgcctcaatggggattaggaaaccggcgagtttccaaacctcggtgaaaaattccttgtctcttgtcttatttatttgttgcatttacatttgtgctatttacattcatagagacatatttgagcctatatcacttaggtttgcaaaacttaacttagttgcttagttaaccttgcacctcaccttacctagcaacttaggttagttttgtttaagtgccattaagttttaaaaccgcctattcacccccctctagtcggcctccttgatcctacaccgctccgggtaccgcagccgcggccacggctcctccgccctcacgacggcgtcctctggcatgaatttgcggacaaagctcatgtgcttccccgacatgatgcacgaggccggaagaatggcgttgccggcgtcttgtgccatggtgaccgaagagagtgaacaggggttggatgagagatgtggtggttgaggagagagatgtggtggttgaggagagagatgctgggggctgaggtgcaggaatgcgagagtgagaatggcgaaaggaagaagaaggggtctcctcctctcccccttttatactcgcctcgtctgggcctgcctcctcagttctctcagtcgctgctgccgcccccttgattctcgcgcccgctcgtcccactcgccccgctcgtcccactacgtccatgtcccgcattcaatgcggctgacagcggcgtaaccgacgtgaggcgcgcgatgatttcggatgtggctaggcgggcccaccgataatctcgtttcgcgcacctgacggacgcgcgaccgatgcgacgcgaagcgataattccggatgtggccaggcgggccctccattttcccagattgcacgcccccatgcgtggcgcgatcacccatgggcgacctgtcatcatggtgagcacttaaagctgcccacatcggtgaaggctgctcagattccccgcggggcccaccatcacaagacggaggttattaggcaccgcaccagaccgtcccaggtggggtgcggtcggacgtagtaccgggggctgctgtcggtgatatgggcccgggggtacccacgttagggggaaggagcggaggagcccttccccctagccacgtgtaagcagccgagaggcgccctgcgtccacctaggggcctcggggtaccccgtcgcacccctcgggcccaaggggttgtgccaccccgaggcccccgctcagctgccactcggcggctaagtgggtggaggagggggcgccgctggcgcatttatgaacggcgtcccaaccacccacgcaacgcacgtcaatcacttggaccggtctgtgaccggtagcagatagatgggacgggtggcagcgcacccacgccccgccctgtgtcaggcggcgtaggggcaggtatgccccatcccatcagccattagggctcagcacgcacgaccggtgcattcctggtagcatgagcccacaaaagtcttcaaggcttaatgagggaatgacaggggatgtcccccgtgtcagatgggagacggcgctgggacccaccacggagtaagcagccatattgcttccggtctaaggcataagcgggagcagaacctgaggaagagggaccccctccaagaaagataagacgaatagaggcggtgcatgtggtatcctcttgaactataaaaggaggaccttacccgccgagcaaggggacgacttttgatagcttgaactctaggggaagcacagttaggttttcccaggagcccaaaatctcttgtaagaacttaagcatagttccacacataggagtagggtattacgcttccgagcagcccgaacctgtataatctttggtctcactcctgatcactctcgacctcttgatcgctcgtgccctatcccctggccgaactcacaaagggggatctcacgtcctcccgctagatagctagggttactcctcgacaatagtcctttagtatgtgtcatgaaatataagtatacatgaaatgataaccgtgcaaataagttgagctctatctataatatctataaaatagttttattgggaatataattaatttgatatcacatatactgtaccgagtatcaaatattgtagggttccataaaaaccaatttaaaaaggatatgttaaatttaacttgaggattgaaattagatagaattaccctagtcacgtaaaggatgttccatcggaatatttaaaacatatcgtcaagtctctcaggacataaaattcaactcggcaaaataatttgccacacaaataaacggaggcaatgctttattgcctctataatggtcctagttgaatatttaaatcaatataaaaaagttatagcaagtccctgatttcattgggatcaaatctaaattaaattaaggcaaatcatttgtgggaagaaatcaataattcaaattcaagtgaaatatttgaattcctaataaaattttcaaatccaaaatgttttcaatccaaattcctagtctcaactatcaatttgcagtcaagtccctcccttttcgctctattattttccttctattcatctctcagccagcactgttcatggtccaccaaggcaccaacccgttcgatctgggtctacccaagaacgaactctctccccagagcaacccagccgcgccgatactgtacatctcctagcgtagcgtcacctccagaaaacccggcgatacgcacttgcccgcgcgagcgtcctgctcccgtcgcgccagggtcggcgccgcgaccgtccctaaccctagccgcgccgcacccatgtcggacccgcgtcgcactgcaccatgccgctcccgtgtgccgcgtcgcgtccactccgccgcgatcccgctcccctgattctctccggagaatcggcaccacgccgtcccgtcgcgccgcgcgcgttacctcgatcgcctcgtcacatcaccacagtcgcgtcgccatcacccatagcacatcgtacggccgccacgtcgcgccatcgtcaccatgctacgccgcgtttgctggttagaaccgcgcatccctaacccaagaaccctaaccacgccctacgccgcgacgtcgcccgtcaccctcaccatgaccccggcgccgtatgagaataccatcgctccgcgccgcctccgtcggataatgacgcgctctccgcaccagtctaacttctagcccagcatctagctcgactgcccatgtcctagccagtaacttttctatattttttttaaaagatcacattgtttattatttcgagaatattttcttcccactgtgcttgtctcaaacacaacctaatactccctccgtatgcagcaatgatttttcgtgtccaattttaattgtctgttttatttttaaaaaaaataaaaaataaaaatataagtagtcatgcataaagtactatttatattttatcatcccataacaatacaaatactaattataaaaaattttaaataagacaaataattaaagttggacacgaaaactcatgaatacacttaacgtgggacagagggagtattctgcatcgtctcactcggacagagatggcggagaagaaccatcaacttactatcacagtattggatttggaccggtctaaagaagcgtatttgtttaatttctgtcttgatttcaagatgccatcgcgagatgatatatccggaagaggtgctatgagctcttcgaccaaaaattaaaccgaaactactgtttcacgtggcgctgaaaatctaaagcgagcagctgttgtttcgacagaaaaacttaatttcgaagggtacttttgtattgccggtaccaggtttaagagtgagtaagctactacaaattattccccgtcagtataatcggtataaaattatagcgggagctaaaccaaaatgaccaagagcaactaagataaatttagggttgggttacgattttttaggccttcttagcctgttgggccttctaacaacctcaaacaaagtctacattagcccctcatctataaatatatggacccccgcccccacactgtctcagcccttgtgtggaagggaggagaaagaagagagacagagcagatatgtcgcgagtgaaagcgcaagatagaagggattaggtttggaactatagctatagtactctatacctagtacaaatagcaagtctaaaattagggtgcattctttttacggaattgctaaccttcagtcgacatgaaacccatctccaaatcttgcagattttgggccaccggatgagcttcgtgattcgtgccccaggccttctcctctaactccggcgacctcctcatcttctctggcgctgatgacaccctagactccgacagagaactctacggattagggtcccgggttggggtggtgatgggaggaggagagggaagaggggggagttcgccggctttagagggatggccgtaggaggtggcaacccggcggtgggcggtggcagcattatcaaagccgcggggtcgaaagctggcagtgcgccgatgtagatgccaggggcaaagcagaagggcgtgttaggaggaggcggccggtgttgtagccccgttgccggagacggggaagacggtggcgcgccgccgttggcttaaggaaagaagaggaggagagggaggggaaggagaaggggaggaggctggctgggagggggggcggcctcaccggcaccgttggcacctttgggccagccggcgtagtgggcggcagcgcgatggcggtgggggatcgggcggggcgagatggaacccgcgaggggagtggtagtggcggaatgcacgagcttgagaggaaagggaggagagagttagggttgaggttttgcacaaatcttaaaaagcatatctaacggtccaaaatttgaaagatggaaggtgggattttctatcaacatatatgtagacagtcacttctttttaaattatgggtttaggtgattagctgcacacaaaagtatgaaacaagaaacgtgattagcttatagttaattaagcattaattattaaaaatttaaaaaatgaactcattttttaaatcatcctctatatatatgaagttttttacggaacacaccatttatcaatttgaaaaacatgctaaaaaaaacgagaagtagctataagcttaattagctatttaaaacgcatcctagattctcaacgcagcttacaagccaagaagcagcaaatgaattgttggaagaaaagaaaactgatggtgttcaggaggcacgacgacttccacaaaccatgaaatagtttccacatatatagttaacatttaaactctctagtctctagacagagaacatactacgaaatgtgaagagtgcaattggagcttgttaattcgaccacgattaacacgagttgccatctgaagcttgcaagagcacaagcttgtccgttggcggccaaaatgtcctgggttgctgatgaaggacgaacttagctagcaacaaaatagaggctcaacataaggctgaactcaacctctgcgctccattttgtctttcttcatggcctcctcggcatccctgcaaggagaaaaaaaaaagcattgtactacagaaacagaaaaatctctacatgggtcccccttcccacttatagcacgaagcacaggaatcattcaaatggcatgcaagaaattttcccgaaacggtaactaggcacgcatgcacaaaggcaccagggagatcacaagatgctcctttcctgagaagcaaaaaaggcttgcatactaacccgattccacatttataatatacattcttttctactgaatctataatatagtg

SEQ ID NO: 55546 - DNA, 1246 bp, Oryza sativa
tttagcaatacataaaatggaatgtattgtttgtctatattactcacctcaactgtaggtctgtagctattatcatgtcttgttaattaggtaatccagcaatgctagaggtagggatgaaaacggagcggatagtttccgcccgcttcggagaaaaacgaatacggatacctttcgtatcagataattcttagatagttcagatacggatacggatattttctccgtcggatacggataataattcggatatccacataagttatgagacatacccccatttttttataactctatgaccttcaatagacatttttagattttaattgtagttcatctcttatcactagtccacactattaatactatttaaatttttaaaaatatttataaatcatactacattttatataaaatgagctaattatatatgttgatatttgtttctattagaagttgagttggttttcgtgttatgagaaaaatttgtttccgtattcgtgtccgatcatattcgattattactcgtattagagataatctatatttgtttccatattcgagctgtctgtatttgtttccgtgtccggcaaaaaatatgaaaacgaacatggtatgagcattatccgctccgttttcattcctagttagaggtagtatactggtagtattgaaacaacttttttaagggtgaacagagagctacaatgttgacatgaattgtctccaaaaaaacaacacatttaggcactaaagatgtgttgcaatgtcttacgttagtgtagtgttgtactgcaagcgcataatcatttctctcgaaagcctctctagcttgtaatttcagttcagcacttttccttttagacagatcattatcctgagaacaaaggattatcagtaagaacatgcatgtataactaataccaatatgaagctgcatctatgaaacgattggttaacaaatatcacagtcaatgattcacatatcttgcataacctgtaaaatatccagtttgatattccagtactactgctttgaaatcagttactcaactacgaactagtaaatatctgtgcacagcgcataacaaaataacacatggaaagaactctctagctttctataaaagctgggccactcaggccttttatccaaaaaaaacacatgaaaataaatgttccatattactctaaaattgctttaactgttcacattcagtgcaacacaaataaggggatccactag

SEQ ID NO: 55547 - DNA, 9172 bp, Oryza sativa
atcagttagaaaaatagaagccacaccgaatttaccaagataattttgttagtctttttcaggaatttatgcaccgaaatactcggggtgtttcaatctggtagtctttcttttttaggacaaattactgtatagaaccacatgcaccacacaaggcacacatcaattcatatcaacagacccctactacgagaaccataagccttgggaatttaaatgggatccttgaggcattttggccagggatgcagcaaactcaagttgcttctcctcaggccttgaacctcacctcttcataacctcaatgtcctgaggcacggggatgcgaaacatgagggattggggctggtctggtggagtggaatactggacgcctagtctaataaccttggtttggtgggatggaggaacagactggagactactgaggacccagtgagtgccgataagattttcagttgattcccgtcagtatttggattttgctaagaaatgtccaatctcgcattaatagctcatggcaactgaaaaatgaaggaaatagtataactcacttggtccggaatattaggattagcaccagcatctaataggcatttcatgatgccagaaaaaccataatttgctgccatcataacataagtagcaccattggagtctctaaagttcacatcagccccagcctgtataaatgaattattatttgatcagttcagtttgtgtttcagatgctatccagagaaaatgtccatggaatgaaaatggagcttccaaatacaactataagaatatccgtatcaagaaaggggcactgacttggatgagcagtttgacgcattccaatgatttagaagatatagccatattcaatggggtatcatcaagattgaaaaccttatcaggctgttggaagtaaaatgatggaaataaggatcaatagagaactatcaatcatatgcatgcttgcaaagaaattagacagcatttacataaattctgagcaaataggcatctttatttcattcaaaccagttataatcaagtgttgatatagatggaccacatgtaccaaaggcaaaaacatataagttttctgttatacacctaagaaaggaacaaataaaatgaagaaaatattacatctgcatgatggtccaataatatcttcatggtgctacattgaccatgagcagcagccgtatgcaacggggtcccatagagagaatcaaaaacaataccaattcctcttgacagcagcaattctactatttcacagtgtcctggaagagaacatttgttaaataaaaaaaaaactaaattgcaacaaaatgtttatagtatctgcagaagcatatgatgcagacctaagaaatgtcacatttgattcaaatcaattcccctgtattcaaggaaaatattcaaaatagactcaggatcagggttcagtttaccaaccataaaccacttggtaaccagtaaatagggattacatttttaaaatggctggttggttatttgagttctttgtaattgttataggcatgagagacatccgtcatgttaggagcacatatgtctatacaacactaggaaaaaatatatccccactgcctgaaaaaaggggttggtgtttggtgctcgacagtcccctaccctttaccataaaagatgttttctggattgtataatgtgtgagttgatttttaaatcattggcaaaggattgagttattggcacatcagtatgtgccattggagatctgcataacttcattaagttatgacaccagattgtaacataactttattgtacttatttcacttccccatctcttttaagttgtaatctcgtccggtcttgggcttttgtctccgtagtgctacctctttagaagtacatataaactaagttgggtcatctcgaccttccattgagttctcaggacaaaaaaagaaagatagcattctccagtttcatttggctgctgctcaactaattatgtctttaacgctagaattgacagcctgcagcatttattatgttcaaatacttgctcaaattttgactgaaacggtgcaaattctggagccttgctgaggattttcagtttcgaaatgttttttgccgagcacgcgcaagcgcaccgggggggggggggggtgtcggtctgaaattcacgaaattattagaaaatttcctagtgttgacaaatttttgtgatttactagaataagtaccgaatttttttggccggaattattagaaaatttgacaaaatttgaatgaatttgaataaattgaccaaattcacaaaaaaattgcaaaatgccgaaaatttcaggcaagatatgtgcttgcggctggggggggacgaaatttcagaaataaattgcaatccctggccctgctcaggaaaactaatagagtagataatagaacaaattaaccgatggttaatctaaagtgacaaagtatttacacatatatatcaaacatatttttcaaaacatgcgtagtgtgagagagatacctttcccggcagccgcatgaagaggtgatcctgatttaccaacaatcattggatcagcaccatgatcaagcagatatcttgtagatgcagttctcccaaaaaacgcagaaaggaatagtggagtttcacctgataagaaaaggtagtgaatattaagagcttagggaactcatatggtcatataccattcttgccttcaacaatgcaaactacaaaggctcctgctccacaaggtaaaatatatctgcagttattgctgttaaaacaacaaaaatgtggatttatcttcagtgatcctaatgtaataccactgatttgaaaagaactaaagtgtccaactagtaatgcagaaattttgtgcaataaaatacgggaaaaaaaacatttatatgccaatgacattggccataattaatgatattgcaccccgtttggcacccatgaatttgctctagaatcatggaattggaattcaattcctatgacatgggagtttcgaggacagcaagaatcagattggaaattccagttcaattcttagtcagaatataataatagaaaccatcgccgctgcccaagagtcagttcctttggtaattgtttggtgggacctttctttcttgataaaatcattctgctaaattaaatatcgtctcgtctttaatagtataaaagcacagtggattggtgtgtgatctcatattaaaatatggatttgatgcacatagaaaatgaacatgacccctttttgaaaaagcacaacccgatagaatgcattggtattattgtttggaatcaaattcaaattccattaggatatatataaatttgggtccagctctagatataaacacaatgggggaggcactggtatagttgatatagtaataatcatttgatattccgcagcaattcaagctagaacctgaagtataaatttaaaatgcatacattgcattgcacagcatcaaaagttgcacaagcgtgcaaataacaccacaagctcatatagtacgtaaccagcatgaaaccaactgtcgcaggtgaggaatattaaactatatggacacgcatatcgatctcttccgtttccccgggtaggagcatccaggataagtgaacgattcgtacattagagcgaatggaaggggatcagagatcagaacctctgtcgttggtttggttgacgtcgaggcggaggtcctcgacgaggtacgtgaggacgtccatcctcccctcggtggccgccaggtgcagcgcgcggctcccgctgccgccgtccgccacggccgccaggacgtccgcctcgccgcggccgcgccccgtcgtgaccagcccgcgcgccatctctacgcccagcgataagaagggggaagaaaataggaattaatgggggaaaccctaggagggagagagagggttgggtgggtactgactcctgaggaggcgaaggttgccgtcgaaggcggcctggaggagcatcttctcccaccgctgcttccccatccccttctcctccatggcgatcgatcgagcgggcggcgcggagaaggcgaaacgtccagactccagactccataccgaagtgaagtagtagtagcagcctgcagcctgcaagtagagaagacgagcggcctgagcgggggcgatcgcgttgattctgttgcgacggagatgacgccgctgaccccgggcccatccttccacgtcatacggtgctttcttttccttccttcgcccaaaatactagagcaagtttaagtttaatagtatagccaactactagctccagttcatctatagccaatctagtagctcattcatacaatagttacatactacactattaatatctggtcccacctatcatacacacagtgtcttaaagtccgtgctacagcttgctacaaatctatagcccgttgctcttctctcacctcatttatctccttaaaatatatttgcagctggcttatagcctgctattgtacctgctcttagctgtaagcacatgtgaaatagagaagagaagagagagaaggaaaactgcagcacggactccaatatattgtgtgtatgagagatgagaccaaatattaatggtgtaatatatgtttataggtaactcgttatggttacggagaaggtatatcttctatcctatgacttatagaatatacgaatatgatatacctttgcgtacacaggttgcttccatatacgctaaggtaattcaacaaatattatggaaagtatccttacgagtcgggagactaacaaagtcccactcggaggaggtaaggtgtcttctatatcgtacggggtccgatattttcaagttctacatggaaatgattcacggtgtaaaagggacacctcgggaggggtttcgggtatcgaatttcaccaccaacacatcgaccatagcctacaaagccggagcacgtgaagcctagtcaccagaaaatctcgtcgaatccatcgactacgatctcgtcggtacagccgaatttgcctactcctattgtattatgtggttttccatattaatcccatataaactggactagctattagctgataaggggcttgaaccaatataatccttgtattttttcttgcttgatgtcgtatcgtgtagatcctcgtaccaacgtaccctagtactctactcatctggtctacgggtatcacccattgacataactattgtatgaataagctattagattggctatagataaattggagccaatagttggctatactattaaactcgctcttagctgtccaaaattattactccatgctataaagtgtttaatcacatattaaatagcaatattttgggatgaatgcagtaggaagaaatagaatatatagccacggtaagttttgttctatacttgaacttttaaattattcaaacaagaccttaaacatgatatcatgtttgtacatatgtagtccttccatgtatcatagggaaaaaaacaagaggaaaaaagaaattaaaaaaaaccaagtgattttgcatattaaatatttttcaactatgtacatggcatttatttagcatattagttacatatttagtgttggtagctaatttaacttcgtatcggcatattttgctttttcgaatcatcgttgcacctatatttctatatctatacttctatactaatataaaaaggaggagttgtcccccctccaatcctacaggtgaaatcatccggattaatctgcaccgtccatccgcgccgaatacttcgctcctcctcctccagccacgaagacatcgctccacacgcgaagacttcgcttctcctcctcgctcgctcctcctcctccccgcatgttctgccgccgtgccgccgcatcctcgctagagatcctccccgcgtggactgccgccgctagagctgctgattcttccctgccgccggagccggtgcttcttccccgcgtggactgccgtcgcatccccgccgccggagccgctgcttcttccccgccgcagccagttccgacctcggccccatccgccacggccggagctgactttccgccgccaccggcgccgacgtcctcctcatctgctgctgtgccaatcccttcgccgatcccctccatccccatcatctcttgccgctcacctccttctactctaccacacaacccggtgctctctctattgtcgcttgttcctctctccccttggttaacactgaggagtactaactaattttgttttggatgttatagattttataccagaagtccaaaacaacatccatcggtatggagacgagttgtttcagggtgttgaattgcttgccaatcccccttcaattttctgtatgaaatatactcagatcttgtgtcggttcctcatgtcgattcctgtgtgattttctgttgcggagtatagcttcatcaagccaaatttaatgttttctaatttctcctgttttattattcttacgtgatattacttgtagcagctaaaatcaagatgatgtgacttgggtaggttttcagttgtgtttgtatgcaactaaaagttgccaggctacactactaggtaagctggcgtgatttatgtttttttttgcagtgtcatccttttgagaagtgcttctatgctccttgaaaaaaaacctgcacggaaattaaagcacatcaatggttcggattaaaaggtgattactagggtaaaccgtcattagcaaggggcaatttcgaccaggaagtgaaagcccacatgcagcccaggccgatcgatccatcgatctgggaggtcgacacggcaacagggctagatggtgaagatcaccagatcggccgggcatgtgcgaggaatgggagggcgacgagctgtgagggctattgtcgacttgttgtcgttgcgctcggcgttgagacagattatacagtatgacgagatataggaccagttctcgaagggcagtgtggtgtggaagcggcagaccagatggagaatggccgcatcctctacggcggcggccatccatgatgactcaaactcctgcatggtagaatacccgcttcttgtacctagtgaaacctagatagaaatcccaacgattctcctgttttttgattcagtgattttcgtcctttacaaaagctaatccttttggccgcttgacatagatgatgcagatattatctgaatatcattccaggtgcgtcgcgagggaattgccgttgcgaatcgatcgatgagagatggctgggtatggggtgggtatggatatgaacttttgcgtccgggacgaaattgcccctcgctgatgaggtttaccctgttaatcgctttttaatccagaccattgatgtgctttaatttttgtgcaggttttttttattgaggagcatagaaacacttctcttgtatgaatcatatcttaatttggtaacattaaaattctttctgagttatctcctaatttcataccattaaaaacaatgacttttcaagaatcaagttcactgccatgatacaccgaatatagccatgtgagggagctcttgccatcatattttcatgtgccatttgatgaccgtaaatttggttttccaagatgtgcagcaggtaacactgtcgatgcggctgcctttggtggtgttctctgttcaacctgaactacaggagtaatcggtctgctaacacagacctggtctcaaggtgccatgcaactcgctgattccacaagcttatgactgagtagcaggtaaacattttgtccatccattatctgcaaatccacctgtgcaactctttgcttcccaaatttgattgcatgtgttgcatatttttactgatgcagaatcgaatggttttaatgttgtatgtgcagacactgtggcaacaaatctatcccaagtttcctgcggttttatttcatttgcactctgatttaaatgaattacatatgcagatgtcaatctgatttacctttgtacatgattcaagattcaactacagcaattgaaaatgttcttccctatagatcagaaagaatgaatttttaatggtgaggtataacaaagattctagattatgcataattttcttaccacaaaactgaaatgatgtttgatataattcataaattattctaaaaatttgttttgtagatcggtaaaattcactcggaatcctgagtggtagaatgacatcattggtcttatctgaagcaaagtattcaattccctcttaatttgctataggaagccgtttgatactttgtttatgttggtctattggctcatttggaagggaacgtactgcaagaatctttgatcagaagagaagcacagcagcccaactatttgctgacatcaaggatggaatctccatttggaaggaagctggtatgttttaaaacatcagtgagttgtaccgtgttttagtttggagcaagtttgttccatggccctgttaggcttcgacaacacgttctgttgatataatttatacggaattgctaagcatctatcgacagaaaatgcatacccaaatcttgcaaattttaaatcaccggatgtgcttcgcgattcgtgctccatgtgcttcttctccaactccggtaacctcctcttcttctccggcgccggcgaattagggtcccggggtggggtggggtggaggtgggaggggaagaagggggaggtggccgggctcagagggatggccatgagaggtggcagcccggtagtgagcggcggattttaaatttaaaaataaaccatctcgatacttatttctaaacctgaaccttcttgcccactccgcctcgcctcgcttggctaaacaatagtcacaccatccgcacttgctcatggaaaaaatattcatattcaaaaataagttttgggaaggtttatttttaaaactaaaaatgaaaaggttcaaaaaaattaaaaaatatatatctgtgattggtcatatattacatttttatctgttggacttcatatttctaacgagcacggagcctttcagtatgattagatcaattccctgttatactaccttggagttgtatgcttgtgtcatgctcaaacagctcgactattcagcccatccaattttcaaatgatcttaacgac

SEQ ID NO: 55548 - DNA, 21295 bp, Oryza sativa
cttgccgctcaagtcttgtacccgacaatcatgcaggaggaagaggaataaattgatttttatggttagtttcacatgaggccaacgttttctattttagggagtcaatttttggcaacctcttggagggatatttttttttttcacgcatcaaattatgtttagaatttgaaaaaaaccaaaattttagggatgagatttagccaatctcttggtgttgctcttaggtccattttgaaatagaggactggcaaaggaaggattcaattgcgaaagggcctatagtttactagttacaagagcctcagtaccatcataggtcctgggttcgactggtgacgtcgtgtcacgcctagaaattcacgaaccagaatttctaagctgaatgtgcattaaatccctgtccaggaccagccagggtacacaaacggcaattgttgacatacagatccacgtcttacaaaaatataaaagattacaaatgcagcggaaaagacaaaagcgagctaagcctgaagacttgactcctgcaatgaggtgactctattccacaggcatccttgacggcagtgacaaaaccaacttcttcgagacatctccaactgagaagaacttcaactctggggtgggggaaaagagagcaagactgagtactacccactgtactcagcaagtcataccggaagagaatgtatgatgcagggtataaccaaaggaggctagaggttcatttgcataaagctagcatttaaaagcagtagttgaaagcagtaaaacagttgtagcaattaatcaatattaaccaatcactgtccaatgctacaccaggttgcaacaggcccaaccaaccacctgaactataccagttcattaagctaaactaggggtgagactaatcacgatgaatctggtcgatcgcccataaccgcgggcacgactattcgaatagttttactctgatcagaggtgtacaactgtacccacaagacacagccccacgacacgttaccgtgcgccgacatgccaccacgacataccggaaagaggccgtgacaggatccttcgcataaccccctctaaccgatcgcaccacaccttagggttcgcccccgtcatcagcaggcaacgggcagcccccctttcatgccgcggtgaatccagaagccgatcaaccggacacctcggccgacccaactccatcacgcccaccctcgcctgggtacgtcggctagaggaaagctacactacactacaagcccagccgttgcccacgctggcttgtggtaagtacgataagttcttctagggcatcccgcgaaccgatccttaattgccatgggcacgactagcagaaccatgcacccacagcccaccatgtagtgtattttaattaactaacaccattgcagtggcactaatccaaagctatgccaataatcaaagtctatgcattaatgtgattccccttttgtgtactagttgaactaagcatggctaagcatttcctaagccaacatctaatcatttggatacccaagttatcaataacataaggtaaacaatatatggctgagtagttgggcccatcccacatgatattgtaaaacgatgcaacatttaatagaaatacaggacatttgtaaattgggtataatatgatcaatcgtaatgcatgacttgccttgctctcacactgatgagaccacagcaacgtcttcgagaaaccgcggatcgacgaagcggccgaaatctacgcgacaaacaaagcacacaaggaaaacatgctataagactactgaaacaggaaacaaaaccatttttaatggattctatgcatttttataaatttactgagacttgaatggacttaaacggagcttggatggattagatatgaattttagaagattatctgtgtttttactaataaagaaaagaccttaatagatttattgcgcaataaataaccccggatgacatcagcaaggggggcggcgccgacaagcgggccccgcatgtcagcggcacaagaggaggaggaggtggcctagcgggtgggtcccagcagacggtggctcaaaggggaggaggaaggcggcctggctcggctcggcttcaaggcggccggccggttatggtgagggcggctgcgcgagcgcgtcgtctgcgacgacaatcggcggcgagaggcggcggcgggcggtgcgaaaggcagcggcgaccggcgcgaagggcggcgacgcacggcgcagcccggcgctaggagggagaggaagggagaaaaagagggggagggaggcctcaccggggattcggccggcgtgggtgaagacgacggcggacggcggcggcaagcggcggatggcggggtgcgcggggtggacgaggcggctctcgacgtcgcgaggccgacgacgatgacggagtggctcgacgatggccctagcggcggctagcgacggatggaggcaacaatgggcggcggcgcgtggcttggcgtggggagagcggtgcgacggcggtaggggcaaccgagcggcggccgggatagctcccatgacggcgaagctagcagcggcgacggcgtggcgcagcggcggcggcgcatggccggaggcgtaggcaagcggcggtgctagtggcgagcggcgcgatggaggtaggaggcacgagagagcacggcgagtggggaaaaagagagagggggctcgggggaatgttttataggcgaagggggaggcggacgaggccgagaaggtggccgatttggccggcaacgtgggaggtggagagagagaggggggaggattcgaaatgaatcccatctccaagcgggtgtgtgcgcgtgcgggagtggtgggagagtgggcgggcgatagggacgcggagcacaggcggagtggggcacgggaggagcaggggaagcggcggcgtgggcggcggtttgcatagggcacggcggctggaggttaggggtgaacccgacaggtgggccccacctgtcggcgcccagggggagagggggaggaaggtagcacttcgggggaggggagaagtattgggccggcccggtaaggagggaggcacgggaggcgagttgggctggcggcccaaaagagaaaaagaaggaaaagaaaaaggaggaaaaagaaaaaggattttcctgggattatttattgtggtttaaagtttttaattggttaaaattatttattgagctctgaaaattccactaaaaatcctgttagcatattttgacatgtagaatccaagaaaaattccacatgccgattccaattattatttacatttattaatttagggattcatctctaggttaaattaaatcatttctttggacgatttattttatgaatttaaagcaaggtaggggaacttcagggcgtgacacgtcgtcaatctccagattgatttgctggcccaatcttcgaagctgctcataagggtagggtttgcgtgcgtgcgttcataggggtgagtgtgtgtgcgcgttgtgagtgtatgcgttgtaccgtgtaatttaaaaaaagaagaaggaaggattcaatttcctataggtccttttcaattcacagggggaagatctgttttttttataggattgtattcctatggtcaaacctcttggacagatatatagaaaaataagcacggcgttacgccttagttatattgtttatatagtgtaattaaatggcttctctttccatatctattttcacacatctagtactacgttaatttctatgttttttttctagagtgagtacgcaagtgcttcttaaactttgtgcagttgtatcatctgtgtcattaaactcttaaaatatatttttagatcccaaacttttttttggttgtcctacagctccaaacagactctaacccgattcatacattgacaaggcatgccaccgtggtgcatatgtgtagtgggacccacgtatcagtcatagggaaaaaataaaattaaaaacatattatctccttttttttaattttatcttttttatatgactgatatgtcattcccacttgcaggtcggccccaattgtgacattgtcacgtcagcatttagagtggattggtttccgtttggacctatataataatcaacataaatttggggatccgtaaatacatttcaagggtatagagaggtagatgacataaccacgtaagtttagtaaccgccagtggactttactttttttttctattcatatgtttttcttatatgcattttaaagcgccttaggctgagttcgttaggaacaaatctactggtgcacgggaaacggagtggtctattagcgcgtgattaattaagtattagctattttttaaaaaaaatggatcaatatgatttttaaagcaactttcgtatagaaactttttgcaacaaaatattccttttaatagtttaaaaagcatgcgcgcggaataaaagagagatgagttggaaaaacagagtgctgaacacagccttaaaatcgtgagaaactgcgcgtgtaaactgccaatattaaaaaatataatatatatcttatttaaaaaaactgtttgagtttagattattgtgcaaattggtgtgttttgcaagagcaagttcccaacactcccctctcgtttttcacgtgcacgcttttcaaactgctaaactgtgtatttttttttaaaaaaatagctaatacttaattgatcatacgttaataaaccgctccgttttccatgtatgggatggttcccaacaccaacctccaacttaaccatcgttaaaaagggagaaattgagtgttaaccttggttaaccatcatctatccagtatccacgacctaactatcgctgccttccccaccaactccgcagtctctacaaaactcactccgcatcgttcgtcttcttctcttccgcccctacgtcacctccagtcaagggctaatgcctagggcctaggcttctactagtagcgagtagcacactgcctgccgctaccgctctctcgccttctccacccccgagcgagcccgatcgatcctctctctctccatggaggaggagaaggggatgatggggaagcaagagaaggagaaggtgctcctccaggccgcctacgatggcaacctccgcctcctcaggagtgcgtatcctagccctttctcttaggcctcgttcggttcgagtgtaaaaggccgagatccccggccccttcggggaagcccaccacgcggggaaaaaatccctgtgctgacaaaaatcgcattcggttcggtccgggaaggtgggaatcccggcccattaccccccaaaccctagggatattgatccaccacccagaccggtggaaatccaccacgctccacccgagaggcgcaggcgccgtctctccccgtcgcgcgtcggtgcctcccgcgccgctctccttgtcccgtcgcgagccggcgcctcccaccgcatccaccggcgacggcgcctcccaccgcatcctcctgcgccgctgccttccaccgcatccgcccgcgtcgccgcctcctctcggctctcgctgtagacaccgccgccgcctcacatcggatctgccggagcagccacttgtagacgcatccgcggccgccactgacttccccggcgccgccttccttcctcccagtgcagacatcaggtgagccccttactcctctccctgtcgctgctcgtgtggatgaagaagcttatgttttgctgccatccctccatgcaagatccattggcaattacttctctgttcagtcacctctgtccggacaccgggtctttcccaacaagaacctcctcgaggagcatcttctgctacatcagctaggtatgtcaaacaccatccttcttctgaactccatcgacgattcaagatggcacatgcatgcttgtcaattatcagcattacagacaactagtagggtgcccgtgcgttgctacggggaattttgttgatcacgggggataaagccgtgaactccaggattccaacataatttaattagtgtttcagaactactcgctgactcaaatttaaggagcagcaacagtaatgctcaaactcgttacataaaatgacttgtacgttggcaacattaagagccataaactgcactgatcagaatgtaaccaattttatgaaagaaataacttcagtcttacagagaaactgcatagaggaataccacattacaaaatatcggtagggtttgccctccgtgccgcccgctcgtattctggccttcaaagtattcgtcatgatttggaggagacaatcattgaagtgaaaaaaaactaacttatttcaccagttctggaaatgttttattcagtttcctggtactatcaatgctaagagttgtttaccctggttatcactgatccagaaaaacatagtaccattaatcaactcaaaaggattgtgtgatattttactgaacaaatagaatgcgcttattacataattgatatttcaacctgtcggtgacatgggatcgggagtatcatgactagaggtttgaggcagacacaatcgcccacgtggcctggcaccctcgggggacgtcgggcccgagggtgatgtgttcgccctcctcttagcccccccgagggggtcgagccgcacccgcctcggccccgagggccgaggcgccccgacccctcgtgggttttcgctccgcgtgtatgggttaggtgggcacagtggggctcacctaaccatatttattgcggtttggctgagcgtgtcacgccgcatgtaacgcggtgcagtgcactcatttatccggtctgtgaccagtcacagaccggtcagatcgcgggttaggtggcgacaggcgatctgacgcacgcctcgccccatcccgtcaggacgagggcttctaggcactcgtccccagctggagctagcgtgttacctcccagagatggcacgttagtcctggtcagatatatgccaggcttcatcctaaccattacaggcaaaatgttgtgtgaagaagggccaacgtgcagattgctaagctgacgcgtggtggacaagaatgaccgatttgtgaccagtctgacaccggtcatgtcgtcagcagacagccatgattccgcgtcgcgcctgctcccggcgaaagtggaggtaggtgcgggccgtcccatcagaaggtgactcgaacggcaaccatgcaaatctccgtccatttatgaaaaggtagggtaagtccccacagagagggggggatggtgcatgtggtatccccttaagatataaaaggaggaccttgcccactgagagaagggaggtttttttttttggactggacttttccagattaggaacccagaataagggagaggctggctcatactttgtagctccttcacacacgaatccaccaaaacacaggagtagggtattacgcttctaagcggcccgaacctgtatacatcgccggcgtcttctgtgcttcctgtctggcgaaccttccacatacagattgggagcttagagtctcacctagggtccccggccgaaccggcaaaggggggcctgcgcggtctcccggtgaggacccccacgctccgtcatctggcgcgccaggtaggggactctgcgagtgatcttctgagctctcgcactccttcgtgtgcgccaagcattttcctgttcagcccaatggccgagccagcaaaggcgcgcgacctctccccgagtatgagcggtgacgacggggagccaaacccacgccgttgagctcgtactccaccgccccctccacgccaaagtcctaggcgggaaaaggcgctcgagagggctgaaggatccgcgacttcgacatccacaggaggtggagaagggcggcgagatggggagcgtcgtctcctcgtctacggcgacggcagcacgccccagggcgcgctccaagctgcaggcgcgctcctacgtcacccgcccgtcgcccatgaaccggagtctccagcccaacgttggctggacgatgtggccaaattggtcatgactgcacggcagcgcctagatgctggtgggcggtcctccgccaccaaggcctctggagctgctaccaccggctccgcgtcgtcaagacggagggcacgacgagcggcagccgctgttcgccattcggccgccactcctttgtcgactccttcgacccgggaagatctgcgtggggggccggacgcccgcaccagcatcgagcgccggcgtaatgaccgacgtgctgcccacgcaacggagggcgcttcctcgtccagagtgtcacctcaacacggacgcggggaccagccctccgtgcccccggttggtggtgtcggctgtagagcctttgtggcgagccttcggaatgtccgttgccccccaaggttccggcccaccatcgccgaaaaatatgacgggagcgtcaaccccgccgagtttctctaggtctacacgaccgggatcgaggccgccgggggtgacgacagggtcatggcgaatttctttcccatggccctgaaaggacatgcacggggttggctaatgaacttgccacccgcgtctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaacaccataccatgcatccctgcacacgcggtgatttacgcgttcagggggggtgtgcggcacaaccgtatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgatgagggtcatgtcctcgccgtcgagggcgctccgcgggccacccgaaaggggaggcctggggagacaaaaagaaggaggccggcgctcccagcagggagcgcccgaccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacagcgatgatgacctaggtttccaagagcctggggccatcgttgccactgtcgatgggggagcgtgtgctcacgtttctcgccggaacctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatgatgctccggccgtcccagccgatcatcggtgtgacgccggggcacacttggccgctaggtcatatcgacctcccggtcaccttcggtggacccgccaacttccgcacggagcgggtgaactttgatgtgacggacctcagtctgccctacaacgcggtcttggggaggcccgcgttggtaaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccataggaacttattgttatacaacaatgcccttcgggttaaaaaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcgttatacctgcgggcaagcttctcgggtacttggtctctgcccgaggcatcgaggccaaccccgagaatatacgagctatagagcggatgcgccccccagcaagcttagggatgtgcaatgcgtcaccggttgcatggccgccctaagtcggttcatatcgaggctgggagggaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagccggacggtggcccaaggcccccgacgaccggagcaggccctctccccgcttgtcagacggtgccaggtgcccccgacccccaggacggccccgaggccactgcgggaaggccgcacctatcgccctctgaccccgaggctaaccctgtaccgattcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcgccccgcgaggccgcttgggtgaagagcgccccagggatgcagcccctagcgaagaggatcggccccaccgaaaggtgcagcggcccgtctactttgttagtgaggccctccgggatgccaagacccgataccctcaggcccagaaaatgctttacgctattctgatggcctcgaggaaactgcgccattatttccaggcgcatcgggttacggtggttacgtcttaccccctcggccaaatcttgcataatcgagagggtactggacgggtggtgaaatgggcaatcgaactttctgagtttgatttgcactttgaaccacgcaacgctatcaagagccaagccctcgccgactttgtggcagaatggaccccggctcccgagctcgtctcggtccccgaagcaaactcgggcccctcgcagctgcctcacaccgcccactgggtgatgcagttcgacggctccctgtctcttcagggcgtcggtgcgggggtcacgttgacctctccgagtggagacgtcctcagatacttggtccgcctcgactttcgagtgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcaccattttgacgggattgagcttcggcacgtgcccagacgggataacatgatggccgacgaactctcacggctcgcgtcctcacgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaaggcattgtgcttcttgccaatatccatgaaggcgaatgcggagcccactccgcctcgcgcaccttggttggtaaagcttttcgccaaggtttctattggtcgacagctctcaatgatgcggtcgacctggtccggcgatgtagagcgtgtcaattccacgccaagcaaatccatcagccggcctaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatctggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgctaatgcggaaatcctcaaaggccttaaaaccaagaccttcaacatactcaagaagcatggcgattcatggatcgaggagttgccagcagtgctctgggcaaaccgaactacaccaagccaagcaaccggggaaacgcctttcttcctcgtctacggcgcggaagcagttctcccatccgagctcaccctgaggtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgacctcgtcctacgccgcgtccaaacgcgtgctggattgagcaagctttcaccaatgtaggagggtccgtatcgagtggtcggcgtcccccggccgggctccatacggctggccacgggcgacggcactgagctgcctaacccgtggaacattgaacaccttcgtcgcttctacccctgaggggggggtcgggtgtcaggtttcgggctcgggccaaccccgcaccccctcgggcgtgcaaggttggccgggggctgccacacatgcacattcttatttctttttttttcagtatttcaataaaagcagtttcaatttcctaaaggctgtgtctgtgctgttttttccttttgaagaatcttgacttgaaataggtcactcgtgctcaatcctgccctcgggggctcgggtcggctaaattcgccaaacggggcccagaaccgagccgtgccctggggcgtggtgaactccgggggggaatcggtaaaaacccacaatcgggtcacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatacacacagcaagatgaaattgacacaaaaatttcttcatttttgattacagattaagttgatctatacaaaaaagaggcccgaaggccttagaagaaagaaaagaagaaaaaactgaagaatggcgggggtctgggggctcaatccgatgcgcccgggtcgccggcctcgtcgtcactgttgtctgcaccaccggcattgccctcctcgtcggagttgggggcgaacgcgagccgaggggccgagccctcgaagctgtcgacgatatggtcggcggcatcccggacttgcgcgcgcgcgcggtcctcggtcccgggagggaactcttccagcgccatccatggagagaaattggggtccctggtctggtaactcgccaggacgagctccaccgctccttgggcgaggtccctcgaggatgacttaattgtcttctcgagctcctcggggagccgttggagagccccggccatcttcgagaggcgctgggcgagacctccctggttggcggcgtactttacggtccgccctctccagaggcccacttgccgaccggcgcaatctaggcgggagacggcgtcccaaagcatgccgggcccaacctcgcctgccaagcggagggcttcgacctccccggcggacgagtccagcgcgccctgcagatcggcgatggtgtgttcggcagctgcgaggcgggcggctaagtcgctttcgcccgcggccgccccgccgctgcgcgccctcgcgtccagctccttcgcccgcgcctcgagctcagcggcccgttggttcagtgcggccctctcggcgcgggcaccttccagattacggcgcgcttgctcctcctgcgctgcctcgcggagggacaggctgtccgccagctgttgcgccgcggcctcggccccctcgagagctcgctcccgctcggtgagcgcgtcctcgcggaggcggagcgcgagctcttcttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgctagcaccttcttacgggtttcaagctccgagatgtgccggcggtgagccttacagcccacctccaccatggcctccaccgagcgtcgcccctcttcgacacgcgcccaagcggcatcgagctccgcccgctctgcctgcagggcctccacctgggcacttaacccgtccaacaccgtggtgtttgcggcggccaaggcttgcagaaggggctctgcgctcagtagggcagcagaaggcgtggggaaaagccgcctcggagaagatgccacgcggctcggcccgccgatggacgtgccaaacgcggggatgtcctccggacctggttgggcctgagcgtcgcccgagggagtgggcccaagtgacgcgcccgcagcctcgtcgccagctaccccggaagttgtcgcctgagcgtcgcccgagggagtgggcccgagcgacgcgcccgcggcctcgtcgcgagctgcctcggaagtcgccatcgcctcgtcctagcgaaatccggcttcctcccgagcggcttcctcggccttgtgggctcggacagcctcctcccgagcggcttcctcggcctggtgggctcgggcggcctcctcccgagcagcttcctcggcctggcgggcccgggcggctccctcccgagcggtttcctcggcctggcgagcccgggcggcctcctagacggcctcctcggcttcccgtaggcgatccgcggcctctcgccggtcagattcccgcctccgggcctctgcggccgccggatcctcggcctcaggctggccggacttggaatggcgggagggacgcgacgggatctcgctgaaacaaaagaaaagaccagaagacgaacgagatgggtgagtgaaaactcgcgttgagagaatgaatacaaccacgatgggtgagagacgaacctgcgagggggtcggttaaacgaccactttagggggggggaaatgaggtttccccgagatggttctgtctcccccatcttgcggggccgcttcttcttgcgctccccctcgggctgcgatgttggcgcggccccctccgggcgcctgctgctggcacgcgccgccccgccccctcggggagatgggggaggtgttcctccctgcttcctcttcccccgggcgtcggcagggcggctgctccccgggcccctgtcgcgggacccagaagcacgaccccctctcggggtagattgttccccccggcggctcccgcctgcgccgtcgtggccctttggagctcgctcctctgaggccccgaccgccatcataatggtcaggatggaggcgcggtctggatcgctgcagagggggaggattccttggggaatgagggccgcctccacggagttgagattcagcacccgttggaccaatatcttgaagtcctcaggagcccagtcccatctcactccctggtgagtcctcatgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagctatcccccagatctaccggcgcccgccagctggaggcctgagccgggggctggctcggaagtcggaggcgcacttcgtcggcaaggggggtgtagaaccagtcgctcttccagtcgtcccacttcttgcggagggcgcaggggatgtagcggttcggcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaagggagaaagaagacggaccgccccgggtagtctggcgccgggcgtccctcgcccagcgtgactatctcccggccggtggcagattccggcatgaagcggcgcggcagcccagcctgcctctcgctcacgatgcgggagggcggcagcacgctaccatcgagcagagcggagccccgtgccatggcgccggaaggaagagaagattaagagcgagcgcgtgtggcgaaggtagggcacaggaaagaaggagttagggcgcaagcggcgaagacaaggggaataatggcgaaaggaaggaaacaaatcccttcctcagtgcctttatactcttgccaacgctgtgcccggctcctcgcttctcgcgcccactatttcgccccctcgtttctcgcgcccacgcttccactaatcccattcgcccgcttgcggtgcatgaggtggatatgcggttgtggcggtcgagatagatcatatcgtgcgcgcgttaattacgctcgccgaccgaagcgacgttaccatatctccagatgaaacgaatcgccatgtccagattcgtgtgctactcgagtaatgtggcagtcttgaagagaccgctcattattgacaaccgagttaccattgccgatgtgcgtgatttttgaccgttgggtttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagcccccccgagggggtcgagccgcacccgcctcggccccgagggtcgaggcgccccgacccctcgtgggttttcgctccgcgtgtatgggttaggtgggcacagtggggctcacctaaccacatttattgcggtttggctgagcgtgtcacgccgcatgtaacgcggtgcagtgtactcatttatccggtctgtgaccaatcacagaccggtcagatcgcgagttaggtggcgacaggcgatctgacgcacgcctcgccccatcccgtcaggacgagggcttctaggcactcgtccccagctggagctagcgtgttacctcccagagatggcacgttagtcctggtcagatatatgccaggcttcatcctaaccattacaggcaaaatattgtgtgaagaagggccaacgtgcagattgctaagctgacgcgtggtggacaagaatgaccgatttgtgaccagtctgacaccggtcatgtcgtcagcagacagccatgattccgcgtcgcgcctgctcccggcgaaagtggaggtaggtgcgggccgtcccatcagaaggtgactcgaacggcaaccatgcaaatctccgtccatttatgaaaaggtagggtaagtccccacagagagggggggatggtgcatgtggtatccccttaagatataaaaggaggaccttgcccactgagagaagggaggtttttttttttggactggacttttccagattaggaacccagaataagggagaggctggctcatactttgtagctccttcacacacgaatccaccaaaacacaggagtagggtattacgcttctaagcggcccgaacctgtatacatcgccggcgtcttctgtgcttcctgtctggcgaaccttccacatacagattgggagcttagagtctcacctagggtccccggccgaaccggcaaaggggggcctgcgcggtctcccggtgaggagccccacgctccgtcacaaccaaatggaccgacaaattttactgaacaaatagaacgctcttgctcagtgcagcatgcattgtgctttggtttttgtatcaacatgctctgcaatgtcaccccattttgcttgcaaaattactaaagcttccaaaagaagcaaggtctcctggtcagtccagctagtaccaccaaagcctggaatttctgcagattccataatgatgaaatcagtttgtgacatgcctgcatccaaatttcctttgtcatagtctgcgtggaaaggtttaagagaaaacaatcagcattcagctaaataaatcatcagacctaagaactatgcttcagtacttttgttaggtaaaaaaattaaagaagaagaaaaaagaaccatatagaagtatcatcagctccatattgaccttaccatgaagctacctaagcaagaaaccaggtgggatcaggtgaagggatgtgaatcaaatggttttgcagttgatggttgttttccagagtcaggtaatagactaataatagagtgttgtaaatagatttgttgtcaatgtcagccaccaggttagataaagcagagttcaggcactggataacttgtccgctagcatcctgcatccaaactcgtagagttgtaggacacaacgacaatgcaaaaatcttcgatttttcatttcctagtataagtagcacataaaaaacctgcagttgatcacaatacctgtaatggtgtatataggccttgccaaaatcccaccgaaagtaatgtttactactgtccaagaaaaaaaacacacgaaatgtttgacttggaatataaaaattacagaaagaatggaatttaagcaagcatattgtggatggttaattagtcgcataatataccttttctaatctgtgaggacctctctatacacaatattttttgtgtatgttgcagcctgtttagacaattcctttcctttcttctcattgtccttcacgccagtacacttagactttttcttttgtttcttgtcttctaccggcatcgatagtatttttatgtttgttctagaggttgctctagacaacgcgacgtataattgaccatgagagaagacaggctccggtaagtagacgcctgcatttggaattgtttgactctgcgccttattgatggtcaatgcaaagctcaatctaaccggaaattgcttcctcttgaagcgaaacgggaacatatcatcatcagacggacatagaggtatacgaggaaggaaaactctgttcgcaactgctattgtgcatcgcagccatgggcaaaccgaagagactggcacctaaatacatctgttcgcaactgagcatgcaagctccaacctgtttggttctataatgactataagtggtactttcagattcagcatatgcagagacttataacagcaggctagtatcggtctgaaattcatttcctattgatccccaacgagcagaaaagagcaggctggtactttcagattcagcatatgcagagacttaaacgctacgacggtggctgcgagcggagaagggtagtcggcgatgaggggctcgaccccgtcgcaactcctcccgagcggcacgaagggcggagacggagcagcggcggcaggcgtagttcatatatgatatggctcagcgaggattaaaacctaagtgatttccctgaacatcacaactgtaacgtctaagcaagcattttgtcgaacaccttttgggcatggggagcattagcgtattacctgcagcttgcatttatttgca

SEQ ID NO: 55549 - DNA, 4283 bp, Oryza sativa
cgcgagcgatgcgggggaggaaagcggagggagcgaccgagggagggggctgcggcgacgtggatcgaggggttgaggaggggagatgcggagggagcgaccgagagagggggaagacgcgtgcgctgatgcggcggcgtgtggagggcgcgacgagtggtggaggcgcgatggcacggcgtaggggtacggaggcggaggcggcggcggggtgggggtgtgcgagagagagagagagagaggaggggcacaacgacggggcgattggggggcgccatttttctcgtctactgcggatccggagaagcgtccgatctctgatcccacggttgataggtcacacgtctacgttggcttcaccatcaccactacggattattttttaagtagtagagattagcttcaagatacatttgtggcgtgtctaaggtctaaagttgcggctgttaagtgttaatccccccaacaagcagcataatttaacccaacctgaagcctttatacctggcaaaacactaaacaaacctacccttctaatttcacactgttaattaggctagttttggctaattaattagcttaaaagctagctaacattgctatcttcagctttcaatgcaagccctgcagtgtagtaagtagctcacacgaattttcagagcgtgttgtcttaactggttttcttgtattgacagggttgatatacatgagattgggtgcttttgtgaggtatgttctgcctagagtttctattgtttatgtcctgcctaaattaattgttcttgagtttcgataatgttctgttaaacagtgctcagatttatatagtactacctctgtcccaaaatacttgtcgctttgagtttttgtttgtaacttttgatcattcgtcttattcaaaaaattatagaattattatttattttgtttgtaacttgctttattatcaaaaatactttacgtatgacttatccgtttttatatttgcactaatttttcaaataagacaaatggtcaaacattgcaagaaaagagccaaaatgaccactaatttgggacagaggtagtactaagttttaagttttactactgtccctgggtgctcagatttgctctgcattagttctagagaatggcatatatgcatttgtaatagagaatgacatgtgtttgttcagagtcattagctgaaataggacagcaagtatattctagtcagttagcatagaatctggtattgttctgattttgtttctgttttgtttttttccctttaattctggtagtttgagtgtctatcaactgctttggccattggatttgttaatacaacacgtgttccacgaaagatgaagatgattattgattcccatgaccctgtaattctgtaaaggatgccatcatttttaggaatttaggatgccccttgtgaaatgcgtccttcactgtggaaatggatcaaaggaatatcacatctccctcttaacagcttcccaggaatatgcaattcttttggttttaaaaacaaacaagagtaggaacatcaattccatctatacactctgaatgtgcttgtgtttcttacccactgactgcattagtgcagtgtatatgttggggacctgctgaaattgagctcaattctgaattctaaaattctgaaattatggttcaggttgctgaaatttagctagaaaattcagtctcagatcatgtgcaggtttgggagtttcagttctctgaaactgattttttttactttgatgaagagtacaactgtagattgtgccatttttcctttcaatgtgctttttttgattaattcatagaccaacaccagatctttagaagtgtataaatagagaaatcatgcagttgatgttattcccgtaattagacactttttaggtgcctgtcatgcagttgatgttttcgatatatgaattgtctattggacgtagtttttattaacctgtagcttctgttgactgctgctagttaagctatttcaatggggcttaaacatgtggtttagcaactattggttataggagtagctattatatgttgttgttgtgacacaatattcttcttttttgtacataatacatcaacatgtgtataccatagactgatctgtatagtgaggatgatgtattctttcccttttgcaggtaattggaaatgttcacagtgaaacctgaattattcatggaacttattgaacctctggaactaaataacctaaaactttctcgttattggaaatatgtggctgttgaccatataggggcatattgatcagctatttttcggcctttgaattgtgcagttttctttcaagtgataatccgtctcatatgttttttcagggacttctgtttgctgcaccaagaatgttattgtgatgtacctgagaaatatgctgttctgttaattgaggaactttacaagtagatattaatgatttagcttcaatttatgtaatttaatccctgctacttattactgtaatagagatctacatgtgtgaatctataatcttagtgtgcactaatattctaatatgaattgacatttttttctagactttgtaataatcacgacataaattgtacagccagtcttcgttattttcccttttttgtttttttttctcattttttctcatttttagatttttttgggtggtgttttgaattttctgcaattttgttggtgacaatttaaaatttatgtaatgaaatctttaaaccttagtccaaataaatcaatcccaccaatcccttacctgtccaaacaaaccaaatgataatcccgtggtgaaagggattgggtgggggattgggtggtgggaggggatgaacccaatcccctccggtgaccgttttacctgggtataattatcccttggtgccgaacgaggcctgagtttaaatgctgattgtgcttctccgatcgatgctcacccgttgatatagagatggcgcgagggctggacaccgggcagggcgaggcggctgtcgtggcggcggtggagggcagcggcttcgggcaccgcgctctgcacatggcggcctctggagggagcgtggacgtcctcaggtacctcgtggaggacctctgcctcggcgtcaaccagttcaatggcaaaggtcttgcgctctttgccttgcctctcttccgttctatttttcagctcgctcttatacgaatcaagatgcattgagtattctttttctcaagaatgatacaataattcatgctttgaatagtcctcgtgcaagcattgaacatcccctcttttgtgtacattgaaaaaccacaatttagattgatatcaaactccaaattcggtggcttcaatttattattaagaaagattatttaataggacagtccctactgaactatctcgtggaaaaaacttgtcatagcaattaacaaattaaccaaaaatgaaacaaattgctcaacccctcaccccattcaaccacacaatcatcacacagaacgagaacccaaaacatatcacgtaattaagcaacgcggagagtcttgtcaatgtgggtgctggaggtcaccactttgtggaccagaagctggcatggaggagcaatggtaggagaagagctgtaatgtgtttgagaagtagggtgactggggaggccatgtcttgcacagacagcagttgcagaagtggtggtaccgtggtggagatgcgtgacagcgtgagaggctagagagttgacatgggttgggtttgactgtgtgagggtgttcgtgattgtgtaacaccgcagataactggtttcctgtttatatataccttctctgagatttggacttgaattgtcaattccaatccctgatggcagacaacaaccttgtcaatggaattggaatgtgttccttggacttggaagtattctgagcagtaattgtgcattctaatttcctattttccttgcttcccatacttttcacggtaatcatttatcacaaggagtcactggtactacattagcactagccagtccagttgcacattttatctttttaacaaggagtctacttaaccccctgaagaaaaaaaaggtacatatcatgtgccctgaagtatttaaaaatgtacaaataacaccctgaggtggtttcgccatggtaaacaatatgactagtgggtagtgatgtgatgatgacttagcagatgaatataaatctgtagtaaatgccccacttcttgaaacaatgtttcattcagtacttaaattgaactttga

SEQ ID NO: 55550 - DNA, 9968 bp, Oryza sativa
actattgagcgaaaatgaagcaaaattaacattagtatcttaataatggaaaatcctatatcgtaatttccgttgggttgtgtcacgcccggaatttctatccaaaattctaaacgcttacatgtgtgtgaaccctcgtccaggaatcagccgaggcacacaataacaaattgataatagagtacaattattactctaattaataagcgaataaaatatcattacagaggtaagcagcggaaaaaataagataaacggcgcagatgactccactccacaggcagcttgaccagggctacacctaatcctccacaccatcagcatcactgtagaactcctcctttgatgaatgattgcaaggtgagtatatgacatactcagcaagccacgaagcaaatatgcaagtgcacaggataacaaaggatggcatagtagggtttcatttgcataaacagcatttaataaacatttcagaatttaataaaatagttaagtaataattaaacaatattaatccaacgctatacaacataccctgttgcataggcccaaccattctgaacaaccatcctggctgcacagttctatctccaaaccaggaattaaccattccaaaccaggagctaatcaaattattaccagttatagcatcttttattatgatgagaaatgtgagactaatcacgaaagacattgttagacccgcccataaccgcgggcacggctattcgaatagttttactctggccagaggtgtaccactgtacccacaagacacagccccacaacatgtcaccatgtgcctcaataccaccacggtaccttggaaaggagctgtgacagtacccctcgcacaacacaatccaccacagtgcaccgttcctagatcataatcacccctttataaacaaggcatggactccccagcgacccccgtgggcttatctccgccacttctcagtctggtgctccgcaatgaaccatgttatacaaaaggtaaagccattgcccacgctggcttgtggttggcacggttaatgtttcacaaccgaaactcgtgaaccggtccttaattgtcatgagcacgaccatcaaaaccatgtgctcacaacccaccattatcaagttttagttggcaatttaattaattaaccaatcacgattgaccatcgtgaactatcattaagccatcattaaataatagtgaatcataagttatcccaatagtgtgctaatgtttctaagcatggctaagcaattatgtctaacatctagctgaaccaatatataaagctaaactagtcaaattatcacccaaggtatcaaagaatagagtaagcaatgcaaagtggtcataacaaaggaacaggtccacaccactcggtgacattcgaaaataaatgcacagttgaaataaatagagaatttaaatataggatcaacatgctcaaaggattgtttgggatctgtgtgacttgccttgctggccttggaacacttcaaattcttctcctgcgaaaacggactctccggaaacgtcggaatctaaacagaaaggagcaaaatcaccaaacagcacataaacaagcatgaacagtatatgtggatatttttaacatgtagatctcaattttagaaaaatttagagacttgaaccaactaaatccgagctaagatgaattagttatgaattttcaaagattaaatcagattaaatcatttatttagattttaattgaattatgacgcaataatgaattatttttgaaaaggaaaaaggggtttattgcgtcagcggctagggttcgcggtgaaccgggtgcacggcggcggctcacggaaacgaacggccgagatcgattcatccaaaatggacggccaagatccatcggtccatgaccgggccacggggaacgacgacgatgacgtcagcggtgacgtcatcaccggcgacgactcgggcacgcatgcccgccggcgaacgacggcgcggcggcgcgaacggagagcaccaaaatgatgcgggcgacgtggcgaactcaccgatgacctaaacggcgacggacggtgaccgaatgacgtcggcgacgaggaagaagcggcggcgctcttcggcttgacgacggcgacggtgttccggcggtcgacagcgacggcggagggacggacgaggactgcgacgacttggcgaccacgatggtgacctccccgagcgacggcgacgaccgaagcgacggcggcgcacggctggagcgacggcgacgacggcgacgctaggctgcacggggctagggctctacgggcgacgagaggcgaaggcgagggtggcggtgggtagcggagacaccgggggtccttttataggggctaggaggcggcgtcggaggcccacggcaaccggtgacggcgaaggaaggtctagggttcggggagagagacgaatccgattcgaaatcgaatccacggatttccaaacgaaattagccaacgattccataagagaaaagatagaggggatcccggggatcatttcccctctattaatttcattgaaaacggaaaggggcgggcggatttggaaggagatggcggcggcgcgacgctagggctcgagcggcgggcggccggaggtagacgacgacctgacaggcgggccccacctgtcagcgtccgagggcgcgcgcacgcggctgctgcgggcggactgggccagcttgggccgtggagagagagaaggttttgggccgactttcggcccaaagccaaaagaggattttaaaaacctttttcaatttaaattattcattaaatgcaattccatttattaaaaatacttccctagctcaaataaatcccagaaaaatctagaaattatagaattaagcaaagtatttaatgaaattttatctgaccccattttatattggaatttattaattaaaactagatcttctcttctaggcttttaaaataaattctaataattccaatttagacaacaatttatatatttggaatttttagggtgtaacaggttgaaacaataaaggcaataaattaaatattctagccaaatttctagttggttccatttagctagacatgatcttatttgcataaggatacttataatgcaattttatggcatcaaattatggcttaagctgattaaaaatgcattcatgtaattagaataacattgattcgggctaaaatataagaataaactaatttggcccaagtgctggccatagcccaaaattgcatccggccgacccattatcgtgcgcggaggcccgtacagcccatgagggagatcaagatcgcacatgtgtggcctagcttgcccacaggcccatgagcaggctcggttggatctaatcgatggacatgatcacccagggctggttgatgcggtgtaggtgcagcgtcgaccgtccaattccgatcagacgactcagctcaaacgtacccggaacaaaagcaccaccggtttccaaaaccctaaccctaaccattaccctctctctccctgatttcaccgacgcaaggagcgcacgcagcggcagggatgccggcggagtggtgacgttgagacgcccgtgcgcagagaggttgatgctgagcacgtctctggcggggtccagtgggttgccgtggccgtaataagtgcccatgcgagctaaggctggtgacatagtgtgaaggcaggtcatggactcatggtgtgtggcggactaataccgcgcgtaatcccttcttccagcttcagttctcctctccagcgcggtgcaagaccacgccgagacaagcctcgacctcaagcggaggactgatgcgggcatgaggccggtccgaggcgacggcttaggggatgcatagcggcagtgaagtcgtgtgccattcacatgaagacgatggagaactcggaacgatcgcgcacgacggactcatgccgcatatggcgaactctggcaacctgagcccaaaccgtgagtcttcttactcccaaatccttggggtttctgattgagttgggatttaccggttgggttgcacttaatttgggaattcgtcatgatttagggaattgaatgatctgagtcccctccttggctccttctaattgctacccaagttgaacttgattagtaatagcaatctaattaatacactaaaacttagctctaattgtgatcaacagaacatgaataataaatttgacttaatttcaacatgaacaaaaaaacatacactgaacataaaccttaaaactttaagaagctgacacttagggaaaacttgatgcaacctttggcttcaatcactggagtgatggaacatgcatagtcctaagaaggctcttataccagaatattggagttaattcttaaaatcatgaacttaggctatgcttgatcacctcattaagcttacgagaaatttggtgtactgaccggtattgggagaagccattcggcgttgtgatagtaggacaccggtgataggatcaccgtgcggcagtagtgacaggaccgctgcggtgtggcaatggcgatggaacactacaagaatcctattaatccgtgatgaaaaatttctgtcacatatcactaaaaaaccgtcaccaaacaacatctgtgatggtttcagaaatcatcacggattgagcatcatggattgatctgcgtgacggtttgtcgaaaaccatcacagattaacagaatcggtgatggttttaaaccgtcatgatggagaccatggtctagttagtccaaccaagcccatttcctgtgatgaaaaataaccgtcatggatagctgccacgtaggatatttttctgtcacagattagctgccacataggatatttttccgtcaaggatttgaatcaccacgtatgtgccatgtgttcgccaaggtggacgctgatgtgtcatcgatgccatgtaggacttagcccacgtgttttgtggcccaattctttttccaaggagctttcggcccatttatgacctgatgatttttttttgttttgggccggtttttttttggagtgttttttcggccttttagtcatcattcagcccagttcaaattgggctacagctagattttagcccaactaaaattcagttgctgctaaatttagcaaaatacaaatatttcgtccataattttagcaaaattaattaccgatcaattaacattctctcatcatcagtaacaaaatagttattgatcagcacataaatattctaaaaacacattacaaccttcacatctcatacaacataattttttagcatatctcatacaacataattaaaacctgttcaaaagcacatgacaatacccaacagccaccaaagcattttggccactccatcaaagtcgcatatgtttgagcccagcaacctgatagtacaataccatgtgttagattatttttttatgctctagagaaacaagaagaaacaatctaccgatacgatattagtttttgaatgatagggctactttgcaacaccaatcttatgtcccataatacattgcactaacaaaactcaatgtccccatctacctcatttcattggccaagcaagcaagcaactgatgctatagattgaaggagaaaataaatgtggtccttttgcaggacagagcaagaaatccacagtttctgaagcaaagaaacgcaacaaaacagaactatcaaagatttgtgttatgtacaattaatctttaaacatcttacttcaggaatagctctacatatcacgtactgacaaaaacctctgtacaagaaactaaaaatcaaggcagtgcacaactagttcagagttgttctgagttcagaatgctatttgaatgaacaacttggcattcacggccaagcagataattcccatccaccaaactatagatagattcacaaacaactaaagtggttagagatatacacagacaaattctactgactagacctgctcatcatggaagcaaaaccaaaaatggcatttacagccataaaacgacactgctagtttggctccttttgcagcttaagaaagttatcaagtatatacatcaaacaaatctacttggtttatttgcagattaagaaaatgagcaaggatatacatcaccaaatacttgtacttactagccaaaattattatcttttgcaaatttacagccataaacaaggggttgatagcaagttcctaactcatttcagatataatgaagtgcatcgaccatgttgtcaaattgaaaacttcagtgcattcatagaactgatttcaatctgaaagtaaaaaaaaaaaaacaaattcagtagtagatacacgtctgggatggaactgtaaagacgggaagaccgctgcaactatgacgaggaagtggatgacgacggccaggacggatgggaggcaggcaggacgtgcttctatttgcactaattcaatctatttgaaataagagaaagaagggggaggaggatgggggtaccgtgggatggatctgccgccatcgctcgcctcctcgccgcctagcgccggtgcaccacaccaccgccgctcacctcctcctcaccgccgcacaccgtcgagccctcctcactgctgctgctgccggaggatatctctcgcggtcgctgccgaagcggttggcggccatgaggatgcgcccccgatggcgccgagcaccccgaacacgaggagagcggccgcgaaggcgatctccatgatggacgtgccccgggcccgcccacggcgccgccgacaaggtcgtcctcatcggagatggagaaggagtggtccacgtacgccacgcatggctaccctcgcctcctcctctacatctgcctgtcagtgccggatccgatctatgaactactcttccccacctcctccttcctcgctcgcagcctcgacggcgccacctccaccatcgataccgctggcggcgggagaaggaggcatacctccgcgtcgaacagggcgtactcgccgccaaaccatctccgccggaggttgaggaggaagaggttgcggattcagatggggacttggcggcggctagggttggggattgcttcgtttgattttggatcggctagggttggggaacatgggtatgaagcaacaacggatgcgattttacaagaatagccttggtgcatgtactagcttctgacactatttggacatttcacgtcaattttggcttgaccgcgcgcagtggcaccgcgatgcaaacctggccggaaaattttggcccttgcagtatgtttatttttggcaaaaaaaaactaaagatcttatggtaatttttaattttaatttatgagaactttaaatttaattttagactgatttttgtatttcaaatgaaaaaatcataaataacaaaattgtagaactcatcgaaatctacaactattgtattggtcctttctacaaataagttcatttgaacaatttcaattttgaattttcagaatttgacaacttcgaataaaaattggggttaataaatgattttaaatagaaaagtcaccaaaaccaaagatgtagaactcatcaagatgtaaagtttttattttggtcatttcttcatctgactctatttgaacaatttgaaatttgaagttcaaagtttgagaacttcaaatagaattttttattagtgaacggcttcagctgaaaaactcatcaacaataaagttgtataattcatctagatctacaaattttattttggtcatttattcatccgacaaagtaattttaacattgttcataaattttacatatctccaatatggtttcataaattataagagagatgtgtatattttgtaaacaatgttactatcactttgtcggatgaaggaatgaccaaaataaaagttatagatattaatgagttatacaacttttttgttgatgacttttttagttgaaatcatttactatttaaaaatattggttgaagttatcataatttgaaatttaatttgaaattcaaatttaaattattgaaacaaagtcatatagcaaaatgaccaaaacaaaagttttcgattttgacaagttatacaattttgttgttgacaattttttcatttgaaatcatttattcccgaaaaattatttgagttgagaggagggatgtaaaatggacttctcggcaagggaggagcaaaaagggctggcggcccgaagagggaggaggagggagagggaggctgcgggctgagggagggagagagtaatacttgggccgaaaaaggcccaagtatagagagatgaattttaatttgtttttttatttattttaataggttaaatgaactttgtgatattaaaattagttattgcgctctgaaaatttatggaaaatttcagaaaataatttagaccacgtagaatattaaaaaaaaattccagcaatgatttttaaagaaaaattttagtttcctcgttaattcatttgattaaattgctttaatctttaatatatttttctagtaatgctatatataaatatatgacgttttcttcaactataatacattatagaatcctattagaacacaccaggcaactagcgcagtggtaggatgggttatcttcaactagaggtcatgggttctattctcgttgggcgcacgttatgagttattttttccttctttgaaacgccaactctgagttgctgggccaactcgagtgacattgggacaaataaaaatatttaagtgcacattgggacatctagaacaagtggttcaaagggtaagacacattcctaccttctagctaagttgtgggttcaaatcccacatgctgcagatttttacccatgcgcaccatatttttttagtttgccatattatgcatcatatacatgtaacaaattaataaaattattttgttcaaatttaacaaaccgtattttgcgtttgattcttcttgcaatcacattttttatttttctttgcgctaaatatgttttattttttattgctttgggctaactagagtatgacgaatttaaaatcatacattgtgacagtcttgataaaactgtcacgagttagcaggccgtgaatatccactgggctcatccgtgacgaaaaacaaaaaatcgtcacgattacgtttgtcagtgacgatctataaatccgtcaccgaaaatccgtcatggattaacaagtttcttgtagaaattcgcccttcgatccccttcaacacgccttaggatcggtagtctcaaggttttgggaatggcttagcgtacgtgtctcgtcactcgtgcacagggttaagattccctttatatgtatcttgtggggatcgggggtgattctttcttgaggaaaacggtgtatccgatcatagcgttaaggagagaaacatgcatgaggatgcgtgggactcgctcttcaacgttagagatcgcgtgggcgttggtgggctgagcccatcgctctcctttctggctcggtggtcagagatcaaccaacaagtactaccgttaggatttttgttttttacttgatgaaagattgggaggatggacaatactaaccttaggatttttgctgtttacttgatttaaaattaatacatgatgattataggcaaattttgctacatgacaccgtgacttcgtggttttagctgtagggcactgcacgaagtgatttttgggggaaaacacttccaaaagttagatatttggtggtagtcactgcacacattaaagtaataatttccggttagagaggagagagaaatcgtgtgaaatgtcaaaaatgcccttgggcccacatgtcaaactctcctactctctctatgcccctccttctcttctctctctatcccacatgtctgtgacgttggtaggcaggcgaggttcggcggcggcggtgggccggcgagggtggagtggccgagg

SEQ ID NO: 55551 - DNA, 940 bp, Oryza sativa
ccccgtgcggtacctgctcctccgcagcgcctacggccggtacctcggcgccaccgacgcggcccccttcgaggccgcccgcaacgccgccgcccgcgacgccgccgccaactctgacgtccgccaaccacacgcccgcgagggttgctgcggctgctgctgctgctgccgactccccttcggcttggtggaggccacgcagcgcgaccgtgatgaggaggagccggcggtcgacgccatcatgtggctggcaaccaggtgcggcagcgaagacgtacaagaggatcgcgatgcccgcggcgtcgtccttctgcgcgacaggtccgggcgctacctgcgctgcaacaagagcatcctggcttgccgccgcagcatctcagtcgacgccaacttcgaggacgaagatacgttgctgtgggaggtggtgcgcgtccccccgagtggagacatgccggagctcccgatcgccactcaggtgagctcctccgatccttttcccctctcttcttgcgattccttttttttttttttgttttgtgtcttgatgctgatttcgtcggagattaatcttgatttcttgcaagaactaaccgtgtagtacaatatgtggattgatcgaatttcctactgctaccattgttgattttgtgcagcccgggttcttcgtcagggcgtgcttccccccgccgctgcgggagatccagttcgtggacgaagccgacctcgacaacatcagcgagggagaaaactgggctacggttgagatcagagggaggtcggtgaggctcctgagagagaagatcgcgaagcatgtgggctacgacgacttcacgatgtgcgtcagcgccggccgccatgggcagttcacccctctgctcatcgaccttcctcgccaccgggagaccctgcagatcgtccttgtcaggcccaacaccgaatg

SEQ ID NO: 55552 - DNA, 1219 bp, Oryza sativa
gttcgtggaagtcagacatgcatttttgatgaacttctgcaattataactattactgttagaaattagaaatgtgcatgattctgaattctaatgagtgatgacagtaactgaatgttctgagttctgaatcactggacccgatcgattagcaatccacggcagctagttctgtaaactgggtcgattgaatcactggatcctcctaattgtgtaaaaactcacagcttgaaaggattggacagatttgttttgtttgcagcagcgatcagaagttcagaactctgcattttgtatatgagcaattctatggttcttgaggaggtactatgagataccaaaattttagtgtaaaattttggtactttatggtacctcgtagtacctaggtatcaagaggtaccaaatttgcaatagaaaaaatggtacctccttaataaccgtaaaattgctctttgtatataagatttgcagagtccactgaaatgcaatcccgaacctgcgccgcgtcatttgagcaaattctgtaccacgaaatctgctgcactcactccctgtggtcgggcccacccgtcattgactacggttgaccaaagttgaaacggggacccacctgtcagagagcgacctgcgtcttctcgcgacgccttcaaatgccaccgcctccctcggctaacaaactcttccacggctacttgcctctctcgtcttcctccccacgccacgccaccgaggagtagccactcgccgccgcgcgcgcgctctcgccacgccgcgctctcgcctcgccaccgcgcgtgcatcgatcgctcgcggcgctcgccatggcgtggagacgtgggacgtcgcgcgggtatcgggtggggatggaggttttcgacgacgtggtgttcgcgcggctgcggagccatgtgtacggctcgtacctccacgccgacgaggacgggaggtccgtctaccacggcagcctccgcggcggcgcctcgcagcacaacgcggtgtgggccgtggaggagttgctcgtacctgctcttccgtggaggagttccgcggaggaggaggaggccgccacgcggtacctgctcctccgcagcgcctacggccggtacctcggcgccaccgacgcggcccccggcgaggccgcccgcaacgccaccgcccgcgccgccgccgccagctctgacgtccgccaaccacacgaccgcgagggttgctgcggc

SEQ ID NO: 55553 - DNA, 2857 bp, Oryza sativa
gcacgtgcggtccatctcttatagtttgaaccatcaaaggcatgtggtttcagtgcagcagcaaagccaactaccgaaaatgacctatcatgtttttggaatgttggaaatttggtcataattcggcatattttaatccaaaataacaagataataatcatgatatttacaataggatttgatccagtgatagtggtgaatgtaatcaacatgagcatgcttaacgttgaataagcatcaacaattacataatgacacaatgttgacattgcgatgaacattaacagtaaaacttctaattgaaataatgtaataaggttataccccaagaatggtcctccgctggagtttgaggcagtattgcctcagttggtgttgatgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttcttcttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacagccgtcttcccctacttcctcgcctgcggcgccgcctccaacgtctccttcccaggcgactccccagcgcgcaccttcgtcctggacgctcccttgctctcatctaccggccatgtcccggacacggtgttcttcccgaacaacctggtggagccacatcggcaacccgtcgaggcgacgtgctgggcctccttggcgcgcaccccgtggttaccctggtgacgctgcaccgtacctggactttctgcagccggtattcccgacgacgaggtcgcggacggcagcgctgaggcggttgttcgaggggcccgcgaggcttgactcggctggcgtggcgcagcagtcggtgtgctacgacggcgagtcggtgacaagcagggctctcgccgacggccacattgcatattcgttctgttctaggctagctagtatcgatctgttttagtgtgtatcgaactatcgattataaacgaatcgagtgtgtcctgcttgtgctagctagtatctaccgtgcttgtgttcccgtaaaggctgcaccaatcgacaatggtgggtggaggttgaatcggcggctcgagcgtggtggctgcatctcaaagctgccacggtgtcggccgagcttgaggaccgcgcgagcggcgactggcggccgagcttggggactgcacgagtggcgaaagcgacggccgtgcttagaggctgcgacggcaatggctgtgctcggggaaggcacatcctcacgtgggtgggcgtacggtgaggagcaaccggagttggaagagaagatggcgatgagagaagccaaggttaatttggtcctagaaagtattttggcgtgtaaacatgtgttgatagtggcattttatcgaatccattgtgcggaatggcatttaggcgaaacccacttttgacgatagcacaatgtcaattttcacaccccctccattcccttggagggaatcccaggctcccagccgaggaaagcctcccctgtgtccatttggaaaaccgatttaccccctgaactatcgcggtcgaccgatttactcccctaaactcgaaaaccaaacattcgacaccccaaactcttaaaacccaacaaattaccaccctaacacagatcgaagcggttttctgcctacgtggaacacacgtgacgatacagttagcaaaaacaaataaagaaactagtggggctcacttgtcagcatttttttcctctcctcctttgcctctctctcggtgagcagaggagagaacacgcggctgcggcgagccaaggacgcgctctgcctccgcctccaccgccgaccgcccgaactcgccgcctccatcgccggtcgcccgagcttgctctgcgttcgccggcggacgtggttggacggccacgatgccgacgaccaggacgacggaccgttcgccgcctccaccacgccaacgagagaagcagagaagggaagggaaaaaatgcagagctcgagcgtgcggccgtccatcctcgccgacccttccgtctgccccatgcgccgccgcagcaacctcatccatggcggcggcggcaagaagtgcggcggcgagcggcggtgcgcatggcgatgctgcttggctcggctcggttagctcgctcggtgtatatgcatggacacaggttgtacagatgtgtgctgcttgccggtgtgacggggtagttttacagaagcagcagcgaatttgggaacactaggagcagcagaagaatcaggtgacatcttgagcggcaggcgcgacggccggggaggggaaatcgatggc

SEQ ID NO: 55554 - DNA, 1090 bp, Oryza sativa
aaggccgtggatcccgccgactccccgtcgaaaccggagaagagctccgcacctctctccgccgcctccgactagaaggatgacctcgacggcgcccgcctgagcagaggactcgtcgcctcgtcgccgtagccgcggagctcgagagggtggtggatctgtcgccgtagcccgtcgcctccaacaccctcctggcctcctcggcgccacccgttgcccgccgcgacctccccgcgttccgccgccggcccacgcgcgccgaccgcccgcccgccccagcacgccgccgcccgccgcccatcgccgccccccgccgtgcacgctctgagcctgagagagaggaaaaggaagaggaagaagggaatataatgcagggaaaagtccattctacaccctcgaagtcttgtgcttgtctaaaatacacccccgaactacaaaaccggatataatacactctcgaactgtcaataccggacgcttaacccccccgggctgttttcaccgtggtttttgccacgtcggatgccacatcggatgccacgtcagccctagccacatcagcgcaaaacattaacatgggccaagcccatattctctccccctctctctccctccccctcccctgttcattatcttctctcacggccgttggcgggcggcggcggcggcggcgcagagctacgagggcggtggcggcgcggagctgcgaaatcgacgactacggcggcagcggctgcgtggagctgtaagggcggcggctgcggcggcggcgtggagctgcgagggcagtggcggcggggagctggtgcgagggcggcagctgcggcatcggcggcgcggagctgcgaaatcgacagctacggcggcagcgtagagctgcgagggcggctgcggttgcgtggagctgcgagggcggcggctgcggtggcggcgtggagccgcgagggcggtggcggcggggagttggtgcgagggcggcgacgctgcgaatcacgagcttgttgcctcgctcagaagtggccgacctcgccggagccatacgcgcggggaggagtcatccctatgcgctcgcgccgccaccgcttggtcg

SEQ ID NO: 55555 - DNA, 6325 bp, Oryza sativa
agctccaccggtgctctctgtctgggaggaagaaggatagagaaagaaagggaagaggagatgggggaagaagtggccactaacgtgtggctctaatttttatttttagttttatttgctgagtagacttccacatcattgccacatagatgaaaaccagctgaaaaaccacttgagggtgtaaagtgaacggtattgaaagttggagggggtgaaatatctggttttaaagttttgggtgtattttagacaagacaaatagttggagggtgtaaaatggacttatccctataatgtatgacaagtgggtctcactattttttaaaaaataaaatgctgactgaattaccacgtgtacaccacgtaggacaaaaccactttagattcggtcgagagggtaatttgtccagtattgaaagtttagggtgagtaatatctagtttttgagtttagggggtaattcggtcaaccacgataatttaggggataattcgtactttttcctttagaaacatgccaggggaaatttttcatgtagccaaaaaaaataaaagaataattaaaaaccatataaaatctcaaaaaacagaaatatcgcagaaatatattaaaaaggaaaatctagataaagtgaaaaacccagcagaaaatctagaataataaaaaaataaaaaaaatattcaacaagaatatagaaaatactaagtcatatttaaatgaggtacccttttcacaagatcagagaaaataaaaattgatctatgcaacatactgagatcatgatgagctttataatgtaataaaatatcataaaagctgcagaagtatcaatggcatccatgcatccacacatgcaaataatatatttcatacaaggttataatgtcttgatcaagaaagaatgatgagtaatcaaagaaatagggctgaagtctacagactatagagaacccatactagctagtacatgctagctagcatttgcttatatcacgatgggataaaactctgtacaaaatctcccaaatgttctccaggtacaaaaacttgatgaaatgcatgtgtgccaaccatgtccataaggcatcttgaatctcccaatcatactctgcattataagaataattgttctgcatattcgtttgaaagagattgcagagtgtcataacatatattatgggcacttactgaaccagaaccaatacgacagtgtatagctaagtgaaccaactacttagtatgacagctatttgcttcctgaaacaagcttccgagagataactaaagaaaggatatatgcagagtattatttgtcgaattaaagaaagtatagcgaaagaaggactatctaggaagattagtaaaaacaggatatttacttgatacagtacaggaaactactgctagcaaaacaaaactaatcttccctcctcaatcgaaataaatttagctctgttcttatctccaagttcccaaaccctcttcctcgttttccgcgcgcacgcttttaaaactactaaacggtgtgttttttgtaaaaagtttctatacgaaagttgcttaaaaaaatcaaattaatccatttttgaaaaaaaaatagctaatacttaattaattatgcaataacacttgcttcgttttactgccatatctgatcacaaaatgattacaaatgacaacaacgacacaactcaaaagatcgatcggacacatattcatatatgattccctttaaaaccattttattgtattattgtgtcattacagcagatctacctgctattgaacatgacaaaacctttaatccttcctgatctagctcagttaagagtaaagtagggcctcaaatcattgctttggtcagtgatttgaggcccttggcctactaaagtgccgcatgactaaagcacccaatacatcatttcgctggtgagcttgtacatctcagacctgtgcttcagcatgcggagccctcctccattggcaccaccagcatcgtcgtcgtcatcgcagcgctccacctcgacggcggttaacacagcgaacagctcctcgccatcacgctgatcctcatcggtctgaaagaacctggcaatgcagaacttggcggctcctaggtttacgaggtatgagctgacaagctggagggcgtcgggtggcgtgaactccagaggaaggctgtgaagcaccggcagcttggtgccatcgagatccagagcggagaggaccaagctcctcctcctgtctccagtgctgcatgagaggccaaaccaaaggccgtgctcatggcaatactcggcgagaccaacaaatggcagcttccagccagtggccactgtgctccacacatggctcactgtgtcaaagcagtagatgccactgccgtgcgtggatgacatccagatctccatgtcaccaaccacagcgtacgagtggacatgcaaatcggacttgtgagacagcggcggcggcggcggggggagagcgtggcatcgccaatcctcatttaatccatcctcgtagatgagcccatagaagcagccgcaggggacgtttccaccgccgtcgtcgttgacatggcggcgcgacgtgtcaaggatatagaggtcgtccccaacggtgacggaagtggtaagcaacctgactggtagggaagtgcgggcatggtgcggacggcgtgctcgccggggtcatagaggacggtgcggcaagtctggtcgacggcgaccaccgcgttgttgtgattgcctccaaggaggaggaactccatcttctggttcccaaacaacgtggagaagggagggtagaaggtcatggctgggcatggcaggctagcatactccaccgcgtcggcggcgacggccgacgccacggatggcaccaccggggttggacgtggcaggaagaagcggtccatgtcaatgttgcgcagcgtgtagttgctgcggcggcggccaaactcctccagcaacagataaacaaaccgacgggtggtgctcatcatcaataaatcgatcaatatgataatatactgtacaattgaacatagggaccccgcgtcgctctcgcgcgggcggctcggggggcgaaaaccctagccgcccgcgcctcctccccctctcccccgcctcgccgccgccggagctcgccggcggcaaagccggcagcgagcagggaaggcggcggcaaggtcctttcttcctcttggcagctccctcccggcgcgacgtggacggggcgacgtcgatgaggtaccccaccgccgggagaagtggaggcggcggggcggtgtggggtggcggcggatccggcacccccatggccggatctggcgcggcagcgcggcccggcggtggtgcgcggctgggggcggcgacggtggcccgacggcgcgatgcggctgggcagcggcggcggcccggcggctgggagcggcacggcaaggcggcggcggctccggcggcgccccgcccggatccggcgtccccacggccggatccgactcccggatggccagggtcgttatggccggcgtcgctggcgacgggaggacggcgcgtgcggaaggacggcgcatgcgcgacgggaggacgccggcgttgaggtcgatgcgtgcggcgccgtgcagcgggccgacgcggcagtggctggcgccggcgatgcttgccgccggacctcgtgatcctcgtggatgaccgccgatgggggctgctgccagatggatggctgcgttgtgggggacccgactgggacaccggcttgcatggcggcggcggggtcgttgcacgtcgcccgtgtggcggcgctgcaggtgttggccggtggagatgccgccggatctggggtcgagctcggattcagccgcacagtactgccatcacgaccggcgatgacgaggggacgccatgtgggtgccttctcatctccttggagctcctccccttcttgaccgcctggtcgtggggagctcctttgcgagacggtgaagacggcggcaaggttgccccaggttgttatcgatagtgatgggcggtggcgggcactctctttgtaggtgacggcatgggaggaaggctagctggtcgccgaagtgcagcggtggtttggtcgtgctcgttccaacgtgtagctgtgggggtcgcgctggcagcaggttaggtcgcttggagtccagccgacggaggggcgtcgttgctgtagaggccacgtgttgacattgcctgggagttggtgaggtagcggcaagaggggcattggcaagtgctaggcgaaagccagcccaattcttgggcggcaacggcgatgtctttgggcgttgcaaccctcttgagggcgttgttgaggtgcctccctccccctcttcaaggatcctctaggtgaaaacctcatcctttcgggatgggcgatggcggcgttttgaatgtcgtgaccttcttgaaggcatcgttttggaggtggctgtgtgttcctctcggtgtggtggtgtgtaggcacgtggcggggtgtgttctcttgtccggttcccctgtcccctgctgcttttgcctttggttgtaaatgtctattttactcctcttaatgcaaaaatacgcttctagcgtattcccgaaaaaaaaatcgatcaatcggattgaattgctctggatctccttctcccccacaacgaacaactaggctactactctgaagaatcagaagagatctagatcgatgggtgcctcccacccctttgggttagggttagagacagatcaacgaagagaaagtagtaaaacttggtatttatttgtcttcgttttggactagaacttcctatcccaagcgaagccaaatgatctttctcgttgcaaatctcaccttagcagagagagggagtggggggagccgcccaaccgctactcctcgagcgaatcggagagtcgccggcggcggacagacgacgggaaggggatggtggaggaagagagagagagaggtggggagggagttggctccggcagcggtcgttctggtggcggcgtgagtgcggcctgcggcggcgtccggggagcacgccgggtgagttagcgaatttcccccaacttgcaattttatctcattcaaagtctttacagaaataatttttgattttaaaaattgccagacacgtggtcgccgaccgccctccggcagggcgacttctcaccactccgccatcgtacaggccgcccaaactgacgtggcagacggccgttcgctctcgaggcgacggccgtcaaggaaatttgcaggggcgcccccttgccgccctccgatagggcaattttgtaccgtccggggggccgcctgcaaatgggcagcggggggcctggaattttgcaggcggcccccttgccgccctgggggagggcgatttttgcctccccctataaagcccagccctctctctgaaatttcattatattcagtaaaaatccaaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtattgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtatcggtacaagagaaagatataaatgtttcaatgcaaaccgaagatgtagagggtcctatcaacgcaggggatgttgttggaccatcgatgtaaaatgaggaaaatcaaccaagggaggagcaggccatgggcatggcggatgagggggagagagtcgg

SEQ ID NO: 55556 - DNA, 10258 bp, Oryza sativa
aagttagaaaatcagagtaaaaaggtaagtaaataaagtaaaccaagctttgcgagataagttaaaacagttggaaacgaggtcacaaattttgtaattttgaataactggtttcaaaagaaatgaaagaaaattataaaaccaacatgctaaatttattttattgcagcaagattaaataaaacagtgttgtaaaacttttgctggtaaatgagccattagtacagtaatagatgtacagtactaataacactggaataaatttttaatgagaaccattaaaagagattatgaagtgcatgtgccattagtttggtttaattaaaagagaaagggaggagaacagttctacttttccaatatttttagagggcttctatggataaccatttggcataacctagggtcaacctggctctgataccaacttgtcacgcccggaatttctatccaaaattccaaacgcttacatgtgtgtgaaccctcgtccaggaatcagccgaggcacacaataacaaattgataatagagtataaatattactctaattaataagcgaataaaatgtcattacagaggtagatagttcctctcaatcaataaaaatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttgataaaacagttaagcaattaaacaatattaatccaacgctatacaacataccctgttgtataggcccaaccattctgaacaaccatcccggctgcacagttctatctccaaaccaggaatgtaccattccaaaccaggagctaaacaaattattaccagtttaagcatcttttattatgatgagaggtgtgagactaatcacgaaagacattgttagacccgcccataaccgcgggcacggctattcgaatagttttactctgatcagaggtgtaccactgtacccacaatacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccaaaactcgtgaaccggtccttaattgccatgagcacgaccatcaaaaccatgtgctcacaacccaccattaccaggttttagttggcacattaattaattaactaatcacgattgaccatcgtgaactatcaataagccatcatgaaataatagtgagtcattagttatcccataaatgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaattcttcaaactcttcttctgcgaaaacggactctccggaaacgactgaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcggctagggtttgggtggaccgggcgcacgggcggcggttcacacgaacggacggccgagatctaaccgatccaagatggacggccgagatcgatcgggtccacagcggctcacggcggacggacttgatggcgtcagcgatgacgtcaccccggcggcggcggctcggcggctgggacggctcaggcggcgcacgctcgccggcgaacggcggcgcgaggacgctaacaaagggcaccaacgggtaacggacggcgcggcgaactcaccgacgaccaaaacgacggcggagaaacaacggacggcgacggcgacgaggaggaagcggcgaagctcttcgggtcgacggcggcgatgacgctccggtggtctccgacggcggcgaagggacggacgaggacggcgacgacttggcgaccacgttgacgtccttcccgagcgacggcgactgctgaaacgacggcggcgcacggctggagcgacggcggcgaaggcaaagctagggcacacggcgctagggctactccggcgacgagaggcgaaagcgagggtggcggcgagaagagaagagcacggggatccttttaaaggggctcggaggcggcggcgaaggcccacggcgacagcaacggcgaaggaaactcgcggcttggagagaggaaagccgatccgattcgaactcgaatcaaactcattccaaaccgattgagccaaagattccaaaggagaaaaggtagaggagatcccggagattgtttcccctctaacaaatcggccggagaaggaaaggaacagccggattggaaggaaacagcggcggcggctcggcggcggcgcgctagggtttcggcccgaggaagacgacggctccgacaggcgggacccacctgtcagcgacagcgagggcgcgcgcgcgcggctgactgggccggctgggccgaggagagagaagagaggttttgggccgactttcggcccaaagccaaaagaagactttttaaaacctttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttatattttcttttcaagacttttataattatttctaaaaattccaattaaacaacaatttatatattttgaattttcagggtgtgacaaacctaccccccttaaacagaatctcgtcctcgagattcggaagaactggcgaacagatgcggatgagctgacttcaattcatcttctcgttcccaagttgactcttcttccgagtgattactccattgaactttgcagaaacggataactcgattcctggttcttctctcatttgtttccaagatatggattggtttctcaacataagtcaaatcctcttggacttctatctgctcaatattagcttcttcggtaggtatccttaaacactttttcaattgcgacacatggaacacattatggactcctgccaaagattgaggtaattctaactgataagcaacctctcctcttctactgacaatcttataaggtcccacaaaacgcggtgccaattttcccttggtgtgaaaacgatgaactcctcgaagaggcgtgacacgaagatacacatagtctccttcttcaaaactcaaatctctacggcgattgtcggcataactcttatgtcgagactgagccactcgcaatctttcttgaatgatctttaccttttcttctgcttcccttaggatatccgtcccgaaaacctgacgttctcccgtttgatcccacaaaagcggagtgcgacacgcactccgcttccgaccatacagtgcttcgtaaggagccatctgaagactagcttgataactgttgttatacgagaattctgcatagggtagattcttatcccaacttccactgaaatctaaagcacaagctctcaacatgtcttccaaaatctgattcaccctttcggtttgtccgtctgtctgcggatgataagcagtgctaaagttcagcttagaacccatctcttcctgaagtttcttccaaaaatttgaagtaaactgactgcctcgatcagacactatcttcttggggacgccatgcaaacacacaatccttgccatatacaattccgccaagcgacttccggaataggttgtctttaccggaataaaatgagccactttggtaagtctgtcgactatcacccaaatagagtcatggcccgatgacgttctgggcaaaccagtgataaaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtacatcttagtactaccagggtgaatggagtataaagtatcgtgagcttctttcagaattgcatctttcaaatctttgttgtcagggacacaaattctttcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaactgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaatttcccccttcctctctttgggccccttttcggcccaagtcttctttcctctcccgcggcccgcgcgccttctccctctctcgggccggctcccctctctcttggcccgctcacaaaagtctgttttgcgtcccttcttctctcccttcgccgacaggtgggacccgtggaccccacctgtcatccccttcctccggctccaaccgccgccatggccgcccgagcctccccacgtcgccgcaaaatccggcgccctcccgcacccgagctcgcatccaacgacgtggacacgaccccctccacgtcctccaccatttcccccactcaccccgcaagaaacggcgccggtttgacctccccacgagctccacttcacctccccacttcgccggccgattccgccacgtccggcctcgatcccgccttcccgagcccataaaaagcatccacgggctcccttctctcttttccccaatttccccgagctctcccgtgccacaaatcgcgctcgcaccgcgagcccgggcgccgccgctttccggcgagctccggccgtcgctcctctctgccctagccaccgccgcgtcgcgccgccgccgccgctagcatcgccatgccttgctctaccccggcccccactccatctccctcctccaccgccggaaccaccttcccatcgcgaggccgagccactaccgccacacaccgccttcagtcggccgcgtcgcgccgccgcgccgcaccatcgccgccgtcgcgctcaccgagcccgcccgcacctcggccgccgcttcattgccgcgaatcaccgccggagccttttttctcctcgcgcgccggtgagaccctctctcccctccgtctccggccggcaattcaagccgccagggtcgccttcccttccctaacccctctatgctctctcctagggtgccgccgccgcccgttcgcgcctcggcatcaccggtcgtcaccgccgttttctcccttcgcgccggccgccgtgttcgccggtgaggaatcccctctcctccttcctttcctctctctcccatgggcgccgccgtcctccgcgcgtgcgccgtcgtcttcggccgccgccgccgccttcgtaccggccgccgccgtctcccgcgctgccggtcaccgccggtgaccgcgcgtgccgccgccggtcgccatggccgccggtcggctttgaggccgagccgagcccggccggcgcctccctcgcctccccttgagccactgcccggtggggcccaccagccggtggaccacccctccctctcctttcccctatggagccgctgccagtggggcccgcttgccagccgcccctctccctttcttagtgccgctgacgtgtggggcccgcgtgtcggcgccggctgccccttgctgacgtcagcgagatacttttcctttgtaaaaataattaataattgcgcaataaatcgagtttaattctagaaattcattaaaatggctcaaaaccttctaaaattcatatctaattcattcgaactctgaattgagccattcaacttgcaaaattcatctaaaattgagctctacatgtttgtttactttttatgtactgtttgcttggtctttattagagtttttcctcgttttgcgtgccagcgtgtaatttccgccgtttcggaagattgcgttcgcaaggataagagttcagaagatccaagtgaagaagcaaggcaagtcacacattccccttgagcatgttgatcccaatttacaaatgttttactgtttgcaaataaatatgcatattttgctaattacatggggtcagggtattacctatctgctcgcttgtgccatgtttacttgatatctgttctttgtcaactttgggtaatgaatcgactagctcatgttacttatgtgacctagctagaactatatgcttagccatgcttaattaccactagctcagttgatgggataattgcagtattagacattctagtatcttgatgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagttcaggtgggttggttgggcctgttcaacgtggtgtagcgttgatcagtggagattcaatattactttaattactcaacagttttactgtttcgctcaataaaatgttttacaaccgcctttatgcaaatagccacaaaccgtccttgtgttccccttgcacgtctgcatcgtcggtgtggcttgctgagtacggtggttgtactcagccttgctattattcccccttttcagaagtgtagtgcttctgagctgaagatggagttagaggaccaaggctcagaccccagttgagttctgcctgtggagtggagctgaagccccgctaggatcgcctttttccgctgctgctgcttttgtttcggtgtgaggactaagtgcctcttctgtaagtattttacgcgttatttacgtttggaactgtttattacttgtcgttttgtgtaccctggctggtcctggacagggatttaatacacaaaatagtctggaaattcgggctaaatttctgggcgtgacaaagtggtatcagagccaactcgactgtaggttgagccaaatggtcaaaccctaaggacaagttttctgaaaaccctacttgcaaattgtctcctctcgcccttcggcatttctttgtgaaacggtttttcaaaattctcctcccaatctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtggagttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacaacatatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagtcagtgtgtccatgagctaaatgagagtcacttttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcattttttcaaggacaacagttcaaaggttctcagtcaggcgaaagtaagactacccactgtaaggggggtaggtctcagagatgagttttggtttacctcgtcggcatttcacttgaatgttcaacccagtgcagcaatttggttagtaattaaaggagtccgttgcgagccactagcagagtctcccaatctcaagtcaacaggttcaattctaatgtacacccgtgaggccaggtcaacagttcagcttagagaagtagcatcagggacgattgtagttcagacgaaagacttgtcaagcaggtttcctggaattacttgtcattcgagccaggaccagttcaagcggacgtaggaccaatgagttacaaatgccagatgcaagattcaagaacaactccatccttctctagccaacttggtgaactgtcaggttatcaagttgctagcattgacagttcgacccaagataagtaagttttatgagtacgggcagtcctagtctgcgtcagtttgagcagaaccaatcaattcaggtttgggaagcaacgggacaacagtgttgaatccagccagatcgctcgtataggtttcatcagctaatcggtcgtgttgggtaccagaactccagggatctaatccgatgaaaccagtcagtcagtcagttcgaatcagaaagaggcagcatgtgtcagcagatcagtcagaccgtccatcagcaccggctttctttctagccatcccagaatctcgggacgagattcctgtaaggggggtagatttgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatt

SEQ ID NO: 55557 - DNA, 1560 bp, Oryza sativa
agtctctgcgtgaacccttgtgctacaagcctcgccttatatctcaccacctcattgttctcattccgtttccggatgaaaacccatttgaaacccacggggaaggtttttggaggtgtaggtattacttgtgagaatacctctcttttattgagggaggctaactctgcttcaattgcttccttccatttgttccagtccgagcgcttcttgcactctactatggattttggatctggatcattttggatggtatctgcaactgatgatgcaaagtatatgtggacaattgtagtcttacggttgaatgattctccagattcaacatagtttacggaaatttcatgcaccccagttgacggctcagtatttcccaatatgaccgcgtcggggcgttccaatgtcccatcattataaatttagtgcactgttgatgtgggaagtggatctgatgaatccacttggtgtctctcaacttgaggttgagtttcatttactgtgtcagaggattctttcctatgtttcctcgtgcgctttcgaggatttgccgtacttctcccactctcttttgaggaagggaattgaatagttttatttggtacctctattctttccggcacattccttgcgggaatgtatgattttgtgacacttttactcaagtaaatgagactggcaaattgtttgcagctacctgcaaatcaatgatccttttaacctgaagttcagattctgtggtacgaggatcttcctttagggtgtctaaggcatcccaatttatttctgggcattcaatgtgatacttgaattctccccctaatgccggaaaatgttcttcattgaagatacaatcagcgtaccgggccgtgagtaaatcccctgtaaggggctccaggtatctaataatcgacggggataaatatcccacgtagatccccattttcctatgagggcccatagatgtacgctttggtggtgagatcagtacgtatacagcgcaaccgaatttccgcagatgggaaatattaggaggatcaccacgaaccaattgcaacgggaaagttgtatggtatgcagttgggcgcaattgtattaagtcaccagcgtgtaacactgcgtgaccccaacatgaggttggtaagttacaattttgcaataatggtctggcaatgagttttattctcttgataagagatttggctaaaccattctgagtgtgaacatacggtacggaatgttggacttcaattcctaaagccatacaataatcattgaaagctttggaagaaaattctgcagcgttgtctaatttgattgattttatatggtgttcaggttgatttgctctaagtctgatgacttgtgcaatcaattttgcaaaggcatggttccgtgtcgataagagacacacatgggaccatcttgtggatgcgtctattagaaccatgaaatacctgaatggtccagacaatggttgaatagggccacaaatgtctccttgaatgcgttcaagaaactttagtggctcagcctttattttgagatatgagggtctcaaaa

SEQ ID NO: 55558 - DNA, 4982 bp, Oryza sativa
aagcatattccacgagcatgtcatcgatgtccaaagagtcttcctcttcatttgtcggagtcttggttttgctcggtccctcttcgtcaggaatggggtccatagctccagtctccagcacttgagaggcgaagtgtgcttcatgcttttggttggtctgtgtatgacccatagacttcatgtacagatcaacaagatgtttaggggttctgcatttcttagcaatatgattgtagcaaccatacctgtagcaggcggttttgctgccgctatcattattgggcttagaattgcctttcctctttttgctgttcccacgttgctttttggctctgttgcgtttgcccttgccaaatgaacttccagtctgggtattcccgctgggaacatttttcttctcattcgcatttacttcaggcaatggtgcagtgcccaaccggcgctggttcgagttccatacagtaagctcatggttcttttatgcctgtttcaatgtctgaatgagtgaagaatagactgtgaaattcttctcacggtattgttgagtgatgatccgttctgatgggagcattgtagacagagtcttctcaattttctccgcttcagaaggttcattcttacaaaaccggagtttagagcatatcttatgaacagcatggttgtattcgtctatagttttaaaatcctgtagatgcaagtgattccactcgtgcgatgcctcagggaggataatcgccatatgctgttcataacgatttttttgagatgtccataaaactcgtgggtcctcctctagcatgtattccattttcaaatccgggtggatatgattccttattattcttaaggctgaaaatttgacgatatgacacggcggagatgatgggtctagccatgatgagggcagaaggccgtgaccacgtccggcatgtccagctgcggtcgcacccgtgcggtccacccatgggacgcacaatggtgtggtgcctccaccaggattctgtccagcgttgtgcacatgcccggcgtcgccggagaccctcggcgagtggcgatggtattggagtcggtgctaccggctccggcgttcctttgggcagccgcgccgttgccgcggcgtcttcctccacgtccggcgaagccaggaggaggagatggggggccacggccggcattgccagcacgacggcccctgccacgtcgagtatgacgcacgggagcccgaaggatcgtctcgagctgctgcaagagacgacgaaggtggcatgcacggagattgcggggaagggaggagtcggcagtgaggggaacatgacgagccattcttaccacgcacgtgccggtgagtcttttcactcttctctcttggtagagctctgataacgtattagagaacaaagatgaacagtgaaaaacagtgaatcctccaagtcttattaatctcaaaatgtccccttttatagtggggatttacatatgcacaagcctaggatactcctaggaatcaagggtgatttaagccactaaatatggctgattatgtgtcacaaattcaccataatatggctgttacaagtcacttgaatcctgccattgttgctctttgatgagtctttgatgagatcaaaaatgtctcatgatgcttttgtaacacttaactcctgcaatttgcatcactgctgaaggttgaaatacgcatgattctgaattctaatgagttatgaaagtaactgaatcttctgaattctgtagcattcaggtcttgtgcttgtctgtctatttggggaactttgatggtgccaacttttgcatgcagaattccagattgcttgaaaattttccattgccaagtttcccatattgattaatactccgtactatttttcttgatcagcttgtatggtggtgatgcagcaatagtaaaatagttgtgtcgctgaaagtagcctgaaataaacgaaacggacatgcagtggaattcggcagacttcagactttcagagttcagacttcggacatccaattttccttttctttttggatcgggctttgttaccgtttacgtcggcgtggcttcgtcttatgagtttccctcgataaactgctggtcttaagctcggtgttcacggtaacaatgtcaggttttcaccggtttcctttaaaataccttataccgttataagttcttttaatccggttccttcaataaacgagatcaactctcctcttcttctaaagcgaaattgcacgttcttttttcatattttccgtttgagcactgctacacgcactaaatttctttttacaaaactcttataaacaatgatctcaaccataatataagtagatgaaagatatataaaatctaaatgtactcataacatgatatgtagtgttagtaaaagttcagtaagataaaattttaataagtataggacttttcctttctgggtttttttttttttttggcaaaaacaaccccgaaaccactggaaatagtagcactgagccacactaaccagtcgtctccctcacaagtcacaactccagctaccttcttccttccgctatcccccagccttctctgccgctgcctccgccgcctcgccacgcggcggccggcaagcagggccccgcagccacggcgtgggcggactcctctcctttccccccgaccacctccgccctcgccttctcaggcctcctcgcgcgcccggccggcgacggcgagcatctcggctcgaatcgaactgaaggtatccgttcttctcgtctccctccctcctctgcgcgccacttcgtgtgctggattgggtagattgggactcatttgaactcgaatcgatccatttcgctccaattagacctcccagttcatccccatttgcttcgtttattgcgtgctttggtgaagcacttactaatggcatttttttttttggaaaaaaattgggggttcagttgaatctgcatgctccaggatggagatcgacgggcaggagcctgggcacgagcacgacgggatgatggagccgcaggtggtggacctcgaggaggaggaggaggacgacagcatcaacttctgggcctcgctgggcgtccatgccgtcgaccagatgccgctgcacggcggcgtccagatcgtcgaccagccgtcgccgccgccgcaggagcaggcgcaatcgcagtcgcagtcggtccgcaaggacctgttcccggtcgactccgacccctgccttgagccccgggttgggatggagttcgagtccggcgaggccgccaagaccttctacattgcctacgcggggcgcgtggggttctccgtccgcattgctcggtcgcggcggtccaagtgtaacgagtccatcatcatgctgaggtttgtctgctccaaggaagggttcagcaaggagaagcatgtcgtcgcggggaagaagacgaggaagcggcctgcttccatccgggagggatgcaatgccatgctcgaggtgctacgcagaggcgatagcaagtggattgtcaccaagcttgtcaaggagcataaccatgaggttgggatgcccagcagagtgcactacattgccatggagggtgatacggtggtcgacccttacattggtatggagtttgaatcacttgaggccgccaagacattctactactcatacgcgacccgtgtcgggtttgaagctcgtgtgcgtcagtcccgcaagtcgcaagatgagtcactcaagatgctgaagcttgtgtgctcaaggcaccgataccattcaggaagagagaccaatggaggggatcccaagagagtgcaggccttggatccctccagggatggctgtgatgcattatttgagataattcggaaagacagagatgcctggacggtctctaaactcatcttagagcatactcatgagctgaacccggcaccaacaagtagagttcgctgtattcgctcacagggtgaggtacttgttattgcaaagaacttctctgacacacgcaatctcctattgaacggtctagatttccagcatcctagagagttccagtataatgatttagggccagaggatgctcaaagcttactcagatatctcaagaacacacaaagcgaggatcctgcttttttctatgctgtgcagcttaacagtaatggacacacagccaatattttctgggctgatgctaaaactaggatggcttactaccattttggtgatgttgttaggcttggtacactgtgcagaaacagcaagtatatacctattgccatattttcaggcgtcaatcatcatttgcagcctgttgtctttggctgtgcactaattgttgatgattctgaagcatcgtttgcatggttatttgaaaaatggcttgaagcaatgcctgtgggccctcctgtctcgttggtattagagtttaaccaagaaatggctgccgcagctaccaaaatactacctgatactcattgtacgttctgtgagaagcatattttgggcactgtcagggaagagctaggaagtttgtatccagaaccagaactagaccatttcattactgatctgagaaagtgcattgactgctgcagattagaagaatcatttgaatcatgttgggattctgtcatcagaaaatatggcttcagaaataatgaactattacagtctctatatgaaattcgcagacaatgggcccctgcatacacaaggaaggtattctgtgccagaaatctactgccacaaagctgtcagaatcttgaaaatgttatcgagaagcacttctcatccaagacccagttatgggtggccgttcagcaacttggacaagctgtttgtaatttttatgaaaaggaaactcaggcagattatctgacaacatttcaaatggcaacagttaggactgcatcacctcttgaaaagcaagcaagttcaatattcaccaggtcaatatttgaaaaatttcaggatcagtttgccgag

SEQ ID NO: 55559 - DNA, 861 bp, Oryza sativa
gtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaatgaaggatttgtccatttcgggatacaatgcgcatgactgtcataggttgctaacggtgttcctaccaattgctataagggcagtcaaaccagtccatacaaaggtggttataacaaagttgtgctactttttcaatcgaatttcgcagaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggaattcctgttcatcgacatgaaggtagattgtctagaaggg

SEQ ID NO: 55560 - DNA, 1540 bp, Oryza sativa
caggcgcttctagtgaagaaacatggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattaaccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcagtctgactgggacacgtttgttgcggatcatacaacagctgaagcattggctttgaggaaaaaaatgtccgagctcgcgaagaagaacagatatccccatagattggggtcgagcggatacgctggtcacgtcgatcaatggcgggagatcgagcaaagatttgccgcggccggtaagcccctgctggtagaccccatggttgaacgtagcaagaactaggtttgggcgcgcagcacaggtcaagtctcggatgagggagacatactattcgagactccagacatagaagaagtgactactaatttgcagcagatagtcgagaaagaaagatcaggacaattcgtcccacggagggagcgagatcagcttactgcggcgttggggacggctgaacactctggacgtgtaaggggtttgtcctcaaagacaagttggaaggtcgggtttccacaagacgcacccagttataagaagagagaccaatacaaagaaccactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcatccctgaggattacgcaagggtacaggtcgccaaggtccatagcgaccac

SEQ ID NO: 55561 - DNA, 1367 bp, Oryza sativa
aggagcaggcgtggtatctataacaagcaagccgcgcaggaatgtgtcttgaaggcggatggtggatgcacccgcagccatacgaagccgaagcttcatcaccttccttgctcacatgttcttggcttctagctgccgccggtgattgtggcacatctcccaatgtgtacgtctcaaattatttcaggaaagaagcagtctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttagaaaataaaatgctgttgtgatgtgatgagtgttcagactaaatacttctatcgtgtaatttcaattgaatgttgttgtaatgagtaccttcgactattgttgtactagtagtattgcgaactattcggtgttgtatcataatgttatcgtgatgagtgttcggactaagtactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatagcgtacgacacaccggcgctgttcaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagt

SEQ ID NO: 55562 - DNA, 845 bp, Oryza sativa
aacatcgatccctattcgttttgcatcactctctacgtactactcttccattaacttttcgcatgatgtctgactatttatcttatttaaaatttagtataaatatgtaaaagtataaattgatattagaatttatttgatagtaaaaaaaagtcacaacaaaataaataatatttatataattattataataaaaaaatagtcaaatattatatgaaaaatcaacagcgtcatatattttgagacataggagtataaattaattaaagcttatcgctactactgttgctagctgctactacgactgttaattgcattattgccatttgcaaagttctattctgatctttgatgcaaaaggaatttgtacgcaacacgtgccgtcgagatggcgatgcatatatatgtgatcaacagatcgatcaggccacgagacttccatgagtcgatttatgcgtctgtttgatcctttgatgccattttaattcctcccttgaaaattcagaggttaataattttggaatcgtaatagtagtacatattcccatgtgttgatcaacaccatattcccacagatattaacttttttaattacacggtacaacgcagacacccataacacacacctataagcatcttcgaagactgggccggtaaatcctggagattgacgatgtcggtgatatgggcccgggggtatcatgtttagagggaggaggccgccctcaaacccacgtggcgtccccagaggagggtggcgcccgggaggagcggcggccgccctctcagcttagggtaccgaatttggagcgaggaggctgccccctaacccacgtggcactccc

SEQ ID NO: 55563 - DNA, 822 bp, Oryza sativa
ggcagctgtctgcaagttgctctcttccgttgctctcattgtcattgtctaatttttcttcaatctctgtgaatttgacaaaaaaaaaattcatagattgttacatggttaaagattaatctccgacccaatcaatcatcatcaagacttcttcaactagaaccagaagaatcctcttgttgtataattgcataaaggacacaacacaaacacaagaattgcaggaagagaccctctgattgtgatgcttggcttttgggctcggatagcgctagttccaatcacaaccttagccgaggaggggatcaggagagatgaggggtaggaggatctcacctcagtggcgatcgggagctcaggcctgccttgactcggggtgacacgcaccacctcccacctcagcgtcgtttcgttgtcgacgtcgccgtcgacggagacgccagggcggcgagccaggaaggtctggttgccgcacaggtagcgcccggacttgtcgtgcagaaggacgacgcagccgccggcaatgtccgggccgcgcgccacatgatgacaccgacctgatccagcacgtcgcggtcgcgctgtgctgcctcgagcgagcagcagcggtcgcgctcgcggtcggggccttgggggagtcgggggacccgaggtagcggccgtaggcgccgcggaggagcacgtaccgcgtggggtgccccccggcgaccacctcctctacggcccacaccgcgttgtgcagcgaggcgccgcccccgccgcgcaggttgccgtggtagacggaccgcccgttctcgtcggcgtggaggtacgaattgcagc

SEQ ID NO: 55564 - DNA, 1094 bp, Oryza sativa
  unsure (1)..(1094): unsure at all n locations
agaatagcagcagcacaatgcacaagcatcttttctctgtatacattgcacttcaatcccattgtgctctgtgactctgtcctcaactccacantctgcaaaaagggcnntttggtgncatctgnngcactnntccatgcaagnaacttactctaggcttctcttgtttacttttttatcttggacagatcagctgaattctgtttgtgaggagcctcataaaaaaaataccacttcaatttggaaagctttatgaggagattaattaattaactaaaattgctatggatgacaaaggagataactgaatcagcagtggcatgaaaaaaattgctggtcagagccaagctgcagctgctgcagggtttgtatagtgttcttgtattgtacagggttgagggttccaactccctttactagcactagttattattacatgatggaacatgtcatcatctcatctctgctctcttatacttaattaattaactctcttcattaattaatcactcgattaagctataaactctctgggtgaagcagcagcatccatccaagaaaattaagaagaaatgaaacttaattttccagggttaatcattaattgacccttcttgttcttgtcttggatggatcagcagctctagctagatggatacttggatagctgacgccgccggcgatggcgatggcgacggcgagcttcaccttggcttgaggcggtccaaggcgaggtaggcgatgacgcggtagccgacgaggaggagcgccatgacgcagacgtcgacccagtggttgttgagcccgacggccttgatggccgggaagtcggcgacgaggcagcgcgcgccgccgccgccgcagtcgtagtgggcggcgccgtcgccgaactggatgccgatgaggaggcggtagcagtagaagctgtagttgagccaccggagccagccgacgaagggcgggatgtgctggacgtagtagccgccggcgatgaggaagaccatggtgatgacggaggcgagggtggtgccctgcttgacgtccatgagcacggcgccaatggcgagcccgaagctctgggcgaccaggacgct

SEQ ID NO: 55565 - DNA, 5284 bp, Oryza sativa
cctccccgccaccgccgccgccgccgccgcgccctgaccaccaccaccgcctccttcccgcgcgcagatgtccagcttcaccgccggcgcaatgtgccgctcgtacgccgccgccagcttccccctcacctccttcagctccgcctcactccccccgccgttcgccgccgccgccgccgcgccaccaccaacatccccatcaccaccaccgccgctgatctgcggcgcgatacctgcacgagcaagaagagagagaaaaaaaaaaaccgcacgtgagaccgtgagctcgacaagtgtcccgccattgttcacaaaagatttggaggtgcaatacaatcatgagcgcgcgcggcgctgtcgggcgcggggaacgcaaatgcgccgcgccatgattgggcagctgctcgatcgatccatcgatcgagactcgagagtgcgccaagctaagtgtgtccccatccatgtcccctgatctccacccaactaagctattgcggctgccgatcgatgccggccggcatgccgctatcgctcgctcgccattgcgcacgcaatgtaatcaaacactaccgcgacacgaacgcgtgatggcgatcgatgatcaagtgtgagggctgttcagattaatgctattttaaaatatacattttttttaagttatcaaagatatgcatacatttattttttttaactttggtaaatatataagaaatccagctaaaatttcagcaatattattaacttactaaaattttggtactagtttattttgactataatctaaacagtctataagtattaagtattgctatcgtcaggggacccatggaacggcatgcgcgcaccgtatcaaggacacaatctctcaaacacgttggctcgtgcttctcttctcagtgctcaccaagctcaccctcctctctctatctctgcttatgcttttctttttctttacttattaaaaaatttatgagcccatggtatgtgtaagtataaattgtttgattattgctttatgttcacctttttgcaaggtggttaactgaacaactgtggggagaattatatattatgaacaagtgttgaaggatctgattcctctagcttttttatatgggacgaattgtacgggagaataatcctgtgaggccctgtttggaatgtggggaatttttcgttttctacaggaattgaaatgtttgcttgtgaaatttccgcaaaatccgtttatttgagggttaattagactctgtattttcttcagtggttggactctgtttgcagaaaggtaccctcacagaaacaacacatggtataattccaattccaaagtataaccaatgaaaaaaaatgctaataaaatggaatatgccatactgtgaattgagtccagttaaccacacatgtatgtgacacaaattcttatagggcgacctttcaagatcactgcattacttttcaagctcaggacttttagctgataatagtggtgactaagggctacgagcctatgatcaagtgtatggtacatgttctaaatgtcatggagatgccaagaactgatggttgcaatgcttgaaacgattttaaaaaaaaaggaattgatgttgttgccgccatgttgggaggcaaaggggagaatcctaatgacaaactactgaagggtgaaaatctacacggatgctcgtccatcgtttacttttcagcttataagtcgctggaaaaaaataaatattaaaaacttatttttagagttggttttgggaattttcatcatagtttatttttcaacttccgcttttatatcgctaagaacatttataaaagttttacctctaaattattctttgatcacttataaaccgttacgggcttataatcagctataggcgaaacgttgaaacacaaatgtgtatcatgatttttcgacgatataaataaaccttctaaaaatctatgatacaaattcttctgtggtaatttcgccgatttgttggacatatgacgtgagcgttaggaatagagtgtcagatgccaatatgccatgtgaattggagagcatcacaaaaagttagagagagagaggaagagaagatgaggaggaggagagggaataataatggcgatcgaggagtggggatcgatggcgtacgtaccgttggcgaggtcgagcatgaggtcagccgggttgagcgacagcggcgaggcgaagccgactgaggcgaagtaggagagcgcgtcagcggcgaggccgtagtagatggggcagccgtcggaggagaggaggaggaccttgtcgaacatgtggtagagcctcgacgacggctggtggatggtcaccaccacggtgcggccgccgccggcggccatgcggcggagcgtgccgacgatcctggcggcggtggtggagtcgagcccggaggtcggctcgtcgaggaggaggaggctggggtcgacgagcatctcgagcccgatgctgacgcgcttccgctcgccgccggacagcccgcgcacgccgcggacgccgccgatcatgctgtgcgccaccttgccgagcccgagctccagcatcacctcctccgcctgcgcgcgcttctcgccggcgccgagcgcgcgggggagacggagcagcgccgtgtaccagagcgtctcggcgacggtcaggtgggggtagagcacgtcgtgctgggtcacgaacccggtgcgccgcttcaccgcgccggagaacggctgcccgttgtaggtgatcttcccggacagcatcccccgcccgccgccgccgccgccgccgtgccggccgcccagagcagtcagcagcgtcgtcttgccgctccccgacggcccaagcatcgccagcatctcacccggccgcacaaccccggacatcccgctgatgatcgtcttctccttcgccactgccgccgcacccttcttcctcctcccctccccgccgccgccgatcgccgacgacatcctcgcgcaccaccccgccgccggcttgccgatcttcaccttgtacaccacctcctcgaactgcaccaattatcacaaaaaaaaaagcatggtcacgtctcatcaccaacctccctcatgcacatatgtcaacatgctcatgcacgtagctctacaagtacgtacgtacgtacatacatacatacccctccgtcccaaaaaaagatcaacctagattcgtaactaggaattcattttttttgacagagtagtatatatgtatatatacacaaatgtgtacttgtctactcaccttgaggacaagagggtaagagttggcggcggagtggtggccggaggcgacggaggggtgacttgaggtagtggggtggacgatggcggcgccggaggtgttggtggaagaggacgacgcggcggtggcggtgggagaattggtagaagaagaagaagaagaagaagaagaagaagaagtggttgaaggtggagaactgaagtcgcggtggtgaccgtcaccggcgccgcccccgccgctgccagcgggtgtctggtggtggtggtggcggccatgatcatcgccatgcaactcctgaggcggcatggcgatcgatcgatggatgaaaatctctctgtctctcgggtgtttttcacacacaagccactataccaacaccacagctagctaggctgtgggattggatgctatactactacagctgcagtagtggcagctagtagctagctagcttgatcgagctgagttgacacacaaccttgtgatgatggtgatgatgacgatgttgaaggagaagggatgaaggagagggctttgccttctcctactacttcaactaggctatctcactcccaagtgaagtgctgtctggtttttggcttggtgattgcaggtatatttatcatagctgaagaggagagagagagagagagagagagaatgtgaatgtgtttgtgtgtggagtgggggtgaattggcaaaggcaaagaaagaaagggagggggtaagatggacctaccaaatggggcaggggagcaacacttgttgctgtcactttttttattggctagctaggatggcaattggcaaaccctataaatttattgttagttactacccagtaatatatgtgtgtagttttttttagtgattttgtatatagttgattaacaatttgtgtggcgtattatctaaaaaaagaacaatttgtgtggtgtgcaaggtaacacaccactagatgcatatgctgatgatatccattagaagttacaaatggtggtggtagttattgttgaaacctgaaagggagtttatatcacccatatggtggttttgtagctctagcatggtgtggactgtggatcatctcactttcttttcaaagatattagagaaatattactgatgtggtgtagtgcgcataatgattaaactgggcagttggtttgcaaatgggatctaaatgtaaatctggttacaacttaccccaacaaacaaacattctagtaattaggtatatttacacgggatcggaaatgtttgcaagattgcaggaatagagatacaacttgtagcccacaatggcagccatacacaagacaacaatgattaagatggcaggaaagtgatgtgagttaaaatttttttagggaaatgacaaattacatacacccaagagaaagaaaggagagaaacaaaaatagtgcgatcttgaaggagagaggaggaacagagaaacttaaactagaaaaagaaaagggaagctctacttgttttatttgtgtacttgagactaatgaaagtcatgtgtggattcgcacttaatttgccaccaattttgctgcttaggcttcatcatgatgtcctgccattaattgttccatatttaaatagatatggtagcatcataactgtcacttatgctaacaacgttattaaggcttagttcgaactagattgttggctcggattttaaacagcacagtaaacaagatagcattagtattattgagtatttttcaaacttaaaaaatagatttatttatttttttaaaaaacttttatatagaaaatttttacacgaaacataccatttaattagcagtttgggaaacgtgctcatactaaggccgggtttagttcccaactttttcttcaaactttcaacttttttatcacgtcaaaactttcctacacatataaactttcaacttttttcttcaaacttacaattttaacgtagaactaaacacaccctaaacgagggagagaccaaacgaatagtgtcagagaagtggg

SEQ ID NO: 55566 - DNA, 1186 bp, Oryza sativa
taactatttgcatggtcattcaaaaatgacatgccaaatatattatatattcaggactcaggaggggatccccgggtgaaattaaaagaaacatttcactacacaatagacctacaggacaagtgatacacacaccttgcctttcgcgattccttccttcgccagagccagcagcgcctggaaatgcccttccggatctccactctcctcaaactcctagcattcaacaaagcactaattacataaaccaatcgcgaaaggcatgtgccaatctcagatgccagcaatgaaacaggaatgatacacaatccacccctaccccacatctcgtcgggtgcacgcccaccgtgcagaacagcctccctgcatcgtccaagcacatcacagcttctcgggcacattacaacaaacaccttgaaggcaccaagcataacatagtcaaaacaacccgcatccaagcagctgagctcaccgtcagtctcggcgatctcgagcacttctctagattccttcagcgagcctccggtgaccttccgcccggaccaaaccaaagaaagcaagagattaagcacaccaaagctgagccaaaagaaagtagaaacaaagcaagaaagaagcgaaagggggaatggccggcagcaaagcagcgtacgatgatgcggtcgacgccggccgcccacgcgcgggcgatcacggcggggatgtcggcggcgtggcactgcttgccgtggtagatgcccctgaacatgccatcttcagttcgttcgcagcagcaagagcaagacgccaagacgcgagtagaaagcgtgagagccaggcagtgaaacgcgaaaaacgagataagagtcgggaggaggaggaggaggtgggtaccggtgaagttgacggcgatgtctgctcgtcgcggtggcgccggagatggagaagaagatgagaggaggagtagaagaaggccgggtcagtccaggtaggagcatgagagccgcgagcgagagagagagagagagagagagagtagagcactcgccgatgagcttgacgccggtggacgccatcgccgccgccgccgagatgggggagagtccgaattgggccgaggccggtcttcgtgtttgggcctccaaggctccaacaaaacttgagtttcgtctcgttcttttaattttctttaaatttaaatatataa

SEQ ID NO: 55567 - DNA, 2872 bp, Oryza sativa
cagtactacttgtgtttgtctcgtctacatagttcttttcattcatatggtgctagaacaacttattctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacacgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggtcaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactagaggaacaatccattagggttacctaaatggtccgagcgtccaaagtgtgggtgcagagatcgctggcaggtggctacatcctttgctgaacaaacatttggaaggagatattttgtctgccccaatgtagacaacgatttcgttgtatgtctaaccatttacaaaatccgctatgatttgcacaaaattactacccaaactgaataacattactatttttacagggcaatccaaggatgtgtggatttactcgatggatcgacaatatcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttttctacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttataaaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgttaattttcaaaatgaaaaattatttttgtaaaacttttaataaaaaaaattaaaaataaaaaaaattcgtgagttagccggggggttatagttggccatatgggccgcccggcatggcacgggccagacctggtcgtgtccggtacaagatttgtcgggccggcacatcccaacctatatgtcgggccagcccacgtgctccacctctgtgccgtgccgggctggcccgaaggtacgggcaacccatcgtactatttttcaaaataagtctatttctcctccctcttctttgagttgtgacataataggaaaaagtacaccaaaggtccctcaacttgtcattgagttacaaaatcgtcccccaaccgcaaaaccagatataaggcatccctcaacttacaaaaccgtccgctttaggtccttcggttattttgccctcggttttatccgacgtggcggctgagttagcgttggacccacgtggactccacctgtcagcatgacccacgtcatcaccatccttctccctcttctctcccttcctcatctctctctcccttctgtgcggcagtgcgaggcaggagaggaggagg

SEQ ID NO: 55568 - DNA, 2713 bp, Oryza sativa
tcctcctcctgatccatcccgatcccgtgcctaccgccacagccgccattcaacgaccggccgccgccaccatcaccgcctcgtgggcctcgtgggcggtgggcgacagccggtgggggagcccgcgcgccgctgctccgctaccgcatgcacgccacccctcccccgccacctgccccgcaactcctccacccatcatcgtcgcgtcgccagtcgctgccgtcaccgctgctgcgcagcccgtcgccggccgccaacgccctcctcctctcccccctcgcactgccgcaaagaagggagagagagagagatagatgaggaagggagaaaagtgggaggaggttgatgacgtgggtcatgctgacatgtgggcccacgtggggtcccacgctgactcagccaccacgtaggacaaagccggggtcaaaaccaccgaaggatctaaagtgaacggtttttgtaaatggcgggatgtcctatatctggttttgcggttgggggacgattctgtaactcgatgacaagttgagggaccttcggtgtactttttccgacataatatatatagctaaaataagtctattttacgtccctactctttggaccgtgccatataatacatctatttatctaacgatcagaaaattgactgaaacgaaataaatttagtgccatatctgatcacgaaacgatcacaaataacaacaaagacacaactcaaaagatcggacacgtattcgtatgattaaaagccattttattatattattgtgtcattaaagcagacctgctattgaacatgataaaacatttatccttcctgatctagctcagttaagagtaaagtagggcctcaaatcattgctttggtcagtgatttgaggcccttggaactaaagtgtcgcatgactaaagcacccaatacatcatttcgctgttgagcttgtacatctcagacctgtgcttcagcatgcggagccctccaccattggcaccaccagcatcgtcgtcatcatcgcagcgctccacctcgacggcggttaacacggcgaacagctcctcgccgtcacggtgatcctcatcggtatggaagaacctggcgatgcagaacttgccgtgtccaaggttcacgaggtatgagctttcaagattgagggcgtcgggcggtgtgaactccagaggaaggcggtgaagcaccggcagcttcgagccgccatcgaggtccagagcggagaggacaaagttcctgctcatgtctctattgctgcgtgagaagccaaaccaaaggccgtgctcatggcaatactcggcgagaccggtaaatggcaacgtccagccggtggccactgtgctccacgcatggctcaccgtgtcaaagcagtagatgccaccgccgtgcgtggacatccagatctccgtgtcaccgacgacggcgtaggagtggacatggagatcggacagcggcggtggcggcggggggagagcgcggcatcgccaatcctcattcaatccatcctcgtagatgagcccatagaagcagccgtcgccgtcgtcgtcgtcatcttcgtggcgcggcatgtcgaggatgtagaggtcgtccccgacggtgacggaggtggtaggcaacctcacctggtagggaagggcgggcatggtgcggacggcgtgctcgccggggtcgtagaggacggtgcggcaggtctggtcgacggcgaccaccgcgttgctgtgattgcctccaaggaggaggaactccatcttctggttcgcaaacaacttggagaagggagggtagaaggtcatggctgggcatggcaggctagcatactccaccgcgtcggcggccgacgccacggatggcaccggggttggacgtggcaggaagaagcgctccatgtcaatgttgcgcagcgtatagttgctgcggcggcggccaaactcccccagcaccagataaacaaaccgacgggtgctcatcataaatcgatcgatcgatcggattgaattgctgtggatcttcttctcccccaccacaaacaactaggctgctactctgaagaatcagaagagagatctagatcgatgggtgcctcccacccctttgggttagggttagagacagatcaccggagagaaagtattagtagttttgaacagaaaacctggtatttatttatcttcgttttggactaaaacttcctatcccaagcgaagccaaatgatctttctcgttgcaaatctcaccttagcagagagagggagtggggggagccgcccaaccgctactccgcgagcgaatcggagagtcgccggcggcggacagacgacgggacggggatggcggaggaagagagagagagaggtggggagggagttggctccggcagcggtcgttctggtggcggcgcccggggagcacgccgggtgggaagggaggaagaggacggcttatagttggccatatgggccgcctggcacggcatgggccagacccggtcatgcccgggacaagttttgtcgggctggcatggcccaaactacatgacaggccgggccgtgccagcccacgtgctccacctccgtgccgtaccgggctggcctgaaggcatgggcaccttatcgtgattttttttttgaaaaatcatatgctttaggtccttcaacttacaaaaccatccgctttaggtccttcggtggttttgaccccggtttt

SEQ ID NO: 55569 - DNA, 1310 bp, Oryza sativa
acacatatttctacctagtttacaatgaacagtaccagtaatgtattgcaggaattaagcacattcttgtgatcaatccatactagacatagctaattgtcacctcaatcaatatttttgtcagaagtcaatttgcagggtgaaattagagtctgtccacttcttttccaagatgtgaatttacagagttaggacttggtaggattccaaggtggaaatccatcagtccttcgcccggttgttcttaagttttggaactaatactcaagcaactaactggattcagcacagcaatacagcatgcagcatctgcaaattggcaccgtcaggattcccaaatagatggacagggacacgccctgaatgcttcagccttcaggagattcagttactgccatcactaatcagaattcagaacaccatgcatattctaacacacatcagaattcagaacaccatgcatcagatttcagaacactcgtcaaagttcacttatcttgaacagtatatatttcagtagttaagcacattcttgccatcaatccatactaggaatgaatactaattgtcaccatgaccaatattttcgtcagaaaaccctgttcacaaagtacgtaaaccgtggtaatacacccattgaacaccctgacaatttgagatttttcagccactctacagctgagcaaacatgaaactgtattccagaatcggctgaactaaaaatttcactcaatatgtctctaaccaacacactaatcttctgtcgagttccctgagcctgtcaaaacttcagcacaaaaggattcactaaatcaatcttggttcgccttgatccatttgacagcaatttcactgacatttgggaatatcaactgattatccgctgcagccatagcaaaggaatcacgcagttagaaatcattgacagtatgatacacaagcagtacaactcttgcaaataaaaacggtgcaagtaaatctgcaagtaaaatgttactcgaaacaagttgaacttcaccactgaactactgatatgatcattttcagagcaagttaagcagacaataaacgcttgaactggttttagaccatgcattttagttgtgcctaacaacaatagtagtcgttagctagaggcacatagtattaactactactggttctgcttgtctgctatattcagataagtcctattgccaagatacacagaattagtgcatacgattttctggtaattcctaacatgaaaatttgtcagataagttcagacataatttcacttcaaaatttatcagataagttcagacata

SEQ ID NO: 55570 - DNA, 740 bp, Oryza sativa
tgatgatttgtttgatcagcttaaaggtgccactgttttctccaagatagatcttcgatcagggtatcaccagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggcggtctttattgatgatattcttatctactctcgaaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaagaatcgcttagtatcagctcctattttgactttgcctgatccaaagaagggtttccaagtgtattgcgatgcatccaaacttgggttaggttgtgttctgatgcaagatgggaaggtggttgcct

SEQ ID NO: 55571 - DNA, 767 bp, Oryza sativa
acttattcggcacaactgagtttggctataaaccaaataaacccttaatctcatgatgcaacacatgcacatgtgggtatttttagaacaaggctaataatacaaccaatctgttggctataagattccttgtagtcttttcttagcctacccatataatagttagctctttacaattaatacatgacccacttatctctctcacttaatttcttagttcttgtatccaagacggctgtaagtttacaggccgcttctcctctctctcctctcttctcttctccacctcagcatttagctggcttatagcctactattatatatttgctcttagtggtaaagtgcgtacgctagtacagaaagtgcaataggtgcactatacgtataggcgtaagtacacgtggtgtgcttaggcgtaagtatatatgatgtatgtgcgtcctatctatactcacagagatgtgcacggccaactaatctgtactcacatttccaccaagattaatgggaacttttactaaccatagatagtgcctaaatacactccttcctagtccaccctgagaaatttattatcacttccaaaaagtattaatatctgtgaaagtacgtgtaacctagtggttacattaggtcctaggttcgactactcatgagagcaaattttccaggatttaacggctttgtgtttttagtggtagatgacgtacctgtcgacagcagacacctatggtgacgtgtgcgtgcgttatgaattttttaggatt

SEQ ID NO: 55572 - DNA, 900 bp, Oryza sativa
ttcggccaaggctgcgacggcgccgccacgtcatcttcgccggagaccctttccatctgacctctccatccgtaataagtatcaagttcatgcatatattgcatatatacatgatgacatcaatcatggagaccacatccacaaccgttatagtaacacttagctaaaaacacttacaagttgatcaaacaaccaaaacttaaattacaagctcttctgttctgtctatggggaggacaggtggccaggcaggggctcccaatgcttgcaagctagctcctaatttcatcttatgagttaattcctacgcttatgtgcgataaatccactggcatatactaagaacagaaaattagcaaggaaacgcatcctccattgtatcgtaaattcttcatcagtactgcaaagcacaaaaagagaaagagagagaaatgttatgagactgcaaaatttgtacttgagcaacataatgaacacacaatcaacatagaaaaaaacaagtagagcgcatgggctctagtatatgatttacttactttggctctggagtccttggatgccaagattgacgaaacgaatggctgtccttgatgatggaactggatgaaaaaggtatcttagccccattaagagaattcacaaatggtgtactcgtgtggttggttttagccaaggccatgccagttcttgctacctgcataataaagatgaaaaccacaagttaaataagcaaggaaaactggccagtcacatatgacatgtcgggacatgcattggtaatcaacatgatgttgaattgccacttgtaaaattcgggacatttaactttttaccacttttaagatgtaacaattaaggatttgccactcgaagacttaaagtctataacatgtgcatcat

SEQ ID NO: 55573 - DNA, 2136 bp, Oryza sativa
ttgatctgcttgtagacttcccaagttgtgtcctatagtgaaatgttattgcaatcttgccatatattttgcttgaaaataattgggctcactgaattttgtttgatctgcttgtagacttcccaagttgtgtcctataatgaaatgttattgcaatcttgccatatattttgcttgaaaataattgggctcactaaattttgtctgtagttcttatcctatcttcctatatagttggtacccactaaggagcatttactcctataaagcaagacatgcaagaagccacatcatcaataattctaagccatcggatcacattagtacatagttatcagctgttggatcaagaagctactcatccatctaatttaatcattgattactcatccggtcatctccctttagatcataatcacacgtgacattgttatccattcttcacataatactatgttttctcctcccaagtcctccaagataatggaaacttatctcctttatttaatacaactcaaattattgtataacatgtgagttttgtttttgttataaacaattggataacatagaataattaggcatcattaacccaaacctattgttgaaacaagcttgagataaaagcaaagaggttcaaactaccctaattatgacgatatccagattgtgcaagaaaataacttccgtatatcataacaatacacaatgatgttttaaagaaaaataaaacatgaattgtttgcatattttcaagcctgagaaccatatttctctatctcagattccctggtggtgttacacactccttcactggaactgcagaggaccgtgataagcttctttcctttgaagatgtttataggtcatctccctccctccccttgatgttacatatttgcacgtggtgcaccttgataattatagaacttaagagtaccacaacacttctatttgtagtcaaagttcatttcaatttctgctgcaagttcgttcttttttggtgaagatctccatttgggcaattagatgtgaataaaaatattagtagcaattaaaacgttttcattccattataattcagttatgtcaggtaaactctaataaggttattgttcagtaagcatttgactggcctgcaatgcatgaacacctgaagttattatttgcttttcatgctccttttacttggttcttttcctgaggaaacacagtagaagtaatgctcatcattctgagaacattaaactattttgttattaccacatgcttgttgaaatgtcttacttgactaataaaatactgaccattggcagttcaatatgatgttttgcagatatttatttggttagcattttccatcgatgcagaatcatttgcccagattttaagctaaatcaatttaaattcttatcataatcaatcatgaatctttcgatggaacggaaattgatttcatcaaccttttcttttgtttatactttacacttgcacctaactttttccgccaagaaaattgataactgaagatacatcaatcccaggcaagttcttgaggttgtagctggatgcaaaggaatttctgacattgaaggcttaagtaaaactctgtaccacaacacgtgcaggtaagctgtccgtgcgtcatgccgaaactttttgctgtctggtccaagtactcatctaatgcagtcaatttctctaaatttcacgagtaattttgcccttgatgctacagctctgcacgtctccaatttccatcagatcatgttattgagctcaatctttcatttctctgccttgcaggttcttcttccctcaggacctggatgcttctgctgatgcacagcttgagagtggtgcggctattcaaaatagctgatgggacatgacagagcgtttgctacttaacagtttgctacctttttttgcttggttaaagattttgtactttgacaattgccaaattggcatgctatgagagtgtcgttcatgttctacaaatgttaataaggaagtgaatctccactatatctactataactgtcaaattggattactcaagtatagttatattctagaagtaatggttttctaaaagtagacaaattgaagaaaagtacagaaacgaagtat

SEQ ID NO: 55574 - DNA, 3929 bp, Oryza sativa
ttgcgtgcatctcggccgtccaaaacgaatccgaacggctgctttacttgggcaaaacaattgccgtttcagcctaacaggaggccacacggcctgagacgtgagtggggaggcaccagtgccgccgccgcgaccggagaggcgctaggccgccctgccctgccgccgcgaccgggggcgcgtggaggcggctggccggcaggactgatggcgcgctgatgcaggcgggcggggccccagcccgagcccggcgcgtggaggaggccgcggtgctcctgccggccgttgggaacacactccgcccgcgccgcacctccaatttcggcagcctcgactcgttgatggagttcagcgtccaagcccgcaccggtcgaccgcccacgtcgtcgccggcgaggggggacgccgtcgcacggcttcgtccagtggagaacgctgcaccgtttcctgcgcccgcgaggtgtttgtggaaatgcccccgaggctgtatggttctgtattgtgaaatgcccctgcccctgctctgtggttctgtattgtgtggttctgtgttgtggaaatgccccagtcctgccctgctgcctgggatgatgcagactcctaattggaagtgaattgttattgtttggcattgtgagtttttgcaaattgattctgtaatcttgatttttgtcataaaaaaaaggtgaaacatgattcagcagttctgatctgctgaacagggatatatgagaacctggttgcaaatgtctaatttggtatatgagtgagcatttcagtaactgcagaactgcagattgtatgacctcagaacactgcataataatgtggcaagtttttacttataataggagtatgtgagctcattaatttcagctgaaattgaaataagtataattggagtatgtggcaagttttatgtccattagcaaatatcttattcttcaatttttccactgaataagtgggaaatgaaagcagtttagttacttgaatcaatagaaaggaaatgaaaatggtggcagtgacatgtgcctattgaaattaactatagattgaaggaacattcatgttctgaatcttccaaatcagtgaaaggaatgtgggggcgccagtccatcgtagagcattgtaaattttgtgaaagaacaaatcagaagaattgtttctgaacctgttcagatcgctactgcaatcaagatgaatctctccagtttcaaaagagtctgaactctgaagtcacactgtgtctgcatgctgcaatgtttcaaaaaaaaaaaaaagaccaccatcatacaaatcgctcaagataaaatgcaatattgtcaagctatcggtctgcatgtcaatagtgaactatcctagactcgctgagtcatgtgttcttcaccttttgatctaacaattggtttagggtagataatcaccgtaacaagtaaaagcagctactacctaactagattccacatccgacattactaaacttcaagatattcagttactgtcgtgacagaattcagaacatctgacaatactaagtgtcactttatcaatattcctgtcagaagtgaatttacaaagtgaaattagaatccgtccagttcttttcaaagttcctagatattttcgttaagcacactggacaggggcatgccattactcatcagaattcagaacgatggtcatatttctacctagtttagcaagaactgtaatacatattgcaggagagttaagcacacattcttgtcatcaatccatactaggcatgaagactaattgtcaccaaaaccaatattttcgtcaaaaaaccctgtttcacttttaccgggttttcgaagtacgtaaaccatgtaaaaaacacccattgtacaccctgagaatttcagttgtttttctgtcattctacagctgagagcaacataaaactgcatttccggcatggactgaaagttttactctatgcctctaaaaccaacacactgatcttccctcgatttccctgagcctgtcagaaattcagcatgaaaggattcactgaatcaatccctcctccgatgcctatatctcctacgtcacgatgcatccggatctgggaatgtcaaccgatgatccgctgcagccatagcagagaaatatgcagttagacagtgcccaaacagtactactcttgcaagtaaaaaaacaatgcaagcaattctgcaaattaagatactactcggagttcccgactttcgcgctaagcactgggcgatcattttcataacaaattgaaactaccatccttcatatatgcagataataaagacctgcacaggtttcagaacatatgctgttgcaaggaaactctgcaaattaagatatactaggatgccgaatttcacactgaacactggtatgataataatcagaaaaaatagaaattagcacccattctatatgcagataataagaactcgaaatggtttcagacaatccattttaggtgacagacccaccacaacaatagtcctaggccagatcacacaatattaacataccatttagctactactactagttcttcttatctacatattcagataaaatcctattcccaagaaaacataatacaccaattgcatacaattttcttgtgatgcctgacttgcattccatcaacagaaagttcctcacatttgttagcaagtaaaaacaattcctactacaatgttctcttctgctgttctactacaatgttcttcagaaaactcctaactcagcaagtaaaaacatgactgcatttgtcccttccacaaacagtgcactgagaactggaaaaatcgacggtgctgagataaccaaaaggaccagaaaaggagatagtacatggcattcaggatccgcgaatgtaaactcattaaggacaatgatagcacaaactaattatcaatgatagtttgtaatttgtaatttttactacaaactaatcttctctgtaattaaaatgatagcacaacgatgacgcaaacaagttgtaaaaacaaatgtaattacaagttgtgaaatacctattgtattgtttgtgtgattagtgtcccgccgtacgtcgccggctgcggccagctaggtgcgcggccggaatatggcttctgctgcggtgatgactcccacgaagacggcaaacgcgtagagactccatatcggcgggggagacgcctccgtcggtgggcgtgtcggtgatgaaggacgagacgtcgtcgggggcgcgggcggcgtactgggaatgggagtcgccgccgtcgacggtggtggagtcctgaccgctgatgtggaagtcgtcggaggcgcaggcgtcatcgtgttcggtggcgcgggctggagggtgggtgtcgccgccgtgggtaggagagcctgtgccgtggatgggggcgatgtcgtcgccggcgtcgcggtcggtggcgcgggaggcagatacatccatcgatcagatgcatccatgtcgtagtactcgtcgcaactgaggaccgggccgaggcgtggctcgctccagtggttggcggacaccgccgtcaagcccgccgagcgctcccaaacaatgagacgagctccggtctgctcctccagaacgcgggaaaccacctccaacctctcctctcgaatccgccgaaactccggcgaggagtccacgtcaagatgatctagaacccgaagaatctgcgtcccctgattcttgatgttgacctccagtgcatcccaccaagtgaacgcggcgcgtcgggcagccatggacagggggtgagtagcgtggtggagcggagcggaatggaatcgagcgctaggctgtgggagctcgaggcgagccgcgagcgaatggagaagaagaagagaggcagcgctctcctcctgtgttctttttatattgaaaacggttgacctgggacccacct

SEQ ID NO: 55575 - DNA, 1871 bp, Oryza sativa
agaccctgaacatcgtcctcctcaggaccaacagcgaaggtaaaaatcccagttcgagtatgaatgttgctgaattttctgaacaatgtttatgtgattctgaattttgctttgtctctgttctccgaattttgtacgtcacgtccagcactgtagattttcctgttctcagtagtttgtgcctgttgtggaattcgctgaacatgtagtcatgatgtgtttgcttgtagagttaggatttgtctgaagaatatactgtagaacagcagaagtgaaattcatctgccgaattttaatctcggccaccaccagacaattctatgcactttgggcttatctgaatgttgtagggtttatctgagctttgtagactttttcacacaatggtctgaatactgtagctgaatgcttgattggtatgtaaatatggtgtgcatctgggttattactattgttgtgactcagaactaaagtggatggattgaaacaagttcaagcctgcattgtctattcaacttgtttcacaatgatcatatcggtagtttagtgtgaaattcgacatccaatatgcatgttgctggattttctgaacattacttatgtaattcttaattttgctctgaaaggaatgcatggcatgacgtgggcagtgcttctgtttttctgggcctttttagctagttcagctcatctttttttgtctgttaggacttgtctgaagaatactttagaacgacagaactatacaagtgaaatatatctgcacttatctgatgaatattcatttcaggcatcatcagacaattgtgtgcaccttgggtttaactgaatgctgtaggattcatctgaatgttgtagattttttagtgtgaaattcagcatccgagtagcattttaacatgtgaattactggcactgtttttacttgcaagagctgtaattcttgtgtattactctttctaactgcgtgatttgtttgctatggctgcagcgaatgatcagatgatattcccgaatccgaatgcattgccgtcagcagaggccacagatgaagacgatcccacgattgagtgaatccttttgtgctgaagttctgacaggctcagggaactcgacagaagattagtgtgttggtatagggtggaattttcagttcagccgatgctgcaatgcagttttatgtttgctatcagctgtagaatggctgaaaactctgaaattttcagtgtgttcaatgggtgtttttcgacggtttcacatactttggaaacaggtaaaacaggaccttctaaggaaagtattggttttggtgacaattagtattcatgcctagtatggattgacgccaaaaatgtgcttattcctgaagtatattagtgttcatgctaaacttggtagaaatatgcatgatgtgtctgaattctgatgaatgaacacagtaactgaatgtctgaatctcctgaggcattcaggcttgcccctgcctatctatttgagaattttgatgggttccagtttgctgatgctacatgctatctactatctagttagttagtagttctgtctatacttagctgggtggaccataaaccaattgttagatcaaaaagtaaagtacagaggagagttcttgaaaacataaaactactccaatgctattttctgaagccctaaaacattcaggggttgtccctgtccttctaagagtagtatttgggaattttttttgaaggttagtatttaggaattttgacggtgccggtttgcaaatgctacatcctacatgctaactcctaactctgtgagttcacctatttgacagaactggacagccatattcctgttgtttgcagcaggaactagaacaagtt

SEQ ID NO: 55576 - DNA, 1650 bp, Oryza sativa
aatttgacttgaactaatccatggctagataacttgtgtcatcaccaaatagataaatcaaactcaccagacatgaagagaaccatttattccttgttgtcttatgaaccgagctaacgaattcaacatccacgccttcccgcatccatagactgaatatccgataattttgagaaaattcaccgttgccttgaatcacccgaagaaattatcaccatagcgctcgctcttcctcttcagtgacgcagatttcatatatccccatcatgtaaaccccacagatcctggatatatcctgtactgccaaacagcccgctgacaccctcaacgatttttacccgctgttgcccgggattttcttcacgcacctttgccccactcctgcaccaccgcagccttgccttcgaatcataacgcagaagccctgatgcacagttattcttgctgtcaattccagccacctagcctccgtgctgatctccacgtccatcgcgactccgagttgataaacaactccgcaaccgtgtcgacctccaccagctacacaaactgcacatcctctgcaattggattccgataccaatttgctgctctgtgaatagacctacacacaatatgccaatggacacccttgccgcatgcatgcacacatccacagccaccacgaaaccaagcttgttcctcgtgactgcatgcgatccatggcaaaagtccaagaagctcctattgcttgatccaattttgttgtgctgctcctgtgcgcaccgtcaccgcctccaatgaccggagccggcccgcgccgaatcccgccggcacctacacaacgaccacaccaagccgtgttcatgccgcacgaagttcgtcgcaaacaaatccgctccgacctccgattgatcagccgaagccgacaaatcgtcatgccgtcttcccagccgccgaacgacccgagcgctacgtctagccgtctccctgtcaaacgcagctcatcaaaaggcccgggccaccccgcccagagtgttcgatccaccgaccgagaacgccgatcgcctccagcttcaatcaacccgagcgtgtggccacacgtctccctgttgagagtagctcaccagaaagttcgagccacctgcctgaagtgtccaacccaccgattggatcgccaatcgcttccgccgccatcaacccgagcaccacatctagtcatctccctgttgattgcagccatcgaacggttcagaccgccgcctgaagtgtccgattccaccgatcaaattccgttgatcgccgccgtgctccaccttgcgtccatgtccgtccctggacaccctgtgtagtcgtcgcggcgtggagcacctccgtcgtacctctaccatggatctcccgcaggctctgataccacttgttataaaaccagccccgaaatcacatcggaaaccaaaccacggaagaaaacgccataggagatccaaacatgatgacgacaccgaggcacgatatttgataatggagttcagctgaggcctacatctccggggcactgattacgggcgctcctccccgatccagcatatatagcgtatcagagttacaacgactcacggccggtcgccgccggcagccgctccctctcgctatgctaagtcgccatgcggt

SEQ ID NO: 55577 - DNA, 856 bp, Oryza sativa
acgtcggagccggagcacgcgacgggctgccatatgatggcgtccatctccaccctgtcgcggtcgcgctgcgcggcgtccaccgagaggaaggggagcggggagccgtaggagtcgggggccccgaggtagcggccgtaggcgccgcggaggcgcacgtactgcggcagcggcgccgcggcgtcgatcggcggctcgacggcccacaccgcgcagtgcctcgagtcaccgccgccgtcgcgggggaggctgccgacgtagacggacctcccgtcctcgtcggcgtggaggtaggagccgctcttccagatcctcagcgccgcgaactccacctcctggaaaacctccatcatcggctgccgcgcgaggacgttggacaaggactccatggccgcgccgcggtggtgaggcgagcgatcgatgcgcgcgcgcggtggcgaggcgaggcgtagcgagagcgcgcgcgcgatggcgaggcgtggcgtggcgtggcgtggggaggaagacgagagaggcaagtagccgtggaggagtttgttagcgacggttacgtttcgacgccgagggaggcggtggcatttgaaggcgtcgcgactcgcgagaagacgcaggtcgctctctgacaggtgggtccgacggtcagctgtggtcaaccgtagtcaatgacgagtggggcccaagaacacggagtgtagaatttgctcaaaggaagcgcagattcaggattggatttgaaagagtggactctgcaagattcatataaacgagttctgaacttgttctcatctctgcagcaaacaaaacgaatctgcccagtcctttccagtgagtgagtttattgtgaaattttacatac

SEQ ID NO: 55578 - DNA, 7218 bp, Oryza sativa
aaattcggtgtctgaactagctctcatgacataatcactgcattgaactgcaatgctgcatgccattttgttactttcatgttgattaatttcagtggttctccactatttttacaggcttgcagcaccagaatcaaatagcgagggtaatttaaactagccaaaacatctcagcaaagttcatggaaaatagcaactataacaaagttcaattttaagaaacaatattataactgatgccatgttctaaaaatgacaaactggtttaaggtgatcacaagaacgatggcatgttctacttgttgagctttgatggctcatggctccatgcctccatatgctcattggattttaagtgggtctaattccgatctcttggaggtacggaggttgagagactcggaagaaacagaagaaattcctgatggtgattatgaaccggatgaacctgatgaggattgatctgataaatggtttacagaagaaattatgttatataaagttgatattgataagcacaagtttgttaagatgcgcagcattggggatcgtgctctgttccttcagtggtgtaccttctaacaaaggaattttccctatgttaaaacttgattgtgcttatctttctgatgaattttctgaagaaatgtgtggaaataagattaggcctctgtggcattggtttagttgcttgtagacgtgcctctctgtttggcgagggcacggccaaattagggctatcgtttaattgtaatctcgttatgtttgtcattggctactacatttatgtgtcacaatggtcaaaattgctcggtaaattcggggccagtactatctaagtttggctgacatttagaacgtatgttgcacgtgcacgaatactagaaaactcaaaaggccgaattggccatcattccacgagaaacaacttgatgcttcacaagattcgccaaatttttatcaagaaatcaagaggacaataattcatattgacaaaataaataaataaataaatgcgtcaaaaaaaataaataaaatgtgtggtgctatagctgaaggcacgagatgcgctagtagaatgttggcgtgatctagacaggagttggccagttgagccaaggctgcgacggcgccgccacgtcatcttcgccggagagcctttccatctgacctctcttcatgtcccatctgccaatgtctcgccggcaatgctttctcatgctgacgagttcgtggtcgtcggcgaggtaagcgcatccgggcttcaacgccgggaagtgctcagccgggaagcacgccgagaactcgtagccgaggaagaggacatgatcctccaagctcgccgccgacgcctccacgagcttctgctcaccgccgtcgaccttgaggatctgcagttgtctggtgaagagtccggcttcgtcgtcttcgacgtcgtcgccgtcggcgtagtcgaacctccaaacctgcaggagatcttcggaacatggcgcgcccggacgaggtacttgctgccgttgtccaggtccgtgacgccccgcatgacctctctcgtcgccggcggcggcggcggcgacgacgacgcggatgcggcgcgtgggacgtcgatagcgtagatggagccatcgaaccgcaacgtgtagaagaggccgtcggcgtcgtcgtagatggcgtggcgacaggcggtggagcacgcctgtcccgggtacgcgacgggcgtccaccgctcatcgccgtcgggccggtgcaggaggagcgcgacgcaggcgctcccctcggcggggctgcacgagaggaccacctggtggtacgcccattccctcgcctgcgccggcgagtacacaagggacgcctcgttgtatgccatgtcgtcgtacaccctgtacctcgtcttgccctttctgctcgtgaacctctcgacgttgtggaggctggtgatcggcgggagggtcgccatggcgccggtgagagggttgacgagaacgagatggaggttgggcgcctcgtcgacggtgaccagccacccctgcgacgcgccgaacacgggccgtccatcgagcagggcggccgggagcgggacacggagggacttgccggtggcggggcagtagagcgcggcggcggcggggccgtaggcgtcgcaggagtagagcaaccacggcggccgtgccgtcgtggacggcaggcggagtcgccggaacgtggcgtacgcggcgcgccaggtggagcagacggcgccggagcggacgaggtcgtcggggtcggccaaataccccattacggtgatgacgacgtcgtccggcagcgccgaccagtctgcgacggcggtttcttcctccatggcggcggatctgccggaggcggccgggagccctactggaaacggatgaattggcggattttttttttcttgctctgctttgcgactgcgatttgcgatgataaaacggccgagtcggagatcgaactgttcagcccatcgcagtgtcagagactgaataattatctggcatggttgtgatctttcctttcctttcccaactcatactctccaatttttcttacgaaaaattgttattgaaaagttattaaaaaaattatattaatctatttttaaatattgtattaatcatgtgctaataagtttgcttgttttccgtgggaggaaggttcccaactccattaaacaacggaactgctatattaatttttttaccgtcgattccgctctaagatttgtgttgagatattttacaatcggatctagaccctctttttacaagttagtcccattatcgcatgtttatggtagatttgttcaagttacattccagttacatactagttacattgtagttacactctaattacattgtaattagattgtaactacagtgtaactacactataactacattgttatctctatataaattggatataaagttgcatatattattttaatacatatatacaagttattattattatagtatagttctagtgaaattatatactatagttagatttgaaagttttccccttaaaaaacactcgacagttttttagctagtcccttaaacaaacgttattgtagtcttaatttgctcttttggtaaaatgttcagcccatcgtcgagtccgatgataaatttgattcatattcgtgaaataggataccggatatctccacctctcaactattaaaatcggtgcaatttgactcccacgatagtttcactgacgtggcgcctatgtagtggtgttgacttgatcttcgactcacgtttttcacctctcttttttgatttgacatggaaatatctcccatcccttctttgactctttttccttttttatacgagaaatgatcccaaatgaaaaatgaataggtgtggaagttataattgtaaataaaccacgatcgaatctatggaagcattggtttatacgatccgtttagtttcaactttagggataattattttcgctatcatcttgccgagaaccacctaaggttccgactaaaaaagtgaaataatttaattaagtaagaagtctccccatctgagacttcttacttcaattagtcctctgttcttcgaatggatctcttaattgttgagagggttgcccaaacgcggtatataaggcatacccagtaaagcttacaagtaaaccagatatggagatggtgactaaagttgttgtttccatttttatagaatttcaagattacaatggatctacgaaaagatcgtgtatttacaactaccatggaatagtatcacagagtcaacacaaatcattaaatagaatttatggctcacgcaaaccgttgaagatagttctagacctagaccaagacgaactcgcgttatgtggtgttagaattaaaaaaatatatgtgagacccatttatccgcagagtgactgagtgactggcgcctacctcgggaggccatgcgccatgctgatgttgtcgacatcaacaccgatgagcgcctccttcctcctcccagtcaccgctcaccgacaacatgtggaggaagagaaatggttaggtttgaccgatgttccgtgtctttctccggtatccgacaataacccctcgttgcacactttgcacaatgccgcgtcacccttctgtcttctaagagcaagtttaatagtatagcccactactgactctaattcatctatagccaatttatataatagttgcttactacactattaatatatggtcctacctatcatacacacaatacgtcttagagtccgtgttgcagctggctacagatctgtagcccgctgctcttctctctcatcttttatctcattaaatatgtttgtagccggctaatagtctgctattgccctttgctctaacaacgctttaccctttgctcaacttccttaccttttatttccatcacacgcgttttatcatctgacatcattgcaatatctctctttcgtgcaacacacagatattttgctagtggtaaattaatttcaaatgctcggttggacaatatgtcatatcagggataaaatttgatcctatagcaaaacattattagctattatccctatatcaaactgaaaattttattatgcacaacaagtaaaagaattcatgttttttagcattcaaaaaaaaaggagagaaaatgtaaaagggctagattgatcacaaataggactctaattattatcggcctccctctctagccttcatttcttcgtggatctcttttagcgtacaatgacccatgacaggtatcccaagaaggatgaccaaacagaaaacgatggcaaataccccctcgatactgttgcaccgtggaactaacgggacaacaaagaaagcaagcaacacgagagcaacagtgttcgcgaaccactgcaatatatatgaagaagagttaaaataagaactaatggttagttgaatatataacgaatgtaaacaatagtagctgataagacaacgagacaaaatatacagatatgaactttcaatggtatagctttaatgctctaaattattataagtataggtttgtccttgatcaaaccatttatagaaacagaaaaaaaaaatataacaatatctacaacaccaaattgatttcactaaacccataattaaatatatttttatagtatatttatttttttgaaaaatattgataattctttttataaacttggtcaaagtcaatgatgattttacttgaaacaaactgatggagtacgatttaaagccacataacttatagatggccatctggaccgtccggcacggcacgacccaagcccggccatgcctgggctgaggctagtcgggccggcatggcccgaccgacacaccgggccatgccgtgccagcccacgggcggcatacacggcccaatactactcgggccggcccgaaggcacaatggctcatcatgtttcctcatagaaaaagtctatttttggtccctcaactctgtgggttgtgtttaaatggctggaaagtaagtctattttatatacctcttgtcttgggccttgccttatacaattatttaagtctttgcatccctatattttttttatttgatcgggttgtgctaggccggccgccatgccgagggtgcagcccaggcacaccccggctgtcaggccatgccatgcttgggctgggccaaaattgcatgtttcgagccaggtcgtaggcctcgggccctatggccatctatacacacactcaaagtgggagagctgattagcgactgatcgcgcacggtcgtaggcgcgtggtcagtccagccccttaagtccctcctatatactactaacacattatcatcctctctttttatactactatactgtgtatagtatttatatacatatgtagtgtaaactttgtattacactatgtatagtgtgtatatacacatgtataaacatacgtatataagatatatatatatatatatatatatatatatatatatatatatatatatatatatatatataaactttgtatacatgcgtataaaaaaaaactttgtatacgtgcgtaaaaatatatacatatatataaactttatacacgacgtatacagactttgtatacgagagtatacaaactttgtatatgtatgtaaaaatatatacatgtatataaactttatacatgtacatatacaaacttggtatacgtgcgtatataaagtttgtatatgcgtttacaaactttgtacatgtctttatatacgtacgtaaaaatatatacatgtatgtatacaaactttgtacacgtgcatatacaaacttgctactaaaaaaccgaaaagggagagaaaaaaccgaacaaagacgaaagaaaccaacgtagaaaaacgagaaaaccggacaaaaaaaacagaagaacggcagaaactaacgaataaaacgagaaaaccggaaaaaaaaccaacgaaacgaacggaaaaaagggaaaaccggaaaaaaaccaatgctacctaactcctccgcgcgcaatccgccgtcccctctccgcgcgcgccacatggctagtcgtgcgggaaggaacgcgcgcgactagtcgcgtattagcgctttcgcactcaaaggctgtactagagtgcatctactatataatcgtttaagaaaatagaaaagaaaaacgatagaaggctcgattgcctctaaaaatgtacttcctccatcctaaaatataaaacttttttggtgtatgtgactatgaatctgaacaggaactcgtagttttaagataagttacatccatcttaaattccttatattttcagaacgaatgcagcataaaaaaaataaaaggctttggtcgaacttgtgtatgtcattatgtgcagtcgtacagagaggggtactgaccacaagtgctctgatgccagcaggggcaccggtaggattccatatatctctctcgatcatcggatgatctgaaggctgtgccgccggcggccgtgccggcgaggccagccgcccttgttccagcaagctgcacaggagatcggggccctccgccgccgcggccttctcctcctcctcctccttcttctcctcccccatggcgaattggcgattcgatcgacaatcaatacagctaaactagctatgcgcgttatgttgaggccgtgtgcacgtacgtacgtatatacgtgtaggttt

SEQ ID NO: 55579 - DNA, 4815 bp, Oryza sativa
ggatatatgtcgattcatgagaaccttggtgatatcattggcaattggatgtcttttttaaaatctttgatttcttcttgatttttctttggggagaattggaggttaatttgagggggagtttgtgctttttcatgcattcatgtttattttatgcatttgctctaattttgaaaataaataaaaataagaaaaataagagctttgttttatacctctagtatattcttgtgcatgctagcaaaataattgaggtctatttgttgctatgttagcttgtatgcattttagtctttatatgaagcttagatattgcttttaagtgagatgatgcatgacactaattcttttacttgaattaagaaaatatgcaatattaatgctagcatatggtttgatttttaaatgcttatatatagctttattgaattgttattcctcaaatagctttgtaattgctcattgtgaaaagagaataaaaaatacgaaaaaataaataccgaatccttggaagcagtcttgacgataaggacgtattcgatgtgagcaaaaataatgggtgccgaatccttggaaacagtcttgacgacaaggacgtacccggaataattgagagaaaaaaatatgagcaaaaaagtctcaaggaaagaaaaagttaaaaattctcttggttgttttgtactaaagctaatttgataaacagtaataaatgcaataggtatatatgtatagtgtttatttttcaacctatgtgcttgtgaatatattgcattataaatcatttgaagtcatgagtccttattgatgatttgagcttaattgtaatatctttgattcatgtttatactatgatgcatgcttgttaactagttgatgaatttatctcccttatcttgcaaaacatgatcattaattgcttttggtacatttcaaagctctcgaaaaaaatagaaaatggaaaataaaaatttgttattacaagtggcaagcatgacatcatttcatttgtgctttattgtcattatttctcttttgaattcttgatgaaatcattgtcaaagggggagaaatatacaaaatgcatgcttcttggaaaggggagaattgaactgaaactgtttcgatttacaaaatgcatgcttctcgaaaaggggagaattgaactgatgaactgtttcgatttttaaaaatagtcgattttgtgctttgattgcaaattgatgggagaaattctttcttttaaaaagggggagagtttttctttttctgctttgattgcaaattgatgggagaaattctttcttttaaaaagggggagagtttttctttttcacttttgtgatttttgtttttatttttcaaaaacacaaatttgcattttggagatgttgccaatgtattcatcaagggggagattgtgaaatcattgtcatgattaataattgtgatgaacaattggctatgcaaatgatttaatcaaagaattggtttgaaaagatgtgcgaatgttagtgtgagtgcgtgtgactaatgtgagtcaggttgtgatatctgtgcccagaaacggttgttttgtctgattgtgtgcaggtgacttgaggtcagccttagtcaatggtgaggaccgggactatgctcaagaggagcagaggtctattgcggtcgggataccatgtaagaaggtgactagagctagtattcttggaggtcaacttcggtcaacagtggggatcgggactaaactcagggaggagttgaggtccagacggtcgaggatatcgggtgacgaagttggatacgagatgtcacacggtggatggacaccgtgtgggagagatcttcgcaacaggcttcacgaggtgtgcgtgcaagtgctggtgttcgcgaaggagattggagtgagaaattgagaaaagggtatatggtgctacagtacacgtggtactgtagcatgcgtatggatggtatctatgcatgtatgttgatcatgcatgtgtggctcggtgcgttcttcatgcatgtgtgatggttcggtgggcttcggtggcagctggctggaggccgaaccggtccaggagcagcagcacgttggcccacgtgcgataggcccaagcaggagcaagcgcaggagatcgagtccgatgcggttgattgcggctgtgcgagttttgggaaattgtaaaaggtttggaaattgagggtttgagtcctactgtgaaaaggagttctacacctattttgagtagggggtttttcatgtataaatagagggggagcgtgaggcttcccggtatcgcttttttatcgcttttcagagcgtggagctgatagtttagttagggtttcgagtttagtcgagatttttgtaaggagtgttgttagtgcactttgtaaacacagagagaagcaataaagttgtcatctactttgagagttcttcgatttgtgtttcatcgggttcggcggttcgaccggcggcgtgcaagcggttcgactggcggcgtgcgagcggtccgaccggcggcggcgacaggactacgtcgagatttccatcgatttgagggtaacttttatttccgctaaaagtttttgggttttagttttctctaccattcacccccctctggtaggcttggtttcttgtgttcgatcctacactcttgagggaaaaaaattacatctccatttttattatggtcatctttattgtcaactgctaccttttgaggtcttttggcagttgaaagttgaaacaagaaaacatattactctaataaggtgcaagctagcaggagatctatgcaacaaatagtatctccaaaaccaagctattaaaatcttgcaatactagtaggaaataacatgatttttcagcaggacaactgcaacctaactatgcctttgttacaccatgccattggaaagtatgaaagacagaaagagcagattgttcagcgggactgtacctttgctgtggctgcggtgccattatccgtcaaaggaagggtataagcattgtgaggcgtcgagctctgcggagcagtttcattgggcctcagtgtgatcaatggcaatctgagaccattggagcctgaaactgcatatcctctgtcggaagaagagctgccggagatgtgagaggtaaccgaggcaagtaacaacaatgcattcagatttgggaatagcaactgatcgtcagctgcagcaatagcaaagaaatcatgcagttaggcacaagtaataacagaggcaagtttaaatagtgctgaacaagttggatataggcttgaactggtttcagaccatccattttaaggtgtcgtagaacagagacaagcagtattaacataccattcagctactactggttttccctatctacaatattcagatcatcatctccgaatttccacaacattcagataaaactatcatcaagaaacacaaaataccaaagtactgaacaatttacagtactgaaaactacaaaatccacattattgaacggacaaaagggacctgaaaaacataaacattgcccacaggaaactcagtcaatctagcaagcttggcaatgaaaaaatgccaggcaatctgcaattagtgaactatactagacttactgatgcagttttaacatttcaagaacttgtgcttcaggaaattcagtcactgtcatcacttgtcagaattcagtccctgtcatctacggaatcatcaataatctcaagttatgcagaccattcagaactacataaacaatgttcagagaattcagacacatgcatatcgagctagtctgcttaccttcactgttgggcctgacaaggacgatgtgcagggtctcccggctgcgaggcaggtcgatgagcagaggagttagccgcccatggatgccggcgcggacgcagagtgtaaactcgtcgtagcccagaatgcctgcgagcttctctctcaggagctggaccgacttcccggtgaacacgtcgatgttgccggcggcgcctgcgccggccgtcacgaactggatctgccgcctcagcgggggaaagcacgccgcgacgagattcttggtcaagttgcactgcacaaaatcaacaacagcagcacaacgaatttgataaaaaaaattcacagattgttacatggttcaagattaatctccgacccaatcaatcatcatcaagacttcttcaactagaaccagaacaatcctcttgttgtagaattgcataaaggacacaacacaaacacaagaattgaaggaagagaggggatcaggagagaggaggagtaggaggatctcacctcagtggcgatcgggagctcaggtctgacttgactcggggtgacacgcaccacctcccacctcagcgacgtttcgttgtcgacgtcgctgtggacggagacgccagggcggcgagccaggaaggtctggttgccgcgcaggtagcgcccggacttgtcgtgcagaaggacgacgcagccgcgggcaaggtccgggccggagcacccgacggcgcgccacatgatggcaccgacatccagcacgtcgcggtcgcgctgcgctgcctcgagcgagcagcagccctcgcgctcgcggtcgggggcgtcgggggacccgaggtagcggccgtaggctccgcggaggagcacataccgcgtgggaggcaccccggcgaccacctcctctacggcccacaccgcgttgtgcagcgagccgccgccgctgccgccgcgcaggttgccgtggtagacggaccgcccgttctcgtcggcgtggaggtaggagttgcagcaccacacccgcagcgc

SEQ ID NO: 55580 - DNA, 1236 bp, Oryza sativa
taaactgcatttccggcatcgactgaaaattctactctatgcctctaaaaccgacaccctgatcttcgctcgatttccctgagcctgtcagaaattcagcatgaaaggattcactgaatcaatccctcctccgatgcctatatctcctacgtcacgatgcatccggatctgggaatgtcaaccgatgatccgctgcagtcatagcagagaaatatgcagttagacagtgcccaaacagtactactcctgcaagtaaaaaaaacagtgcaagcaattctgcaaatgaagatactactcggagttcccgtctttcgcactaagcactggacgatcattttcacaacaaattgaaactaccatccttcatatatgcaaaccatctgctgttgcatgataataatcagaacaaagtgaaattagcatccattctatatgcagataataagaactcgaaatggtttcagacaatccattttaggtgacagacccaccacaacaatagttctaggccagatcacacagtattaacataccatttagctactactaattcttcttatctacatattcagataaaatcctattcccaagaaagcatagtacaccaattgcatacaattttcttgtgacgcctgacttgcattccatcaacagaaaattcctcacatttgtcagcaagtaaaaacaattcctactgcaatgttcacttctgctgttctactacaatgttcttcagaaaactcctaactcagcaagtaaaaacatgactgcattttccacaaacagtgcactgagaactggaaaaatctacggtgctgagataaccaaaaggaccagaaaaggagatatatgccattcagaacaacataaactatgttcagaaaattcaggaacatgcatatcgaaatcgaagctaggctgcttaccttcgctgttgcgcctgagagcgacgatgtgcagggtctcccggctgtgaggcaggttgatgagcagcggggtgagccgcccatggcggccggcgcggacgcacatcgtgatggcgtagcccacacggttctcgagctcgtttctcaggagctgcaccgacctcccttggtactgaaacgaatcccagacgatgttgccgtcgccgtcgggcgccacgaactggatctcccgccgccgcggggggaagcatatcttgacgaagagctcagccaagtcggcctgcacaaaatcaagatagcacaaggaatt

SEQ ID NO: 55581 - DNA, 2105 bp, Oryza sativa
cggcgacggccaactgcaccgcccagatcgcctcgtgcgaggggcggcggcctgggtcgtagtggtagaccgacctcccgtcctcgtcggcggtgatgtacgtctcctcccacaagttccgcagccgcacgaactgcgcaccatggaaaacctgcatcgcggcccgccgcggatggtgcgccggtgatgcgcgcgcggcggcgagtggcttgctactcctcggcttctcggcgtggcgtggcgtggcgcggcgcggcgtggcgtggcgtggcgaggaaggcgagactgcgagagaggcgaggcggtggtgcatttgaaagcgtcgcgaggagaggagggagacgcaggccgctctctgacagatgggtcccctggtcaaatgtggtcaaccgtagtcagtgacggatgtgcccgtgcaaaatgttgaatttgctcaaacgagggagcgcagattcaggattgagtagactctgcaaaatttttaagaaaaaaacgagtttctgaacttgttctgatcgctgctgcaatcaaaacgactctgttcggtttcaaaaatgtatgaactctgaagtcacactgcctctgcattcagctgcagtgtttcaaagaaaaaaaatggtcaccaccatacaaatcgctcaagataaaacgcaatatagcaaacttggcccttaaaaaaaatgcatcaatctgttttgaaaggaggaagtaatcagtctgttgttcgcttctagagaactctcttgtcatatttttttttactttttgatctaaaatttggtctagggtagacaatcaccgactcaccgtaacaagaaatgtagcatctccaaacttcaggagattcagttactgtcatgactcttcagaattcaaaacatttggcattactaactgtcaacttaatcaatatttttgtcatgactgaatttacagagtgaaattagaatctgtccagttcttttcaaagaagtgaatttacagagttattaggaagattccatggatgatcgatccatcagtccttcagccggttgttcttaacttttggaactaatagttggtttagggtaatcacaggaacaggtaaagaactactctactagattctgcatagcaaagcagcatctgcaaaccggcaccgtgaaagttcccaaatagatggagagggacacgctattactcatcagaattcagaacgacgtgcataattctacctagtttagcatgaactgtaatacatgttgcaggagttaagcgaacattcttgtcataaatccatactaggcatcatgactaaattgtcaccaaaaccaatattttcgtcagaaaaccctgtttcacttataccgggttttcgaagcatgtaaactgtgtaaaaacacccattgcacaccctgacaatttcagtttttttctgtcattctacagctgagagcaacataaaactgcatttccggcatcgactgaaaattctactctatgcctctaaaaccaacacactgatcttccctcgatttccctgagcctgtcagaaattcagcacgaaaggattcactgaattatggccctcctccgatgcctatatctccgacgtgatgatgctttgggatctgggaatgtcaactgattatccgctgcagccatagcagagaaatatgcagttagacagtgcccaagcagtactactcttgaaagtaataaacagtgcaagcaattatgcaaactaagaacttgaacaggtttcagacttgaaaccccacaattaaggtactacgaggatgccgaatctcacactaaacactgatttgacaataatcaaaacaaattgaaattagcatccattctatatgcagataataagaacttgaaatggtttcagacaatctattttaaatgacagacccaccacaacaatattaccataccattctgatactaccaattgatgttatccacaatattgagataaaatcctatcaattgcaaacaattttcttgtgatgcctgactagcattccatcaacagaaaattcctcacatttgtcagcaagtaaaaacaattcctactgcaatgttcacttctgccgttctactacaatgtt

SEQ ID NO: 55582 - DNA, 3288 bp, Oryza sativa
agcagaacgaatgatgacgcaaacaagttgcagaatcgcatagaggacacgcgacaaacaccaagaatcgcaacaagagatgggagagaggatcggaggagctcacctcaggcacaatggagatcgggagctccggcctgcctggattcgggaggacgggaagcacctcccaccgcaacgccttctcgtcgtcgttgaggcggccatcgccgacggtgagtctggggcggtcaccgagaaccagggtacccagtttgccgcgcaggtagcggccggacttgtcgtgcaggcagaggacgtggtcggcccgcctgacggcacgccacatgatggcgtcgacctccggctggtcgaagtcgcgctggccgacgacgggggcgggccagcagcaggagagcggccagcggcgcacgacggcgtccggggcaccaaggtagcggccgtaggcgccgcggaggagcacgtactgcgtcgggggcgccccggcgaggaccatctgcaccgcccagattgcctcgtgcgccgggcggtggcggtctggggcgtagtggtagaccgacctcccgtcctcgtcggccgtgacgtacgtctcctcccaccagttccgcagccgcgcgaactgcacgccctggaaaacctccatcccgcgcgcgccgccgcggatgggacgacgtacgtacgccggagatgcgcgcgcggcggcgagtggcctgctactcctcggcttctcggcgtggcgtggcgtggcgcggcgtggcgtggcgtggcgtggcgtggcgaggaaggcgagagaggcgaggcggtggcgcatttgaaagcgtcgcgaggaagagggagacgcaggtcgctctctgacgtgtgggccctttggtcaatgaggtcaaaagaagtcaatgacgggtgggcccgagcacagtgaatgggcgtcgcgaggaggagaggatagaagagtcacgggttgccagttgcgcacagccagatagccaatgactggtggggtcaggcacagtcaatgactggtgggcccgaacacagcgggtgcaataggattagccatcgacgagccgtgctaacttgaacggaactacggaagatgtgtgaaatttgctcgaacgaggcgcacatttaggattgaatttgagtacactctgcaaatttcgtacagaacgagttctgaacttgttctggtcgctgcaaacaaaacgaacctgttcaaaggagtgaatttacagagttcggttattctctttttgcttaagggtgattaacatgagttactatgatatgtagaagacttcatcgggctcattaacatgaggattttcttggccgtgttgtttttgcaaaacaaataaaattcgaagtctgaactccaaagtcatacacaacattcaactgcaagtcattttgttgccatttcagtggtacatttgcttcaaggtgatataatatacagtagcaaacttggccacgaaaaaacttcaagcaatatacaagttaatggtgaactgtcttgtttgtgttatgtacggagtagtacttttgcatcaaacaatctgtttagagtaatcaccgcaataggtaaaaactaccaactactcggtacctaggtagtagaagcaattactcctgaaccattatctaaaaaaagcagcatctgaaaactggcaccatccaacatattgctaagtagaaatatattactgctgatgctaaacttggtagaaatatgcatgatgtgactgaattctgatgaatgattacagtaactgaatctcctgaaccattcaggatttcaggtagtatccctttctgtttgggaattttgaaggtactagtttgatatgtggaatgtagttaatttagtaattctttttacttattccagtgattgctctaaaccaattgctggagagttcttgaaaagtttaaacatgcagatttcttgacagtttgtcatggccaagcttgctacactactacaatgtattgtggtgctgctacaacggtgaagaatcactgaacttaaactgaaagtaacaaaatggcatgcagctgaaatgtaccagtacatgattctgaattccaactgaatcttctgagttctgacttctgaatcacagaaccgatcgatcgaacatccatggtttgccactcaaattctgtaaacagagtcgttttgtttgctgcagagatgagaacaagttcagaactctcttcttttgaagtatgaatcttgcagagtccactcaaacccaatcctgattaacctgcgccgcttcatttgagaaaatcctgtaccatgaaatctgccgcactccctgttctcgggcccacccgtcattgagtacggttgacgacagttgactgtgggacacacgtgtcagagagtgacctgcgtcttctcgcgacgccttcaaatgccactgccgcctcggcagaatccaggaggagaggaggattggagcatcgggagcagagatgggactcaaccacaaacccgtgcatcacctatagaaaacctagaaaaaggagaggatgtgaagagcagctcaacccagatcttggaggagggaggcttggcgctgcatctcgctggaggggaaggactggcggcggcggcgaccttcgttcgcgagaggggaatcgtcgctgcggcacgcgagcgacgcgacgagattttccacgtggatcgggccgggaatttcccagctgatgggcttccaaatggtccggaaaattggcccgtggaattttactgcccgggctggccggccagggaataggccgggatccagtattattcaggtggtgtttggatccaggacttaactttagtccctatatttagacactaatttagagtattaaatatagactacttacaaaactaattacataaatgaaagctaattcgcgagacaaattttttaagcctaattaatctataattagagaatgtttactatagcatcacataggctaatcatggattaattatgctcaaaagattcgtctcgcgaattagtccaagattatggttgggttttattaatagtctacgtttaatatttataattagcgtccaaacatccgatgtgatagggacttaaaagttcagtctcatctaaacagggcctcagtctctgactcggtgatggcctgaacagttcgatctcggactcggccgttttatccttttaaataggtcgatgtgcatgcgctagcgcgaccgaaccatccgagcaatcgcatcgcatcgcaaagcagaggaagaaaaaaaccatt

SEQ ID NO: 55583 - DNA, 1381 bp, Oryza sativa
acaatctgtgaattgatcgaattccttctgctgccattgttgattttgtgcagtccggcttcgtcgcggcgtgcttcccaccgctgctgcgagtgatcgagttcgtgggcgaagacgacctcgacaacatcggcgagggagaaatctggactacggttgagaccagagggaggtcggtgaggctcctgaaagagaagatcgcgaagcttgtgggctacgaagacttcacgatgtgcgtcagcgccggccgccatgggcagttcacccctctgctcatggatgccaacttcgagggcgaagatacgttgctgtgggaggtggtgcgcgtccccccgagtggagacatgccggggctcccgatcgccactcaggtgagcttctccgatccttctccgctctcttcttgcgattcctgtttttttgttttgtgtcttgatgctgatttcgtcggaaattaatcttgatttcttgcaagaattaaccgtgcagtacaatttgtggattgatcgaatttctttctgctaccgttgttgattttgcgcagcccgggttcttcgtcagggtgtgcttcccccagccgctgcgggagatccagttcgtggacgaagccgacctcgacaacaccagcgagggagaaaactgggctacggttcagatcagagggaggtcggtgaggctcctgagagagaagatcgcggagcttgtgggctacgacgacttcacgatgtgcgtcagcgccggccgccatgggcagttcacccctctgctcatcgacctgcctcgccgccgggagaccctgcagatcgtccttgtcaggcccaacaccgaatgtaagcagcctagttaaatatgaatgttgctgaattttctgaacaatgtttatgtggttctgaattttgctgtgaattctagtaacggatggcatggagtgggcagtgtctctgtttttttgatttttttttgtgtcagatcagcactgtagattttctagctttcagtagtttgtgcctgtttggaatttcctgaaaatgcagtgatgatgtatttgcagaacttatctttcagtagagttaggatttgtctgaagaatactgtagaacagcagaactgcagaagtgaaatatatctgcacttatctgatgaatattcattccagtcatcatcagacaattgtgtgcaccttgggtttaactgaatgctgtaggattcatctgaatgttgtagatttttcggtgtgaaattcagcattcgagtagcattttaacatgtgaattactggcactgtttttacttacaagagctgtaattcttgtgtattactctttctaactgcgtgatttgtttgctatggctgcagcgtatgatcagttgatattcccga

SEQ ID NO: 55584 - DNA, 6333 bp, Oryza sativa
caaagatcgaaaggacaacaaatgagaagatttacgcacctaacaagaacaaaacaagttcaatgaggaagatttgcgaaaaaaaaactaaacaaatcgtctgacagatcgggaccgtgcggccacttctagctccggcgaacataggtagtcctggaccacttcctcccggtcctcttcctccgccgcccctccctccaaccaccgcctccggccacacgtccaccgccggccctcaattctccacctttcaacttatcgaagaacacgtaaaccttacgtatgaacagaacgtatctaagaacgatgcaacgcaacaggctacaagctaattccttcgataccttctcataccttttcatatgtgtaaaagacacatttgtcattctaatatcatcatatttatattaatgccacctattacaatattttctttccataccttgcccctcgcagatcatcggctcacgtcgccccacctcctttacctcgcaaacatcgtataaattgaatttgaatatgcatgtttgtgaagtgacatatcacatattgatctatcatactttttttaaggaaattttttgatgactttttaagtgacatgtaaaaacggggcatatccaaatagagtttcccttccacatcactgtcctttgtaaaggtgataagctcacccaaggatgctcaaattacatccagcacatccatggccatctcaaacgcaatgaaatttctgcgggttgggattaagttcaagttctttaatctcaacctgccgaaatttattttctttgcaattacccatttgagtaaatttaaagcagcaaataatcatgtttcaagcaaagtgagtgtttttcttgtgcggtaactgaagcctcaatttggtggcggagacctggtggccttctgcgtgctctcaacacagcttatttcgattgcttatccgccaaaaatggtggagcttgaacgaaaaattggagaggaccaatatgatagtttcatttaaaataggaatattatgctttgtttaaaacttgagcatagagagtcaacaaattcagtgtaacttttctaagactgaggagacatgattaaggttagcttctactcctatcgtcccaaaacaaaacttaatgtaagaggagatatgacccctcctaatacaatgaatgtgagaccctgtttagatgggactaaaacttttaagtccctatcacatcagatgtttggacattaattaaaaatattaaacgtagactattaataaaacccattcataatattggactaattcacgagacgaatctattgagtctaattaatccatgattagcttatgtgatgctacagtaaacattctctaattatggattaattaggcttaaaaaatttgtctcgcaaattagctttcatttatttaattagttttgtaagtagcctatatttaatactctaaattagtgtctaaatacatagactaaagttaagtccctggatccaaacaccacctgaataaccctttatccagattcgttatattaggaagggtcacattctctcattggttgagtagagtgatcaaagaaacaccatccggactgtgtattagattggtgctactaatgatgaaacaaaagatatagtattgggtaattttaacatcctcgaaaaagtaccgggaattaccatattttctagtataaaattaatttggtacctctagatactaaatatctcgagataaaaaaaatagtataaaatttagatacctcgagatactttttcaagtacgataaaatttctctatagtattactttgataacgtgctacatcgaaacaaatgctacagtgcccaaaaataaaaaaaacatatgcatgaagccaaacagttgatgaaatatggggatagctaactttgaattcagggattgcagaagtgtaataaatgacctaataatcctggataattaagaacttaaatctagctcgttaattaattatgctttctccttttggcacaaggcacatcatcatctgcaggcgcgtgaccctccccgtcctcttgaccctcctcctcgtcctcgtcctcgtcgtcgtcgttgtcctcctcctcctcctcgtccggtatcgctaacgccggcggcgtcgacggctgcgccggcggctggtggaagggctcgggctggagggcgacgtcgtcggctggggctgggcttgacgttgccggatggtgttggcgagcgcgctcggccttgaggcggtcgagctgctgctggagcttgagaatccggccgtaggcgccaaggatggggtcctcgaccctcgcgtcggcgaggtagacgacggccgccatgctaatcacggtggagccgttgggccggatcccctgcttctccgcctccgagaagccgaggatcctctccatgccgaacatgaggcgcgcgtaccagaagcgcttcggcttgtcggccggggggggggggggggcgcagttcggcgggcagctgcttgccccgtggtgtgcgcacgcggcgcacgcctgttgggtcgtcgtcgtcgtcggcgacggcggcggctccgccattgattaattcttcgtcagcgagggggtcaagaactcgatgaaatttcggcggcgtggcgtggcgtggcgaggcgaggctagtgtggtcggctcgcttcgggcaccgaagcaaaaatatagatatagtgcgagagtctgtgtagtgcacgtactgagcccgattcgaattcactgttaacctcttgtgttggtgggttaattcgtctccatctcaaattacatattcaactgcctctggattatgtgccccaaaacgcgaatattaccactgtaatttcctgctcacatcggcggtttcaactgcggttaaggatgaaaaagttaaaacggaaagtaagcagtcctccacagtaactatcaggtttcgtttcactcccaccgttcgatcatccaccatcttccttcggtagttaactgttcttaataactcattaactagctagtccagttaattctggagaatcgttccattggagcaagcttcaattctgaaactcctagactctgaatcagacctctaaaactctgaagattcagagaacatctgaacttgttctgctcgctggaaacgaaacgaatctgctcaaaggagttaatcttgcgagaatgcgagtcgttgcgcatctgagagcaacataaaactatattcagcatcggcagaaaaatctactctctgtcgctaatcgaccaacgaaacttgtgtcaagtaccaacaaaacaagttcagcacaaaaggattcacggagtctgtctctaataagctgacgaaccttctgtcgacggtcctgtcaagtacccataaacatctggggaaagtttcaggtggaaccccctctttcagtgaaaccatggaacctcaactgagggtgtgtttagatccaaagttttcatccaaacttcctacttttcccatcacatcaacctgtcatacacacacaacttttcagtcatagcagagaaacgacacagttagactcaggcagtgtggtacaatcataaaagcaatagtattcttgagagtaaaaactgggcaagtaattctgcaaattaaagatgctgaatttcacactaaacactggcatgatcattttcataacaaattgaaattaacattcataacatatacaaaaaatattttcctcaaatgaaaatatacagaaaataaagcattgaaggtgtatgagaccattcatttcaggtatactggagacaatgtcaacacatcatttcagctacaattctgtttgtgtacaatattcagataaatcctactcacagagggtattcccaaagtgcatacaattttgtcctgatgagtcctaaacttgtgttgttctacatgcattctcatcaacagaaaattcctcagatgagtcctaaactcaagtcaacagtatatttcgcttgtgttctacaatattcttcagactagtcctaactcaagaatcaaatgcaggattgcatttttcaaaaaattccacaacaagcacaaacaatctacagcgatgcactaacaaacaattacccgcataattgttcaacaattactagcgatgcgttcctttgacagcaaaattcagaatctacagtcatgcactaacgaaaagaacctggagaacggaaacactgccagcatgctaggctgcttaactctggtgttcagaaccacattaacagtgttcagaaaattcagaaagagatcgaactaggctgcttacctgcggtgttggacttgacaaggacgacgtgcagggtctcccagctgcgaggcaggtactcaagtctctgacccatcagcatcaagaattgccacaattagaactcaaatcgatataatctttggcgcaaacgagttcaagaatcgcaagaagagaggggacgaggaggaggagctcacatggcccatggccgggatgtctcgcctgaagagagttgtggggacgggaagcacctcccactgcatcgggatgttgaggtcgccgtcgttgaaggccgcgacgccggcgaggcacgggagccacctctcgttgacgcgcaggtagcgcgcggtcgtacttgtcgtgcagcaggacgacgccgtcgccagccgccggcgcccagcccgacggcacgccacatgatggcgtcgacctcacctcctccctgtcgaagtcgcgctgcccggcggcgggccagaagcagaagggcgcgcccagaagtggctgatggcgtcgggggcaccgagatagcggccgtaggcgccgcggaggagcacgtggcccgggaggaggacgccgtcgccgccctcggcctcggcgttgatcgtcttcgctggcgaggaggtacctgccgacgctgccgtccacccgcgaccgaagccggacggactccacgtcctggaatacctccattgctcccgccgccccgccggtggtcgcctcgcgcgcgcgggcgctcgcgtcaccaagcgggctcctctcctctcatcggcgacggcgaggcgtgggcgcgtggcgtgcggaggaagacgagaggaggagtttgttagcgacggttagagctgggacatgggccgttccgggctaggcacggcccagcgtgcttcgtgccaaatcgggccgtgccagcacggcgtcttcatggacgccgcccaagcacggcccaatggcccgatgggcctattcgtgccgggccggcacaagcacggcgcctgatggatggatgagaaaagcccatcgggccattatcgtgccatggaccatcgggccgtttacgtgccgtgccgcccgtcgtgcccgttgtccaggcccaggcacggcccacgtacgggctgtgccggaccgtgctttctagcgtgccgggccgtcgtgccttgggccggcctgataaagcacggcccaagtcccagttctagcgacgggtgcgacggggaggtgggcatttgaagcgtcgcgaagcacagcacagggctctgtctgtctgtgcaggtgggcccagaaacggtcaagtctggtcaactgcgtaactgacaggtgggccaccccacaactagccatagttcggagtggatgacgagtgcgcgcgctgacgagccgccgcggccgccacgacgacgagttcgtcgccttcgaggccggccgccgctcgacggcttcctccaccgcgcggcacggaggcgccgccacgctcgcgcgccccggcttccctgcgctacgcctccgccacggctgcatcggccaggtcgcgctccgcctccgccacggcctctcctgatctggccgcatcggccagatcaggaaggggctcgacgagatctcccccaactatgccgcctacgacatcgccggcctgggatgcccgtgctccctcttcctcctccgccaccattctcgccgtcaggtacgctctcgaactactcatcgttgtcggggaacagggcgatcgaggagggtggggtggaggtgggctgagtgcgcggcggaagccgtcggggtcggatgcggcggagatagacgagcgcggatcggacggatgcaggtggggaaggagcggcggcggaggaggattgaggtaggagttcgtcgcccggccgccggccagcttgatctgacgaccagcggcaatcccaaaaatttgacgaacctgattttttttcaaatacacccctggtttggattgctgtcattggaagcgacttggaatttctcaaaattgctcgaatgaggcgcagattcagggttggattttagtgaactctacaaaattc

SEQ ID NO: 55585 - DNA, 4148 bp, Oryza sativa
  unsure (1)..(4148): unsure at all n locations
gcgcatggcgagctgcacgagcggcctgctgctccgggactccccctccacgcggcagctcatcacgaacccgccgccggcgcacgcctcgcccaggctcgccgcgcagtgctccgccccggcggccagcgccggcgcctgcctgtccatgtcgatggcgaactccccgcccctgtcgctgcggagcggcgtctcggccaccagcatgcacgcgtcctggccgtcggggaggagccgcagccggaggcacaccgtgtcctgcctcgccgcgccgccctgatcccgccacgcctccagccgcccccacggctgccagctctccaccgccgccgacgacgacgtcgaccccggcgccgtcgcgccggcgcgcgcgatcagccacgcgccagggttggaccgcgccaccgtgtcgcagccgctcgccgccacgaacggcgtcgccatgaacgccgcggcgacggcggagccggacaggtcatggatcaccaccttccaccccttcctctccctcctcctcatcatctccgcctccttctcctcgccgccggagctcgaccagtacagctgatccgaatgtgatccactgccaaccaaacaagaacaacatcaacgacatgatcaccaagacgagcacgacggcgtcaatggcgtcctctcaccgtctgtcgcggatgaacttgcagctgaagatgggctgccggttgcggccatggagctggacaacctgcggattcagcgcgacctcgtcgtcgaactcaaagatgtaccggggatcagcctccatcttcaccctcaagtgcagctccggcttggcctcaccgttgccaatgccaacccagccatggtgaagcatcaccggcttgccgtcgcgccactcaggcccaatgtccatcctgaccaccccaaccagcctcttcatcccggtgacaatgccacaatgcccgccacgccggccaacgtacaccgcgacctcgaggtaagacccatgagctccgaaacaccccggtgccgacagcgccttcagttcagattcgtcgagggagaagacggcggcattggtgtgtggatcaaggttgaactctgaataattgatcagagggacaggagctatctggacagggaatcctcggagccggatctcgcagtggaagctccgggccgccttcctcgcattcgcaccggggagtttcagaccaagctgtccaactgaaagtctgacaaaaatctggggatccattcttcgtgtcactgaagattagctacttccatggcacatgctgaaaaattcacaaatcattgaagtcagatataatttgatgtaacaatcaattgtaggaaaagaaatgaattctgcaaattagcactaggtgtgcagctgatcttaaaattcttccaatagtagtgtatggtatgacagtatatgctccaagtgatatggaactatgaaaaagactacatagtagcaaatccagaaagaaatgcatagagcatgtttcagtatcagctatgtgctataggaatggcacatgaaaagtagcaacattgctgttgcatgaagatatcactttcagattccattcaaaaaattacatcacttttacccttgtaggtatgaccaaattctacagaaagtaaaagcctaactccgtagccagattcagctcatcacttcaaaatcataggcttaaagcgccagatagaagctgattgcattagattagaccatagccaaattcagctcatcacttcaaaattacagatcacaggcacaatttctccatctgtaaccaagttttattaggtccacctaatctaaggtttaagatcagccaaaaaaaaacttaaaagtaaaagaactaattatttaggaaataaaaatgatttacttagtaagttagctgttttttttttctcaactcaaagtagattttgccagcatttggaattagcattcagacatgtctttaatcgtgattttgatctaatagaaggtacagttcaccttaaacattccccactaaaaaaagaacacgcaactgacgcctagatgcttgcctttcccccattttttttgtgaaacctttgggatccttgacaaaatttaaagaaagatgaatgttgatcaagtagcatattcttcccctttgacaatccctagtgcaagcactaaaaaaggcaagcattgctaatgccactcaacacctcttagcttaaacaactgaaagggagaagaaaggaagaaagaaaaagaggcatctggtgctttgcaatcatgccattgagtggttatcaatggcaattgccaatgccattagcatgccacctctgttcaaagctcctctcatcagtcaggcactgacagtgtcactgcaactgcaaaaaaaaaaaaaaaaggcttgtgcaaccaaagaaaagcatccaagaagagcagcatcaatggcgcggcgcgacataagctagcccgtgtgtcgcgaaaaggggcggcggccatggcagcaatggtggtgcatgggtgaggtagcccaggatcagaattctccctttgctcccatttctttaaccctccaagcaaagcttcctcctctgtcgtatgatcagcgtgcaaagtggagattccaaaccttcctctccaccaacaagtcctcctccggcgcaggcacgccacgccacgccacggcgtggacaaggccgagcacataaggcggccgccgccgcagccgcagccgcagccgcagccgcagcaaaagcttcgctgcatctcacaatgttaagcgcggcgaacggcggcggcgtccaccatgatcaccggggtgattacccccccgaccagcggtacggcaacggcggcgaggaggccagacaacagcagccttcgtggcagccgccgcgggaccaggtgacgcaccacccgcgggggcggagggcgcaccggtcgggcccgctggagtggacggcggcggtggtgttcacggtgctcgccgtggtggtgctcgtcgcggcggtggccgtgctggtggtggtgctgctgctgcagccgcgggcgccgtacctcgccatccggtcggcgcggctcgacgacctcgtctacgaccagcaaggggcgctggaggcggcgctgtcgctgggcgtcgccgccgagaacggcaacgcgaggtcgggcgccaccttctccgacttcgagctccgcctcgtgttccaccgcgtggtcatcgccatccttcgcgccgacccgttcgacgtcccgcccaaggggtcgctgccgctgggctacgtggtgcgctcgtcggggatcccgctggacagctccggcatggccgccatggaggcggcgctcgccgacggcgtcgtgccgttcaccgtgtccggccaggcgagcacgcggtggaaggtgggtggcctcgtcccgttcaagtactggacgcgcctacgctgcgacctccgattcttctggcccaatggcaccgccgtcgacctcagctgcagctccaagcccaaaccaagagcagctagctagctaaccatcaaaagaaaagatacttcatctttcttgctccaatccaagttctccatggatttctgatgtgatcaagattcaagaacatgccactgcctttcttggattaattcttcctttcatccttcctttcttcgttgattcagttcatgtatagattggtcaagaaaatgacaactacacccccaatttgtacaattaattagattgtgtaattgatttgaggtgtgcagattaagatcatagtaggtcctaattaaggggaaagaaagggtagtggaaacagtctggcatggtaaagtaaaaactgattaggaaaagatgtagtcttgttgcaagattgaacaagaccagtgacttcttttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55586 - DNA, 830 bp, Oryza sativa
cggcgatcgggagctccggcctggcttcactcagggggacacgcaccacctcccaccgaaacatatgctcgttcacgacgtagggcttgacagggacgctgcggcggggagccaggagattgttgctgccgcggaggtagcgcccgtacctgtcgcgcaggaggacgacgccgcgggcatcgcgaccgccgaccacgtcggagccggagcacgcgacgggctgccacatgatggcgtccatctccaccctgtcgcggtcgcgctgcgcggcgtccaccgggaggaaggggagcggggagccgtaggagtcgggggtcccgaggtagcggccgtaggcggcgcggaggcgcgcgtactgcggcagcggcgccgcggcgtcgatcggcggctcgacggcccacatcgttccgtgcctcgagtcgccgccggcgcgggggaggctgccgatgtagacggacctcccgtcctcgtcggcgtggaggtacgagccgctcttccagatcctcagcgcctcctggaaaacctccatcgtcgtcacaattagaaccaaaccgtggcaagaacacaagaagagaagaggagcggatcggaggagctcacctcggtgagcttattgatggattcggtctttatggtctcgcaattcttctttactgcggaagtagcttccgcagtttttgcagcgatttttcttattcttgtcgagtttatgcactgtctcgaaatgacgcttggctccattccccttaaggaggagaagcttaaacttcttatgaggaattcctttatcgagtcggagatagcagccggcgcatggcatgctgcccgtg

SEQ ID NO: 55587 - DNA, 8900 bp, Oryza sativa
attcctgcagcccgcaacaacaatgcatcaacttacatgaatataatcatacatagtctcaaacattgcttcttgtatttaggcgtcatactaattgtcaacatcataacatctaaaatatgtgacagatggttttagaaatatgaatagccaaattttgagcttgttttaacagtacattaatgaaatcaattagaaaagggacatagaagacatacttgactaaagcggtcgcaaaaccaatctcttcgggaaaagcgtttatttgattagaagatacatccaacgattttagcaaaggaaggctgcatggaaaagagccataaaaaagttcagatgatattagtggtccacggttaacaatggaaattactccctcctgtcacaaaaaccatgcctgcaaacttgaccagtaatctctatcgaaaaacagttgaaaatcttgatagaatgataatattatgaaactggttttgaaggcagtgacttcaaacatgtccacaaacgatatgtttccatgaccggagggagtagtaaataaggatagtccagtacatactctccaatagctgcggggagggaagaaatattgttgtgactaatgtttaatacaacgagcgaagacaaatttctgaggtcttcacgcaacacctcaaggttgttatgagccaatatgagcttctgaaggtcaactccctgaattacaaaaggaaaaaaacagaaacagaaacaaatttgattggcgttgcttgatatcccttgtttatgcagcatgtagggaaatagtcatacaggaagggggcgaatcgatttacctcccaccatttctcatcctgagcccccgtgtccaagttgttgtacacctccttgggtacctccctggcagaacaggcagaggtgtggcgtcagcgagacatcaagaacaagaagagcgaagctgtgtgcgcgcgcgctggaatcgattaacccatggtcccctagtacaccggccataatcagacaatgcaatgcagtaaactgatgtgagaagcaggtgaaggcgtcatggcgggaagggattggattgcgtcgcgtccgagcagtgggcggcggctacagactaggagagatcatcgtccatgtcgccgatggcgatccaaccgagcgagcagagagagacaatgcacctgagggatcgattggagaggttgagggagcccgactccctggcggatttgagcacccgctccatgcaagcagaagcaagcagcctccggcctcagatcgccatcgccggagacctgatctgatctgctgcaccagcaggcagaggcagcacgagcctacccacgaagaagactagaagagagatcatcaacttagcaaggacggagagctcaaacaaatcgagatgagatcttgttttcttttttttttctttttctcctctcttctttggccacacacacaatggagcgagaaattaattaaattaaaaggaaaaaaaaacagtattagtcaggcccactaatcctgttgggccaaaatcaacattgaggcccaacgtctatgtgatttggaccttggggtgaacaaatcaaggaataagttcactttaggttccttaatatgtcggcaagtctaaaattcatcctgtattctgaaaaaaaaagttactttaaaacaatcatattaatacatttttactttttactaatattcaattaatcacgtgctaatggataacactgttttttgtgttgaagtactttcccaacttctacagagttttctatagaaaagttatttttgaaaaatatattaatctatttttcaaggtttttaatacttaattaatcatattctaatagatttcgtgacgcactttctcaactgttactccctcgacttcctcacgtacccttcctaaacgattaaacggtgcggtttttacacaaattttctattaaaaaggttcttttaaaaatcatattaattttttttaaaaaaatttaaactagtactacatccgtttcaggttataagactttatagcattgcacatatttatatagatgttaatgaatctaggcacacatatatatgaatgtaaacaatgctataaagtcttataatatgaaacggaggaattacttaattaatcccaagctaatggataacaccgttattggtgtggaacgcagacaaccgcagaggcagctcgtccaatgaagtgtactacatacaagtatacaacatcataatttctccccaaaacagttatttctccgatgcaacatttgcaggtataccatctctttttttgcatacgtgcacaatgctggtgcacattatacataacacaagctggttccacgatgctacttgacaaaagcaaagaacaaaacaagagtttaaacacaccgaaacaggtaaaatggtctttaattattgattttcaaatcgaactaagaccggaaatgaatgacatccgggcagccgattcccaatccctctgcaataatctgattcttgagcaactccctcttctcatcgtacacggatatcttgacggggaaaccttcatcttgatcttaggatccagatcaccgcaattctcacagaccttcctgtcatatagggatacctcctctagattaactgccacttccatcacacgcctaacgaatcccaccaagttgtcgtcgggttggaagccatagatggtgaccttagataggttctcgtgcctgaaaccatcaggtgcagatgattcccaatctacaactgttttgtcaccataaccctcctccctcctgtcctcttcagttttcatgttgcaccaacgatcccatattgtaatgcatatctcctttagggagggtgcagcttcaagaatgaacattgtccaatcaatgttgcatccttcaggaacatcaacgagactcacacgctgcagcttgtggaacacaggccctagtagctttgggcattctggacgaacccaaatctgcaacatgagggtaacctaaattaattcagaatgcttacacgcttcagaattaatatgctttttggttttatttctctattttgggctttattctaaagccagatcagtaaggttgatcttccatgtaaacaaatactccctccgtattttaatgcatgacaccgttgactttttaatcaacatttgacaattcgtcttattcaaaatttttgtgtaaatataaaaatatttatataatgcttaaagaacatttgataataaatcaagtcacgataaaataaatgataataacataatttttttaaataaaacgaatggtcaaatgttaattaaaaagtcaacatcgttatacattaaaatacggagggagtatgaaacaaagcgtaagcataaaaatgaccggaacagcaagcagctagctagtaccttttcgctttcaaaattcaggagcaggtcgcttatggaggtgacggtagaaaggagctgactcaactagtgaggcttagacttgaaagcagtgggacatccccaaaagacaaggggtccccgtgacagtcccaatgaacataggccatatgtctaagctttggtaggcacttgagctcaacaaactcaaaatccccatagttgatgtcaagctcaacaagttgcgggtgctctatccgcagcacggccgggtcatcttggttgagacaagagaacaaacgcagatgcttcaactgtttacatgtggtgagcaggttggggatgtcaggttcagcgaaatgcaagtgttgtagctgcaggcgtgtgaggccagcaaacgcatctggaaaagcagctagaaaagttctgaactgcttgccaaagcagagcatgtgagtttcttcgcaacagcctccttgcttctcggttaggattgtgaactcaagagtctcgaggttgtaggtggacatggcgtgttgcacagctttgccgatggtgaggcaatcatagtatctcaagtagaatcgcaagctaagttggcgaagggcgatctgttgactcctgaagttgagtaatttctctgttgcaccagctaaagcctcattcatctgaaccacatcactcagtgtcaaaagatcgggtgcaatcttattgggcgtgaaggaattggcatcaacaacaatgcgggagagctcggcagggagcttagtcatccttttgcaaagggtgcaagctctgatgtcatcagccgtgtccagccgctcaagaatgttgagaagaacgtcattaggcagagtggtgagcctatccttatcctttacagagtggcaagctggtttctacattgaattatcattgcattgcatttagtattgccgaaaaactaaactaacaaagtgtaggagaatcaatcaaatcaatgcgaaggaagagaagaaagaggctacttacattgcggcgacctttcttgttcttcgccatttgatacgaggcttatcaatattgacttgacttgttgtacaagtgtcggtgggtgttgtttggataccgggaacacctcgcctctctatctattttatttagtttagagaaagagaaataaataggaatcctattccaacaaactgattgcttctggacctcctgccggcacccaaacacaaacgaaattgttgttggaagtcgattctatttcgaagagaccttttacggtgcttgaaaggtacccaaggtacctctcctcaacttaaacatccaccgttgattctcaaagagtatattaggaattggattaacataaatatgggcagtttagtaatttttctttagccatcgtgattaactgttctttatctttggttatatcttcctgcaagcttgcacacataccccgaccttcttttcactgagttttgaacgctatatgatggatgactccaatttcaaaactagaatttatacgtccatccatctctattgtctttagaaagtaatccatacaaagagatggagggacatcgatcaatttttcatttagaagtctttacaatcacttgcaaatctcatgtatatatatggaaagacgcgcgaatcaattacctagttctaatcatcaattatgtggtcttcaattagcatgtagttatacgatctgcaaacactaatcaagtactcctaggcatgtgcattggcaccaacggactgaagacgttattgtctctccgcgctccggccggaccaaattacatatctaacatttatgaaatatataaaccaaattacatatctaaccttttcctagtaatacctggcccacacttttaagtatcttttcataggtaccttctactgtgaatcgttagattggaagtcatcaacggatttggtgcactccaagcacggtagaaaatctacatagcaagtggcggcgctcacccctcgaactccaagggacgtggatggggatgggttgggctcagtctccttgcctttggcccaacacaattagtcggcctgctgcccaatagaatcatccgatccgacgacaggcggccgggccgacgtcctcctgctccgcctcttcaattcacgcgccaccatgtcgcgtcgccgcctgccggcttccgcgctcgcctagccgtaccctgttgtatttacttgtgattcttgtgattttggatgtccggactgtaagaagtataatttctaataaaatccatcgcattcgtcccggacaccctgtcgtaccagccattggttctcctctccctcccgttcatggaacgtgagcgaaaccctcttcttccacgggcagtgagccccgtttgcctaccacgcgcacggctggattcgaggaaaaggtgccaacccaagtcgaaatatcagcaagtcgagttgagttcgtgttctaactacaaccgtatctagtcagagcttctttttcttcatgcataacactcgagccgtcaggcaggcaggaggtcgatcaagcaacaacagagcaggcatgcaggatcacccgcatcgcccgatgaagaataagaaattaaggtcaccgccgccacaacaacgtaagctagctgccctcttccttccttcgagttgatttgtttgattttcggcgacctatactatatctgaatgcaatattgcaacggtaaattggtgatgcaacgtagaaaccagcttgcaaccccgtatagaaggatgataggctcaccaccatgcctaataatgttcactcaacatcctcgagaggctagacatgggtgatgccataagaacttgcatcctgtgccaaggatgctaagctccctgccgagctcccccgcattgctgttcatgtcaattccttatgacactaggtgaaacatcgcgcgtgctgatgtgagagtttactatgataacaataagtaaaagttgttggaattaatgaatgggccttagcccactcgaagattaattctttggaaaaatcacaaaagcccacctcatgggatggcatgcatgtggagtttagtaccaccttgcttattctaggagagggggacctccttaaaaggaaggatgccctcctagccacttgaagcatgtgtggtggagagaagaggggaaacacacgcgcgcgctcgctcgcctcgccgggccgggtcggcggcgcgcgtgcacgacgtacgcgtcgaatggtccgacgaaaaattggctcctcacccttgcgcagatgcagcctccttttgcagttttgttttgctgcaaattcggattagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacttgccgtcttcacgcaacacttgcgaaaacaatctagggtttgtctcctactctgtactgcgccgtcgctcgtagactactccatcccgctcgccggcgtgcaccggcgatcgggagagcaggtctccggaacctctgtcttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaaaagtaatgtgtaagatagcttaaacaacatttgtttacataagttgatgtgatttaaatttaaatagtacgtagaataatgattcaaatataaaactaagatgatgtggctttacagagaacaaattaaaatacgaaagataatttagaccatatgtctaagagctaaaaaaaattgagatgatgttgcttgatgagagaagaaaagaagaaagataatttgaaccatagattaatcatctaaggactaaaagcaatttatgtaatatgacttaataagagaaaagaaaaataatatgaactaagtgagtatgaactatatagatatatagcatattataaaaaaaatgatggagagatatattaaaatattatgtgggtttgatttaacatgcttacattttaaatctctaaaatttaataaattattaaattatagataatataacatgtttgcatgatgcttacatgtaccagttgacagcgagacgtctgtggtgacttcgtcaatctcaagaatatgtcggcccagtcttcgaagatgctcataggggtagggtttgcgtgcgtgcgttcatatgggtgagtgtgcgtgcgttgcactgagtaattctcaaaaaaaattgttagtggatgatgatgtgacatctttgcatgttaagttttaggaattagtaggttataactatatagtaagagatgattaagtggtgtggttcggatgaatgacgtcgtggctaatgcaatagacaaacttctcaactccaggagtcaacatatcatccttcgtcaacttagcttgcgattctacctggggtactacggttgtcttaccatcggaaaagcactgcaacaagccatgtccacatgcaatctcaaaactgcgagttcacaatcctaccagagaaggaatgagacccctgtgaagaaacgaacatgctctacattttttttgtggaggctaacttgttttccttgtttctgttcctgttgtcggcataaatataaattagctgattcctgtaggaacataacctcggcatggtgtttcagcatcacaggccaaacgacggagccctgcaatattgaacgatgtccaatatgatgcttaagatgaaagcgttgcttgtgcatttaattgaaataagcatacaagttagttttgtgtgtttgtacttcaaagccagaagtttgtatgttggtaacaaacaatataatccgtcgatgggattgatgcaatggcgttaccaacaatagaattcgtcaatgaccgcgatgtgatggtctcaaataatacccaaggtaaacactaaagctaggaggcagaaaggttccatgggccggtgcaagccaaaatccctacaaagcattcaagcgagatactaggtgtccaccgagttcacagtcctaactatgaagtgaaactgctgagctcacaatcctaactgaaaagcaaaactactcagctcacaatcctaactgagaagcaaacagaccgttatgagaaactgacatgctctaaactcaagaaaat

SEQ ID NO: 55588 - DNA, 3425 bp, Oryza sativa
gaacaattaaggtcattgtgggtatttgacatcatgtttttggtaaacaaatataaaaaaaggaaacatgacaattttggatggaatgatatttcaatactatgaaccaattctaatctaacaaggaggaaacctacataacaataagatcaatgctatagaactaaaattgtgatatctgaatgctacaaaatcaaatttgttaaacttttaatgattttagacattgtacaagtttgtgaaattgttccttagtttgtagcctttcacaaacaacaactttgtggctctaaaactattctattacatgtgtccatgaaaattgtgttttgtatagattggagatattcattaggtgaaagatatatttatatacaatatttagaagcagataaaaatgttgttgttccaagataattgataatggatatatatttggttttggtatactatgtgacacatgacaaaaatccaactgctgagtgtcactataaattattccatttaccatatgaagtcacttgacattaaaatcgtcatatgatctattaaggacccaagtagatacattatcaaaacaattgaatgactatatattttttttctaaattggtcgggttcaacttatctttatttatctcatactaatattataggttttatataaagtaaattgcatcagtagtacaagaacttggcaggtgggtgcgatttagtgcaacaacttgaaaaatgtgcaggccggtacatgaacttggcaatcaagtgcattttggtcaaaacgctgttacatataaatgattcaacatattttgtttcttctattatatttgtttcttctattataagcatactactagattattggtcatgagtacaattgaatatgtttgactaataaaatcacttggaaattatgttacaaccatttttatgcacttagttttaacgattattatatttttcggtttcaaatgacatactattttttagttttaacgatcattatatttttcggtttcaaatcaacatgctactttttattataagcaagcaaacttggaccatgatagacgtcattttgatgggtagacaaacctggaccttatgttatgttgccattttgattactgtatctcactgagtaggcaactatgatggagtataatctaatttctgtcgtgctttttctttggttactgtccaataatactttttttatttatgttgcagtaaatttttctttggttagtaattcaataataaatgtcaaataatacttttttgtatttatgttgtagtaaatttttctttggttaataattcaataataaactttaacggtaaacaactcaagtaaaagctcagcctgttcatacgctggttgggttggtttagttggttccgcagccgaaccagcaactggatggttttagccggtttgggctggttctagcaaatttgagggatgctgagttggtgggttggtttgggtggttgaccggtttagacggtttgagcccgtttaaattgtttattagaactgcacaactacactagctactacgatagctcttatatccacacttttataatctatcctgaaaattgagaaggaagaagcaattggcactaaactcgcaatgcaatgaccaatatatatacctcatttgcatgaaagttcttgtctaatgctctctgttttgtaccaatcaattctgatacaacagaaggttcaacctctaacactggccatccagaatattaagatttctttcacatacacagatgagctgagttggagattggttcatggtttacctgaaagtgtgagaggatggagcacccgctgcaatgctgcactaggttcgccgcctagagatccgtcgcaaggttgcctaccagggaggcaggaacagcttccctgagcccaatttctaccgcgccgccgccgccgcacgctcgcacgagggtttcgatgggagtatcaaattgggatgggttatatagtttcgctggttctatctctccctgaacacaacccatgtgatgctttaatagttttgacctaaaaaccgatgaagctggtaaaatcgctaagaacgggttggtccagtttgggttcgcgatttgtgctgagttcgcttgacctgtgaacaggctgagtaaaagccatatcacaatttcctggtaaaatgctagaatcttggccactgcttcacaattctgtacactcctattcatgtccaaacattcatgttgtgttttaattgttgttgttgttgctgatttaattttgtccttgaatttggtgtgttttaattgttgttgctgttactgatttaattttgtccttgaatctatttgtagaggagatgctcaacctggggggcctttcttcaaaggcaaaggcctgggagaagcgaggttagtcacttattcagttcctgcttattttccttttaatggtcacatgttttctgccctcaccgccctttatccgctatccgcagtgaagaagctgaacatcagtaacaatggtgtgtacccggcggcatccgcgaagaagcacaggagtagcgagatgttgagaactctgtcgttaggagtagcgagatgttgagaactctcattaggagtagcgagagatactctgttcctgactattgatgttgagaactctgtcattaggagtagcgagatgttgagaactctgtcattaggagtagtgagatgttgagaactctcgagatgttgagaactctcattaggagtagcgagaatactctgtccctgattgttgatgttgagaactctgtcattaggagtagcgagatgttgagaactctatcattaggagtagcgagagatactctgtccctggccataaatagtcgttgagaactctatcggtctaataagaccttatatcttctgctgcagtatcagctatttatgtgacgtctcattgttggtttgcttgagaaatgagaactagttatttaaatgtcagttttgcttggcttgagttcatttcagctttgcccggtgctgctgctgtaggcatgtaggagcatgcaggaggagctagaggtgttattctgttatgcggtgttattctgttaagcttttatatatatatatatatatatatatatatatatatatataaaagaaaatcgagaaggtgttttagagtaaggtcaataaaaaagcccgctattggttgtgataagtgaacatgtcgcctatagtaagcgttatagctaagacatacaatagagatatcatatacttgtaacataaatattttattgttttacgggcccaccatcttctcctcttctccttcttctcatccttacatggacgcctcttctcatccttacacggacgccggcaacggagaaggtggcggtgaacat

SEQ ID NO: 55589 - DNA, 2690 bp, Oryza sativa
cctccgaatcgagacacgtcgccatcgtcgtcgtcttccacccgctgctcgtttcctcgtcgcgtcgcgcgggagatctctctctctccctcccttccattaaggtaatcaatcaaccatggcgccctcccgcccgctcatgcgcgggatccgcccgccgcgcgtcttccccacccgcggcggccgcacctcgcccttggccctcgccctcgccgccctcctcctcgcctccgccttgctcctcgccctcatcgccttcggcgtcttctccctcccggtctccgcccccaacgccgccaccaccgactccgccgccgccgggggagacgccgagcccgccgatccacggcccccgcgcacccgcgcccgccgcgaccttaggtaaggggccgggttcccccccctccccctgctgccataatatctccagatttgcttcctccttcgatctgccgctgctaaccgtttctctcttggtttctctggagcagcgagggccttggggaacgaggagcacaatggacggaagtcatatcatgggagcccagggctttcgtctatcacaatttcctggtaaaataatctgctctctacacttgttcattcatctgcatcctctcctcgcataccgggatggcaacaacaatggtgttcactgaatgcatgttatgagaatggaatgatagtactgatagttcacgctttgttgcctgatagtactgataattatttacttttctgcactttttgttgcctgatagttcacgctccaataactctgatagtttacaattcatttttgttaaactgtatgaattgctgatggcttatctcttttgttagtccaaggaagagtgtgattacttgattggattggccaagcctcacatggtcaaatccacggttgttgatagcactactggtaaaagcaaggacagcagggtacgcacaagttcaggcatgtttctccaaaggggacgagacaaggttattcgggccattgaaaagaggatagcagactacactttcattcctatgggtatgtcatggctcaaatgttttctcttctgctatttcttttcacaaatgagccaaattcatagtgtggccatacatgtcctttttatttcttagtcatggatagtaccccattggcacgtaagaggtttatggcattgggttgttaacaatatgcagttcaataatgcaactctcaacatttccatatttttatcatgcgaaggtttttatcatgttgttgtaatcgcaataatgatttgattcattctggtttgcagaacatggagagggactccaagttctgcactatgaagtcgggcagaagtacgagcctcactttgactattttcttgatgagtacaacaccaagaatggtggtcagagaatggctactcttctgatgtatctgtacgtatggtactcatttataatgtattggttacaagtgttgttaactggatttctaattaactccttcacaatgttatcaatggaaacagatctgatgttgaagaagggggtgagactattttccctgatgcaaatgtgaacagcagttcattaccatggtataatgaactttcagagtgtgccagaaagggccttgctgtcaaaccaaagatgggagatgcgcttcttttttggagcatgaaaccagatgccactctagaccctttaagtttgcatggtcagttcagtgacttatctgctgttcttattactttttttaaactgattgcatgacttgaagcctgctgggcacttctgttctatttgctatgtcctgtttaaaacttccatcgatgctccttcagatactttacgtgtgttttatatgctccaagcagtccctttacaaatttctttatggtctgagcagggggttgtcctgtcatcaaaggaaacaaatggtcatcaaccaagtggatgcatgtccgtgagtacaaagcttgagctttctgaagtcgtgattaccaaaggtatctagtgttcctatggatctgtactgagtaagatgtaaagctggcgatattactgcatattgctttcttaactagttttggtcctcttcaaagtgacttccactcattcaccctagcaccagaaacccaggaagcaatatggctttgaggttatctagcacctttagctttgcattcttctcttttcgtgattactcctaggataggagtcatgcattcagatagtgttctatgtaaattttcagctgaggatggttaacgtttgcttgtagtagcttgatatctgccactttgtgagatctttactatctgaagaaataatttgctcaaaacttgttttataaactgatgtgctgtatctttctttggcagatggaccctatataaagcattgactggggcactttccaggatggcagttatgtaggctttagagatccacaccggtggtattctttgctctctgagaatatatagtagaggcactaagcaagggggtttacttgtccataccgtgtttttggagatggtcttgttgaacctggcgccttttcttctttattttttctggcagactacagaggaatgaatggtccattgttggggacatagggtgaggcgtttgatttagtttgttttgtggtgtattgctatctgctaatgttagtagcttaattatgtacactg

SEQ ID NO: 55590 - DNA, 3548 bp, Oryza sativa
ctggttttgtggtaagtttctgcaataattaaattctcttttttttttgtttcataaccaggcatgtccaacactccaaacacaatagtatattaatgtcccgtgattctctgcaggttcaaccatgtgttggtgtctggagtgacaaatgccgttcaaagtatggaagaaggagaccgttcattttggctggatgcttgatgatatgctttgctgtgagttagatgaagtttgataggttatcatatgttcccattctttctgtgctctaataggaagaaattcatacgtaggtaactttaatcggattttctgcagaccttggttacattttaggagataccactgagcactgcaggtaatctttgatacttctacttcctttgatagttttcttcacatcaagtgtgccgccactaaaatgacgagtactgtttgttcagtacatataaaggttcaagatttcgagcagctattattttcgttcttgggttctggatgttggatctcgcaaacaatacagttcaagtaagcctcttcaaaagtttgcttgtcgtcatttgtatttgcaccaaatttgtcaaaatatatgccatgaattaattggattacctcaccatggatgttctctaatatcctgtttctcctttcctttttccctacatacagggtcctgctcgtgcccttttagctgacctttcaggtagttaatgttttcattttgaatgtctaccatactggacccacttaaatatcagtgactaaatgatataccttctattacgtaggtcctgatcagtgtaattctgcaaatgcaattttttgcacatggatggctgttggaaacgttcttggtttttcatccggtgctagtgggaattggcacaagtacgtacttcatgtgtcctttatgtgcttatgttcacatgaagtttgttgctcataagtatgcgctgtcctatacatgatactgttggtaaagggttgaattgacttgttctactcaacccaaatggatcattgtacaattggtaacatctgacggctggtagtcaatctgtattaataaacgatagctatatatacatttagcaatttcagtaccatttgtttcaaatactggtgatgttgtttaccctttgaatgatacaagagtagcgtatgtacaagcaaatcacggtaaaacattgtctcagcatctttctcttctgtggagagagtatcctatcacatgttgaaaagtactatacggtgattacctgtttgaaaggactactgtcttggtcctcttgtttaggcatcttgcttgatgaagtccctctagttagtaaggttttttttggcatgaaatctgagtttatttctcataattattgcaggtggtttccttttctaatgacaagagcatgctgtgaagcttgtagtaatttgaaagccgcttttctggttgcagttgtaagttctcttaaatcccgctgctgcgcctgcagtagaaatttcaagctgttttgtaacagcctgcagagctagcaggtcattcttaggaattgcatgtgatattattttgtggagtgtggactgtaatgtgtgcaagctgataagccctactatgcaggtattccttttgttttgtatgtctgttaccctgtactttgctgaagagatcccgctggaaccaacagatgcacaacgattatctgattctgcgcctctcctgaatggttctagagatgataacaatgcatcaaatgaacctcgtaatggagcacttcctaatggtcatacagatggaagcaatgtcccagctaactccaacgctgaggactccaattcaaacagagagaatgtcgaagttttcaatgatggaccaggagcagttttggtgaatattttgactagcatgaggcatctacctcctggaatgtactctgttcttctagttatggctctaacatgggtatgctaccttaagacatctatgcatgtatatcagctgcatgctgattgtctcttactgttttggaatttgtagattgatggtgttcatccatatcgtttgctttgcagttgtcgtggtttccctttttcctttttgatactgactggatgggacgtgaggtttaccatggggacccaaatggcaacttgagtgaaaggaaagcttatgacaacggtgtccgagaaggtgcatttggtttgctattgaattcagtaagaacccttgatcaatgtgtttactataatttgtagtatgtcgctatgtttagatgctgttacaccccaatcatttctagcctttctgtatttttattggatactgctagttgttgctcttactctatcaaacaactagctgaaagtcttaaaacttagttcatgtgctttcctattctttgtgccctgtagtggtttaagcatttcagttggattctagtttgaggtgataagttggtggcttcaacgtttgggtctttaatacaggttgtccttggaattgggtccttccttgttgatccactatgccgactgatgggtgctagactggtttgggcaatcagcaacttcacagtgtttatctgcatgctggctacagcaatattaagttggatctcttttgatttgtactcaagtaaacttcaccacatcattggagcaaataaaacagtgaagaattcagccttgattgttttctccctacttggactgccactctcggtaagtaccagacttcacaaaatcctgccttgttgggttggaagctttcttacacttggctcttgaatgtcacagatcacatatagcgttcctttttctgtgactgctgagctgactgctggaacaggaggtggacaaggtttgtgttgctgatgtttttttcttttacactatgctcatgtgattctcattgattgaggatattttttttatcaatctccaggtctggcaacaggagtcctgaaccttgcaatcgttgttccgcaggttagcatgttcataagaaacaaaatgtatttctatatgtgctgtcactgaagatgtcttgaccatttaatactccattattctgtgcagatagtagtgtcactaggagcaggtccatgggatgctctctttgggggagggaacgtccctgctttcgccttggcttccgttttctcactaggagctggtgtcctcgcggtccttaagctacccaagctgccaaactcttacagatctgctgggttccatggatttggctgagcagaacaccagccgcatggtgtgtaacattgagaaatgcaactccattttgccattcgtttacagtgaaatgattctttttacctactactacaacagaataagctgaaaagatagagattaggatagagagctaggtaactagtccagttaggttgatgtgcatacaaggcaattggaaggtgtaagagctgtatctacttttttgacagaaaaatgtaagctctgcccgaatgacatggcggatagattttacaatggatgtaatcatgtactatatataacacgttttggtcacagcttgc

SEQ ID NO: 55591 - DNA, 1792 bp, Oryza sativa
agaagaagaacaaggccgcgtccaacgccgcagatgcggatgcggccggggacgccggggccgacgacgacgccgccgaggagaagcctgatgtcaaaccccaggtacagccacagggagcgcctctctctttgttcttagggtttgggggggttcatgtttttttcttttttccttttctttttgcttgtttggtctgacctaggaaccgtggttgccgcaggtggaggtggaggtggagtacgtcccggagcaggcggacctggacgacggcctcctcgccgacttcaagagcatcttcgacaagttcaccttcaaggattcctctgccgacgccgaggtattaccgcttcctcttgtgctgctacggaagacaaaccgatcgatataagattcctctctcatgcttcaattttgcctgctctatgtggagaaattgacaagtggattggtatttttctgataggatgacgagaagaaagatgaggctggcactgatgccgcaaagaaggctgcagggtctgattcggacgacgacgagcaggggacacagcaaaagaaggaagggggcttgtccaacaagcaaaagaaagttcgttcttcgcatctccctattgttgataacatgtttcagtgcctccatcttccttctatgttaattcaccttaagcttaagtttttctttccgttttttagctacaacgaaggatgaagattgcagaactgaaacagatatgcaatagacctgatgttgtggaggtaagctacccttattagttatgctaagattaactggtagttggctgcttgatgtacatctgtttgagtgtgttgtcactatgttatgtcgtaattgctcatctagggtgtcactgccagcgctgccagatataggtgaatctgaagtgaattcacaacaatgtgttgaaatgcaccacttataagattaaagcttctcaattctcaaacgtttttgtacattcattacctgtgcaaggggtacacccttctgttgttcacagttcctaatgctgggcattcttgtattttagcttcattgaacatacatagtaatgtgctgcatgtatttttcttgattcttgagggtagaattgttacataaattccctagcaattgcagcaaatgtcttcatggtgcacacacttgtaccagtattgctatattggagtgcaaacataaatattacttttatcttattgaggaaaatgaagcaacgggaatgacaccagtaaagtagttctatgtaaacttgttgattaatctttgtttgagacatctgtattcttcttgctaggtctgggatgcaacggcatcggatccatcattacttgtctatctgaagtcctacaggaacactgtacctgtcccaaggcattggtgtcaaaagcgcaaattcttgcaggtttgtgattacctaccaacctgccatcaatgacaaccatgttgttttgcataatattaatgaagaacagtgcttctgtgcgctcctaaaaaattgcacacaaatttaaatgttgttgttagtactggagttcctattaagtagttgcgactgtcattcaaagccatcattttgcttcaaaactcacctgtagaagagttgaatagttttttgaatcattttagtggagtttgatgtggaacaatttactcaaaaagaggtgtggatggggagtgaggggacataatgttgataatttacacccctcttatacagatgcaattcttgcagggatgctgtaacaacctgggagcaagagcttcatggtg

SEQ ID NO: 55592 - DNA, 1351 bp, Oryza sativa
aatctttggtggtgtggaataggcaaaatacgttgggtggcataatgttagatgaagtgattgatacacaggtggttgtagaggtaacgttgagtgatcaagtgcaggcttgctggagcaaaaagaagatgatgcctcactcagtcgttgacggcacaatctagctaacctgctgccattgtggtgattcatgcctcctctccgaagactctttgacttgtactaatggagtggactgctaccaaacacgcatgaatagacgaccagatcatcatacaattcatcaaaattagcactcctagtttcaaactacttaacaaaggaaattcaacaaacttcattaaaatagtgtagtgtatttttttctttaaaaaaaaattgccaacgccaatcgcggagtttcacatggaggagggaagaatggaatgagcgccaggcgtcgcgtcggcgcgcgcgtgagtgcgtgatttgtgttggttgtcttcctcttggcttcgcttcgctgctttgccgcgccttcgccgagggaggccgaccaacgcatcaatcaaacacacaagcacaccacgcggacgcagcagcaggggaggagacaatttcctattcttcctcgccccgcgtcgcctcgcctgagtctgactctccaaacgccgaccagtgacgccgcgagccttgccccttgcccgcgcagatctcaccaaaccctaccagatctgcgccccgccatggactccgccgccggcggtggcggcctcacggccatccgcctgccctaccgccacctccgcgacgccgagatggagctcgtcagcctcaacggcggcaccccccgcggaggctcccccaaggaccccgacgccacgcaccagcaggggccccccgccgcccgtaccaccaccaccaggaagctcgtcctcgcctgcatggtcgccgccggcgtgcagttcggctgggcgcttcagctctcgctcctcacgccctacatccaggtatacccactaccctttgctctcccttctgcttcagaatggagagtatccgcatttgggaacgggaacggatcgcccatatatgcgtggcttgatgctcccttttctgtttctgctgacgcaaccgtattagagcaccaaaattcgcgccctacatattttgtgctttgaatgcaactgcttactgaaatcaaggttgctgccaaatggcaataagtgaaaaatcagccaggggaagacttgcctgcttaggaatttcgataccgtaaatttcgatacacaggagaggtttaactagatgaaaaattcacactcttcacatgtacatgttaaagcatggtttcttaacaccgaataacttg

SEQ ID NO: 55593 - DNA, 10476 bp, Oryza sativa
  unsure (1)..(10476): unsure at all n locations
nnnnnnnnnnnnnnnnnnnnnnnnnnnnnnnnnnnnnnnnnnnnnnnnnnnnnnnnnnnnnnnnnnnnnnnnnnncactgcaagatttagcggaccatatcgtggatcagtatactccggaaatggcaatgcactgataaattcagcaccatggcgaggcaatcgctgatcaaatgagctagaagggggccagtcctttagcttaagcatctcaggccagtaggtcctgggatgagttctgccccttgtatatcccataaaaaacatgtgtatgttaatttccacctggaaaatcagatatgaatgtagtaagcgccagaaagttcaactgtagatgaagaaagataggtttctctcatttcaacagaaacacataacaaacattatttaatagggaagctcaattcactaatggatcaacaaaattagttaaactggtcaattatttaatcattatgtgtattactttcttctggaaaggcaacacatgcacacattatttcattgtcgcatttgaaaataagcatcatctcatgtatttctgccaaaagataaaatcaagattatgccaggtatgtaaaaagagtatgaactgtggtaaagtacaataaaccaaacccgagaaaaagagtactatcacataaacacattagagatcctcacctcacaccagtcgaggcaatctactgccctcacagcaaactgctcatcttctgccttccctttggttcgttctcgtactgcccgccacataaccatcggctcccagctaagaccagaagttagcttaagagtgtctgaaacaacaactggttcgccctttgcccaatgcatctgaaagtgcaacaggtcagcgtcctggatatcagtggccaccggacagtataagtagttatcactcgagtcctccctatttgcagcctgacgtaatttcttgctgtcacttcttatcttgcctgagtgatcaaaacaagggcacagctcacttgttctacctagttcttttgcaaatgtttcactccagaagaccttctcagatctatcttctaattcagggagcaacttctctggaaacaagcatttcagatctagagatgaaaaactgcagtcttccttttcctttcgtgggcaaggtatgctaccattactgtttgctttccaaagtaacagagccttcttttggttttcgtcagaagccatgcctttgtttgactcactgttttgggtgtcgctgcgacacttcaaagagtccctttggttctcaccatctgacagaatcttaccaaaagcataatccttgtctctttcttcaggatccaaaatttccacctcttctcctccagggatctcacctttgcgaagctcctggcagcaggtcaagcacaagtcatagaaacagtgcttgcagcttctatgaaaatcaactatagaagtgctgcatctattgctgcagttgacaacaaaattggatcagatgctttctggtattatatcatagcataaagtgaacaaggaaagaacttaaccaatagacacgctcatctagatcacacacagcttgttccacctttatttgatcaactgaaacacctgtaaacaaaacaagatgagcattcatagccataccagcttccagtctgtgtgctagagaaccataccttgtatcttagcctctaattccttctctgccatctgctcctgtcgcagttctatcagccaaggacgcaacaagcgtaacacatgacaggcataacgaatctgattttctttagaaatttcctttcttggaggctgcttcacaatgaatggaatgaactattcagtaagaatactagaaagtgtcatttattaactttaaaaagaatatgtcctgaagaaatggaaatgctgtaaagaaaagatgagatggaaatgcaaacctcttcgacacctctcattcgcaggcatgccttgcaattacaattcttgcgacaataagggcattttgcagcaaattcattttcaggcaaatcaggatacctgtccagttgaattatacaacacatgggatcaccttaaaaggttactagaggtatagtgcataaaaacatatgtaccaaggcaaacataagatgaaacaagaataataccataaaaaatgtaagcagaaaaaatgggtgttatgggactatgggtaagatgaaagcaaaatgtacatttaagcctataggaaaacagtaggctgggagtccaactagtagactagaagtttgaggaaacttggcacaccattgattaatgcatggcacacaaaagcgcttattgttgcaagtcttgcaccagaccactctccctttgtcatttctctggcattggtgacacattaaggcgttttcacctgtcaacattttcttccctttctacataattgaaacaacgaaaagttagcacacccatcaaaacagttatacaattttttttaaaaaaaaaacttatacaaagaaacgtgtagtttatgaccccattattttctgccgctcctgtgtctcctctcttacgcttcttttcagtcttcgaaaccttatcattgactaacatcttgccttttactgcatttgcgttatgctgtcgaggaaagaaagtcatgggttatttcggtatcaatatcaaagagctggggttatgtttcactttgtaaagaacacaaaagtgcaccttccaagcaagtacatgaaacctctgaaattttcatgctttgaatgacaataacatgcttaaattaagcatgtagttagttacatcgaatcataacaggtattcagacattatctaaaaagacaagaattcaagcaagcacttgcactgtcataaaaaatctatgcaaaaccagcttgcatagaatcttgaaacttcttctaaaaaaaaataatcttgaaactgaccaagttcaggagaaacataatggtgggtttatcattaagcaataaataaagcgactaaaattgacggtgaaactgcgatcttactagggagacttgataattaggcccccacaaaacaaaattaatttaaagaagagatttggcttggtcgatgaatcgcaggtagcttgagaaggtatcaggtactcgttcacaaggtagcaggtcgagtaggaaacgttcaaaagtaacgatgcaggcaaatatatagtgaactgcgtacatgtcacaaaccaaaccgttcccaaataacttgtaaaaggaacgttgagtagtttaccctgtgggttttgatgttctcttgatccactttcttttttctgggtcctctcttcttccctgcatcacgtcttttgggcttgttgagaggctcgagaagttgatcagttttctcgacatcctattggcaaaacagcaattggtcagtataactttataagttctccctcaaagagtaccaaaatccatactagatagatactccatccgtttcatattacaagtcgtttgacttttttcctagttaagtttgttcgagtttttgactaagtttatagaaaaatgtagagtactatttcaacacaaaataaacatattattaaaatatattcaatgtagatttagtgaaactaatttgacattttagatgttgttaaattgtactataaacttgatcaaacttaatcaagtttgactagggaaaaaagtgaaactaattatagtatgaaacggatggagtagataaaagcacaaacactgaaacagcaacggatagcattttggagaaagaaccgaaaaaccgtaactttctttgacgtaaataaatttaaagatatttgtagcaatcgggcgaaatgagatgagaaagcaatggtggaagaatctaggggaaaaaatcaagatgttttgggatataaagggatcggattcgaaggaataattccgtactagtatatcctataccagtactagtatttttttaatcagattcagattcgatacagaggatacacggttgctggaatggaatggaagatactcgagcggaaactgaacagacaaaacaaaatgtatattgattgattgaacacactgcgtctgcaatggctgcttgattagcaacaagaacaagctgtttgatcaacacatatgacaggacagagggggggagagagagagattccctacctcatcatcgtctggcgcgttgaaggcgttgggcggcggcttcctttccctgagcgccccgggcctcgtcgcaacaccgcgcccttcttcctccggcctcatcgccggcgggcggaaagcccggtcgccgttccggcgcctccccttggcgcccgatcccctctgcttaccactcttccgcttcgcctcctcgccggatccgtcgatcgccacctcctccaccttctccgccgccatggcggtgcggcgatggtattgatattggggcaaaacgagagagatagagtggcggctgcggcgtaggctctcaagtgtcctccttttattacccgcgcttccaatattccaaccacagttacaaaaaggtcctccaagtttttcctttttttcgttttgctttcacaacatttgaatgcatgcccgtgctttacattgcatatccaattttccaaataatactaataccgtgcaaatgcaactggttacttatatataaatatgatggtcattaagcttcaagttttcactagtgttttccttaggaagctcttacgcacaaacacaagaagaaacgttcagggatctttcgactaactccgtgaggtggtgagcgtttttttttcttacgcacaaacacatagtatatgtacgatgttttgctaacgtatggattttcccgcgcaattttgagcgggacacaaggttttaaatgtatgaattgattgaatatacaataatagcttttgtttcgaaatatacgtagtccatattttgtatataactatatcagtcgatatctcgacggttacaatctaaatccaccgttattatttgaataggttacatttttaatatagagtatgatgattagataacagatagtaataaattttcccgcgtaaaattggtacgtgcttttttatattatattttaaggagtggattgcataatagagtactccgcgtctagaccatagccatcattctctcttttaacacctaaaaaaagcatttgttcaatgtacagttaattcaccttatttaaaatgtacagtcgtttaagcttgatcttttccctctaaaaaaatgtatatctcttgcttctgtttacgtgcattttgtattttttttacagtaacatcaatcatcaatatatatacacgtaatatggtacacacgcatagtgaaaatatttcatcttgttttgtctgattattaaaaatgctgtaaaccatggtgattatttatcacggaggggacatgtaaatgagtaactagcgaagatatactgtgtacacaatggaagcaagcaatagaaggagtttgtgatctatgtgttttgaatgtgtgattttatggctgggtttgtagagattggtcgaagcaacacctctctctctctcttatactatggccgagtttagttttaaactttttcttcaaacttctaacttttccattatgttaaaactttcttacacactaacttataatttttccgttccatcgttctaattccaatcaaactttcaattttggcgtgaactaaacacatccacgtacaaactttcaatttttccgtcacatcgttccaatttcaacaaaacttccaattttgatgtgaactaaacacaccctatgaatggaatcgggtgaagggaagggtgtgttttagttcaagctaaaattggaagtttgtttaaaattggaatgatgtgacggaaaagttggaagtttatgtgtgtagaaaagttttgatgtaatgaaaaagttggaagtttttttttttaaaaaatatggaactaaattcggccgaagtgtactcaatcatagaaacaagaaaatgtggggggaccttgtgtaaaaaaacaggtactagtagtatgtcatgtcctcctcgagacgcgcacaggcaggcaggcaaaacaggcggccgcaccccgttcacttccttctttctggctgctgcagccgtaccaacgcacacacgcaccgcacctcctccagcgcgcgggcaccggactagtaggaggagtagccttcgaattttgaaatttgaaccctcaaccatttggagggaagctggaaaggaaaggaatccatcccatccacgagtcaattcaaggtttgaccacactctttccgttcccctcccaaaggcgtattttccctcgatacgtctcctttcttccccaccaccaccagaccagagacagggggagagatggtgtggctgcagtacaccgcacccgctcccagcgcgccgccaccgcctgcttcttcctcaccggcgtcgccctcatcctcgccgccgcccgcctctcctacgccaacatcgagccccagcgcgccaaggccgccgaccgacgccgtgtcctcgaggacttcatccgccgcaagcgcaaccacgccctggacctggaggatccccctcctaaaccctagctccacctgcctcctccttcttccttcatcccaggttccccgtcagattcctcactctgctgctctaatctaatcttgtaccatgtggattggatgcaactccacctagacctagcaaggaataaatagcatagggatttctattttacttactcactcactgctgtatgcatcactcttttgcctaaattacatcaataatattaatatatcgattggtttattcattcagtggtgattattcctgcaattcacttcttacgtccatcaaacgtttgttactcttactaacttttattttcattaatttcttccgcgaatgccgtctctaattcttgcaatccaacctttcctactcacaattacaacagcatgcgaatgaatctcgatcaagggatcctaccactgttttctacttcatgtactattcattccattttttgttttccccctttaatttctttacctctccttcagccttgtcaattgcaattcaggtattgccaatctaatggacaaaattacccccaaggagtttgtcataaccacatctacttcttttaactccactaaacccattgggacacctctgggtttgctaccaatgctactcatcatgctgcctatatgtgatatctcatcactgctaatcaacaactgaactgacaagattatctgcctacatagtcaagaattactgcaacttgataagaatatttttgtacaactaggaacccttatgcctgtataatctccacctatgctactgatttccctcactgctgtatgactcactacatttcctaaatgtcatcataatacattatttgattcatcggctgtttcccaattcacatgcatcgcacattttcgattgggctatcttcttttgttttcgtacttgatagaaccatgctcctgttttcagtcttacaatctgcgtatctctcctccacctgtcagtttattttgcaaatctcacaatctgcgtatccctcctccagctgtcagttttttttcaatgcaaccattttttccaaaggataggaaacaaataatcaagagaacctacttttgtcttctattctttctgaagcttgattttattttttttcctttacttagcttcccttcaatggttcaacctgagttgttgtcaattgcacttcaggcatgattccgggacataacccagagtatctactagttctttcaagtccactagagctcttggcagagcttttggtttataacatcatcatactatatgtgctatcatcagtacattcaacaacttagaaatgagaagattatctggaaacatatatcagagtcattgcttaatgttgcatcttgataaaaaaaatgttggcagcactaggggccattattcttgatattcagtaaccctcgggtaaacagccatgtttccagggctgaaggctggataggccatcttttttagctattttcatttccttcctcatattgcattctgatgtttcaagctgttatgaacttacgacccatgctgcatccacttttttctgcatgcattatgtcagctattttctagttcaagcatacatgctcaaaaatttttatattcagaacatgttattcacattttctaatcttttcttttttgttgtgtaattgatgatctatgctatgtagacatactatacatgatgaaactaatggcaatccggttgtcagtagtcagtatgtagaggcaatgattttttagaagtggatgtggcctcatatgacaggcatcaagtcattgggacaaagcggtaaggtgattcttttcttgctgaaattcttcaatgtcaaatgaacaacaacaaaaagcaatggcatgatttctgagggacatatgattgctggggtttattctatgaccatgttagtccaatctgccaaaaaaaaaaaacagccactattgcacacagatagttactgtaaattcccctttctttttgcccggtcggcctgtaaaatcctatttccttttcctctttttaaattttaaattagtaaatgatcttagtttcacccactatacaattatgcctgccaattttcacttatggcttgattcctcactgctagcagttctgtctctcttgtgactacacaggttcatcatggtgatttgttggagtattcttcaataaggatcgtgaatgtttacagtgcagaaaaatatgtgttggaatgttgatgaaatcaaataatagaccaatttttttggtggagattcttctgtctcaaattctcaatgttgagatagtttgcctcagcaaggtcagttatcaattttgtgcaaactatggccgtactcctgcaaccaaaattcttgtctcttgcaatgtaatatctgatcacatggaatgcattgcctgtaggccgtaggggcggtttcttttcctgctctgtgttggttgcaatgtgcatgcaaggattggtcatcaatttgggaacacctcaattctgacatgtaccaatttagtaccattcatggtggagccattcaggtgaatgatccagttatccaggcaagtactattatgcatctagcattgaccttagttttttttttctattcagtataatcactcgtcatgtttggaaccatttggttgtatttgtcaatgaagtttgaatatacagggtagtttgtgggtagttcttgctgtgttttctttccacactagtgtcgcccgtttggtaacataactttaaacacttaattgtgtacttggtctaaacaaaacacatagagctggtaaccatagtgggatttgatgatttaccgctgtatttttctgaggactaccctcgtacagtagaaactagtgtagaaagtagaaagacaaggaactctactgtatacaatcactcccagattgacctgcaacccacacaggacgttcactatgcaaaagaccacgtggacgtcaatactatttgagggggcccataactatatataggcctgccccccatatctccgcatattttggatcgcttgtttattcgggctgggccatatgtagtactggcccaattcaatttagtaacaaacaattaattgtaccggtcccagttaccccgagcacaaatcagataatctctggtcaaattaggtgtcaaactgatacaatcgttcaggtctatgaattatatatagtgaggatgaggatttatatgtatgtaaaaaaccaaatatttttagtcttggctcccttctttttaggatatacggatcatatcatatactaccaggagaatcttcacctgattctaacagcaaccagaaataataaaaaaaatagagcccagattaattaaggacggacagccgaaaagggggattgcccacaaatgttgcaattagatactccatagtatattaagtagctgattatattaagccatagcccgcccacttcaaccaccgtgactgcatgtagtaggataactaaaagctttatacggagtacatattgatctgttcatgtgcctttgctactgattagagaaaatctggcatgcaagtctggttgccactgatgtttgatactacctgtgagctctgcaactgcaagagtctgcagagctgaaatcaatttaattaagcgcactgattacaatcaatctttgttgataaatcaaagcctggacacatcaagatctatcggctgcattttctctctcaaaaaaaaaaaagatctatcggctgcatcgcacagtccatgcgcttgtctctagctagcggaagcagggaaagtcttgtctatcttttttctggagtagttgagactttgagagagagaagccctgttggcgcagtgcctgttttgctgcttggcgt

SEQ ID NO: 55594 - DNA, 6894 bp, Oryza sativa
aaaacttaggacaaatgtaaaatgacatataatacggtattatggaaagagtaagatttaatatattggttaagctatttctaccgggggggggggggtatcgataggaccaaaatttcggatatttggtccaaattatttgaaatttgaaaaaaattggtcaaatttgaataattttatctaaattcacaacaaaatggaaagaaccaaaatttttgggtgaaatagtttcctatcggggaagtctgaatgtctgatagacccaaagtttccctccggaaattttgaaccctgtgtaagaaaacatggtgagcggaccggtatacgatatgtatatcgatggatgataagacggtcggacgatggcgtgtggtgcactggtaggtaaggaaggaaggtacgtgcagttgccgcggctgagctaggcatgaaactcacatgcattgcatatttgcatggtccctcccatcccatgtatagtatgtactcgtacagcacaggtagagatcgatgatggacggaccgactggtggccagccaggcagacccagtcgctgctgcttgtccgcctgtaaattcagttattagggccatccatgcatttgctttattgcatccccacaccgtaccgccttgtgccggcccccacacccagccccggcccttatgattaattttctactattaccacatatttcttgtctgatagaaaaacaaattaagagttggatgtaacatatcctagcgtctagatttattgtatttgaatatgtcacgtctaatcgcgggtttgtttttacgggatggaggaagtattatattcctttcattccaaaataaaaataacattttatactatgtttgtagggagtattccctccgttcaaaaaaacctcaaaccctagtatcccaataaatttttaagaaattgaacaaaagaccataataccattagttagtgaaaattgtattagttgatgggtacgtgagcggtattgaagtaataagattttttttatttgcggattggtggtaggtaagaaggtaggagctggtttatcttagaacaaacttcaaactctagcagttgatttattttgaaatggatagagtaatttggtagcttcatcatgtcccatcaatcagggcactgattccatccatgcaaactaaacatgcaaattactgtaaaataaaacttactccgtgcaaaatgtaggatggaaatgattagagaaagggtgtgattggttgagaagagaaagtagatgaaagagaatggttgtgattggttgagaggaagtaggtggagaaatatttttattttgagataaggtattgtgttagaaatagctatcaaccgtattctaggattaagccaaacgtcctatttgtaaacgaaaaatattttgtgaataaaacttttatatacgtgttcttagcgatctaaaagtaaaggctaaaaaataaactacgatgaaaaaaaaaccctaaaatcaactctaaatttaaggttgaaaatttaaattttggctgataagcataagcataagcgaaaagatgagaccgtgtattttggaatggaggtagtacatgcatgtagagtgggttagggatccgaggttcaaaattgtgcatcagtagttggtactggcgtacaatactgctagaaaaaaaacagtagaagcttctggcggttacagttgtacccaaaaaaaccttctctaaatctagtttttgtccttttcatattcttagaagttaactatcaaccgctacttctcagaatcttgagctcattcatacaagtcctaagtagtcacatactatatactgtatatgtctatccgctctgaaatattatcttcttcccaaaaagtgcattactgactatgcattactctctttgttttacgagggtgctagttgtgatcttaggaaatgggcaagaaagcttacggggactaaaattatgaaagagccccatgtgtgcttatagggatttaattatattattcatttcctttttttcacacagtttaatttcctgcaaggtggaagactggaagctactgtagtgatcagcacacattcctgaaattaagttctattccccgcttaattttacagctatcccctaatctttcagtattatagtaatagatgatgaatgaataatatagtttcctttctagtttagtactctacatgcttccaattattgattggattagatagccaatgtatagctagcttaataaaaattaattcagcagtatcgcaagagacgagagataaataaaaaggttaggaagaggctgatttgtcatttggtgagtaatatataattgctcatagcctttttcagtatgtagctaggttttacttatatttctttttccacgtggtagtacgaattgtggataggatcagatgcacggtgggcagaggccattggtccaagtaggatcacatcaggtgggatttccggtgggccccagatctatagcatatactccctccgtcccaaaataagtgcagttttgcattattcacgttcaacgtttgaccgttcgtcttatttgaaatttttttatgattaatatttttattgctattagatgataaaacatgaataatactttatgtgtgactaaatatatttaaatttttcataaatttttcaaataagacggacggttaaacgttgggtacggatattcacggctgcacttattttgagacggaagtagtatgaatgaataggttgacaattgccctagatagctcctctaattcttccacgcaatgagtatactattataattagtgtgtataagcgtatcgtgtcgtaatcatgtcttgcggttgttttacgtacttacgaaaatgataatctctgtatggtattcattctcttttgcaattacccgagcaagagcagaagttgagaggcttgtcgatctagccagcgtgttgttgatttcagttccattaattcactgaaatgtatatatgtgcgatatatcctgctatataaaaattgccaggtaaacctaccttgtccaatgtaaacgtgtgtgagcttgttgtagtggtgaggttcaggtaggcatgcatgtttttgttttggatatgttttactcataaatctattacatatggatggcgggagtacagtgtggttcatgagcagtgttgtatgcttggttgtgcataaaaattgatgtacaacaacaccacaaggctgagactgactagtcggtttcaaaaaaaggtgaagctagacacttggcatccgtcgtttggattggattggaaatctacaacatgtcgtcccgcattgccaggtcacttaattacggacgtcacccaatcacaatcacaatcacaatcccaacccaaacccaacgggacgaaggattgaatccaatccatgggcccaccagacccgacacggagggcccacgccacataggcttcagttgcatcccttcatctctctctaaatttacccgagtggagtcgagacctggttggattggtacggacggatagggactggattttttacattttggtccttttaaaaaacttatttcgcaaatagatctctagaaaaacttatccccaaaatggtcctttttggggcgccagagtagctggcgccgtcgtccaacaggacggcgccagcctctctggcaccgtccccctgctgacgtggcggggcgatgcgaggtggctagggggagtgcgccagagtggctggcgccctccctccccccgaaattttttttgttttatttgtttgatatttttttcacgcttagggacacataagaaccaaccatagaaaaattgaactcaaatggacgtaatatgtgacctatagaatttttcctctcctctcctctctctccgaactagtgcaaaggagagatgtgcaaattttttatttttattttatttttttgatatttttttcacacttaggaactcataggaaccaaccatgtaaaaaataaactcaaacggacgaaatatatggcatgtggaattttccaaagctctaccgaaaaacttctctcctcgaaaacacaatcttgcaagcgaaatttggaggttttaatattgccagacccggcaaagcgggggagaatcggatgtaactttttctgtagatgtctgtgcatatattatttgcctgattccgagtccgtatgagaaagttacgcctattttaatagatgacatattttgtccgtttcggtagagttttggaaaattctacaagtcacatattttgtccgtttgagtttattttttatacggttggttcctatattcttctaagtgtgaaaaaatatcaaaaaaataaaataaaaataaaaaaattgcatctctatgtactgtttaacttatatgtcatttcatgtggttatattttgaattagattaagtaatttcatatagtggtagagtgcattatgtttaacatcctgatcaaagggttttactaatggaattatggtctaattttagtgaaggtgcaaagtatactaagtggtatgctagctattttcagacttagctaagtggtagttcgagtttaaattttttttttgtggttggttgtatcgtgatcctgagtgtgaaaaaaaatccgaaaaaataaaataaaaatgacaccgttgcaactccatacagagaaacaggaatggaggcggcggcgccagccatgctggcaccctcctccctggggcggcgccagcatggctagcgccctcctcctgccacttcggttcgcgtgcgccacggtggcaggaggacggtcccgttgatgacggcgccagccactctggtgcccctaaaaggaccatttctaggataagtttttttaggggtctatttgtgaaataagttttttaaaagaaccaaaatgtaaaaaatcccgcggatagggatgcctcacccaccctgcattgcatttgcacccggcacccctctacggttggtttccgttgtgccttcagcttgttttgttgccaacacaccttccttcaatctatcctgtgaaaaaaaattggttcaaggcacgtaaaagaacactctaagagattgaggttagccatataccaaccaaggaaaaaaaacataccctaacagactatatatatccaaatgcattggacagtttttttttttgattggccaaatttgagcatcctcccctagtcatctcttccaaagttaaaaaaaaggagagactgaatggttgatatatatgtagggctagttcactttgttagcactttcaatcttatcatattttggcacattttagtgttatcaaaacttggttgtgttggatgtttaacctactaaaatttggtagaatgtttaacttgagagtggaaactttcggaattaccaaagtttggtagagtgacaatggtaaggatatgtttggtttgttagcataccaaaaattaataaggtgtgaatatggtaagaaaatgaacaagctcgtagttcccaatgggattttattgtttcatttgaattaatgtgcaggagatatagaaatgaatctttcattggctagtctctagaagatgcacaataaaacaaaaatgagtttaggagagaacggagatgacagttatctcaaaattacaaattgagtaataaagtttttttaaaagccacatattttagagtatatatccgtagtattattgaggttatagaagttgtagtttgatgataaaacgatgttaaatgtgtaatttttatatgatatgtcgatatatagtaaaaagatatgatattaaatctgtagttttttatggtacataatatttaaatatatagttatgtgatagattgatgaaagcatatactaagtagtttagtggaatttatactgttaaaaacgaggaacaagggtagaaaaagaaggcaaccggtggtggtggccaacggtggagacagcgtattagagcccccataatactcccctaaaattataatccatatatttatagtttgtattataaatatagctaatttatatgagacatgtttcaatttttattggctattttggtttagtccccgctttaattttatcctagctccgtcacgagcggtggctcaatatggagaggcgcatgtggtgaaagtggaggaggtaggggataataaggccctgtttgattcagcttaggattattataatctagtttattaggagtaagctgaaacaaacaagtagattattataatctataagccagattattataatctgataagctgctctaaaagagcttttttcagattattgagtggctaaagacccactacccctacatacttgagaaaaattatccacctatgtcatcaaccgaatagatagctgagggcattatagactttagccattcaaacccaatgatccatgccttcaataatccagacaaacaaacaactcacagcttattttatgccagcttattataatccagtttatagtaatctggcttaataatctagattataataatcataagttaaaacaaacagggcgtatagttggattttatttttctcccacccttccgaccatcggcacagttgggcccacaaaggcaacagctgggccccaccaggagggccatagtcatagtgtgtagattgggttaggtgggcccctacagcaggcccatgtgccgtccagcccgtgtgtctggcgtggccgtgcaccggctcgatccgctcctccgtctcgtcgttgcaggtgcaggtgcagcccagccgcgtcgtctctctcgcctcctcctcctccctccctcaatcattgcattgggcattggcgtctcctcctcttct

SEQ ID NO: 55595 - DNA, 10313 bp, Oryza sativa
tttagtgcaaatttcagccctgtgctctgtgctctttgcttcttcccagttgggttgacataggagctttagccgctgattaggttaggtctctgcttctctcatccatccatccatccatccatccatcccctgctgtgcaccgtgactccaccaccaccatcaacaagatgaaaaacaaactcttcttccttttcttgccttgccttgcttgctttgcagtaatcaggggaactgctctctcgtgcgtgtgatttctagtcagtcagtgtggacatctctaaattcatttgtgatttccttcctcatttcgttgcatcggtgtgctatgctgctccaagaaacaagacaaagaaaagaaggcgtgcttgcttgcttgcttgtctgctgcacgagtcatagttggcgtcaatcacatgtacagctgcaaatgctgtgccaagaaatgaacaaaagaaatttacctgacccaaaagaaggccatgtaagtcgtctcacttgttcctctgtttctgtctgcttgctgctctagctctttaggccttttgtccagaattcttcttcttcttcttcttcttgttgctcttgtgttcatctctggattggattagtgcttggggagaataatagtaataataagtaattgttggtaggctggtagctcagctcctctgtacgtatgccatgtatgtatgtatgtatgtatggattgtttcatgtgttaaattatcaccatgaatgattgagaatgaatgaatggacaaaataagcaaggagaaacacacggaatcaagaatgcatcttcctgctgcctgcctggctgcctgcctgcctgtgactgttagttgctatgtctctgtcactcttttttccttctagtagtaccatgatatgcttattattatcattatcgtcatgctcgcaaaaactgcaagttcatcgtcaattagagtctttggatagcattgcaatgtcaatgttgcagtaagcagcaagcactgtgcatgtgcgctgcgctggaattagaataataccgtgggggtgggggagggcgtctcggtggcaaaccaacttttttatgtggaggaatcctgtctctgcgcctggtttggttggtgccctgtttaatttatcagtgcacgataatgaaggcgcgcttgcacttagcttttctttctttcttccttgtcctttttatttttgtgtgttcagtgggtgtgatccctttcgatctctctgcctttcccttttttcctcgctcctctcttttctacacttcctttttcatcctggataacactcaagatggtcaactctgtatctgcttatgcatcatcttgtctctgccctcccactgtatgtgcgtttgcttctgctgctttagtgctccttgtgtagtactagcagtaattcttttgcattactcaaatgattaagataaaagtgagcttggatgtcaacaacattgttttagtactactactcctttctctctttctctgcctcttttgttcgtgcttgattacatactcagatagtgtgccgtaaagttacctgatccaaaaagctacagtacagatataagtacatatacaccccttggtaaaaaaaaaaggattgtactagtagtaaaacagaagcttgatgaaatgatgatgatgataggtactgcatcgtccaagatcctgtcttgtggctttaataattggataatggtggacaagatggcgctcgtacttcactgccatctatcgttagctcagtttgtctgttaaaaactgttctagtggtagaaatttttttttctgtgccctatggctcaatagctgtgagcagtaattgttagagcaatggagattgtttcaactttcatcaagcactttcctttgaactggagtaatactgtggaaatctgaaattcaggtgttggggaaaaatgtggcttcaaattgcactttgttttagggaatggtattgcgaatttgcgatggttgataaggaatcgaatgatctttcgctttccgtccaatgacggagccgaattggggatgttgctttcgttgctgtgcttgcatcattaacatgttaaggagtctataatatctgcagcaggtgtggccaatgaagccaggcaaatactgctagttgcaggaaaaatatagcagcctgtgcatgtgcacagcgcaaaaaaaggattgaatttgacttggactgtggcagcctgttgtttctggaccgaacaaatgcaagcactgcagcagcagcagcagcaggtctctttctttcagcatacaagggttttagaagatgatgtgaaatgaattgatccccattttcctgccttaaatatcatttatgtgcctctttttacttactacactaaagtaatactacatcttactactggtgacttggtgagcaatttctgtgactaatgagggatgtgtgaaatgaatagcaaaacttggacgaaaagggcgaggcgaatttccagcccaccttaacctaacctgccccatctttcttcctttcctttttgtttccttggcactttggcaggaggctaggccggggagcttctagcagctgcagcttcttctagaatctccagtagccagaagctcctccaaacagttcagttttttatctagattctgaaaatctgtagttgtagaatctgggaaatgaattagaagccagaagctaggtttcctagcaagaatctggaaaatgaattagaagccagaagctaggtttcctagcttttctagattctcaccagctagcttctcagcagtagcttcttagaattttaagctcccccaaacaagccccacgaccttcttgttcggatgagctgatgcgatctactacagcaatttctacgcacacatagtacatgctatctccatgataacttttttctgtacgtaaagcagacctcaagtaccattcttgattctttctttgtgtctttgatactactggagtacactctgctgcagcaggagggaggccagaaaatgcgttaagcttttcagtctggccatatccatgagtccatgactgattgatcattgatgaatgatgtgttgcatgtttgcatcgcctgcactgcatcgtactaccatcactataggttgtgatgatgcgtccagcccagagagtggagtactcctgtgtacagtactttcagttccatctctgatgacggacgactgcagagagtggagactggagagcaacgaacgaattcttccatgcatggctgcatctgcatacttcgctttaacttcgtactagcatcattcaacgctaatactatcactagcatttagtactggagtagtatcgaatatcgattgcaggcttcactgttattttggataatatgaatatcactgaatccgattcctaccagagttaattactccattgaacaacacttcaatagtttaaagaaaagcatgtgtgcttgtgatatataccaatcgaacaacattatttcatcatgaatgggccggccaatatgaatgaaaggattgatggatggcgacccgacttgctgtgcctatcttgcctcccaactcccagcttcacccaatccgaattggagcatccaactcgcatcctggtggcagggcaggtccaaagcgttatctctagttactataaatagatgacgaaaatgaacatcgctatcgttttgaaggcctaaaaaccatcacgttcatcatagggagagaagaaatatgtttagattatgagaatttttactgtccagcaggtaccttggtacctgtcggtatatgcaatttgagccatcgatttcgtttgatccaacgggtgagaaagagttgtacctagtagtactgtccacgtgattttacagagcatagagaggtactaaagaagcaagggtagttaagtaatttcgcgtgtatcttcttcatcttcctcctgtcttttctctctccaaaagatgctgcatgcctgcatcgatcgatggctctcaccagggatggacaggctagccggagtggaggtggagggggccgaagagcctccgtgcatcacttcctccaagctcgccggtgacatacgcctaccacggcccttcccctaatctcgctgccggattcgagcacatcggcgaccgacgcaggtcctcgtcgcctccgccgccgcgtagcagcctccgacgcaggcgccgccgttcaacaccaccggcgccgaccacccctcctgctcctcgttacctcgccaccatgcagacaccgctggcgcccaacgcgccgccgtccaacaccccgccgccgacgcccccggcaccaccggcgccgaccacccctcatcccgctcccaccacgcccttgctcttggtttggacttgctcagttgctcttggagtcttcgttgacacagtcacttagtcagagagaaggagcatcacgagctgcttagcgtgtgagattttcaatcttaccctccgtgaatgaacggccggatttaaattggtacctcaaggtaccggtacctcgaggtacaatatgctggactggagcaatgctcttagattatatggtggtggttaaggtagattgagttatataccaaacaaaattgtagttacggaaacatatgagcagtaagagttgtatattgaattttaattgtatatttttaaatattgctcaatgtaaaactacgcaggaacatctagtagttttgcaagagaatcatatcttctaccattattgcctctgtgacgtggtcactgacatatggaggtctttgtctataagccaacatgtcagcgaccacattcctccatctattccttttgtaagggtagagcacctagaaaagaataccccaaccatttttgttgacatctataattggatttgttgcgggaaactattttgatttatcgaggggatgccccccccctctcgttttaaaaaccatccgaacagttatataaaattcttgaagaatttgacaacactcacccaatatatataccactctaaaaaaaatttaggtccaaactcaactcacacatgaagatgtgaaaaagataaatttagcgtatgaatagtagcggtattgttcacattagaatttatctttttttttctcaatgtataggtcaaaatttaacttagtttttggtgaactgataaatgccactgtacaccacattatcatctttgattatgcaccgcatgatgcacataagtggttgcataagtaatagctaattttactgtggcaatcgccttacattacattattgttggcccaacaagagttgtttctttccttgctttgttgtgaactgaaagcacaattagccactctttccggcccatcccatcggatgattatttatttattagagtacacgcagtccgtagagattatttgacgccacatccacgaaaaatttcttatattatgggacgaaggtagtagcatttatcgattgcaggcttgtctgtttgatttggatcatatgaatctctctgaatgcatgattcctatgaatcagtttttgactttgttcgttgtgacgtgtgcaatccacacgagctattcgtgagctcgtccggcagcggcaacggctgacggggcacgcaggcgacgactgatcgacgaggaggcatctgcatctccatggtgtagagaccgaaggccgccgctagaccaacaagacgaacgaccattgatgcccattaccaactggttcaaaaatatgatgcccaacctggcacagagcactaataaggtaaatacggagtattattagtggcgttctatagcagatgacgcagccataccacttccaacacaaaggttcaataataagatcggacataactatgccgaaagaaaaaggaaattcattgcataatggacgactgtagatcgatacagcagcacatgtaagatcagagatagtttgtccaagagaaattcatcaaaagaaaacagctgatatatttggtcccagcatgcgtttatggaaaaagtttcaagtagtcttcttctttctaagtttcaagtagtcttcatcatgtaggtcaccctggcaacaatccaaaaccaaacatgtgagacaactatagcatgagattgatatctccattgagtaaaatcaagagcataaaccgtaccacatagtaggtgtgttcttcaacgacatcttcatcactctcagaggccatttcactttcactgctctcctgctttttaaatgatccatactcaacatacttctcacacaaaaaatctaaggcaaattgccgaatcttcatggaggtactaatggattcaacattattacgcttcaagttctcaatcaaccactcagcctcctttctgataccctgcagatggtgcaaataaattgatcaaagtcatgtgacacaaatttcagacaagtataccagaacttggttaggtgaaagcaggcatgcacataccagaaggcgtactcctcatcgttaagtatacagcgcccatgcctcagccattcagaaatcaactcagcctccttagcaatacacttgaaaccattttttttgggggcaaataaccgatacaagaaactagtgagcctctctttcaatcattaaaacagaatgaatatggcaatcaatcagtcaaactaaacagccaggagattgagatgtatctcagcagcatcgatgccaaatggacgttttctttcatcttttacgttaatcgcggtacgcatccatttcacaatgcattcacccactaagcaatcacgaatataagtacaagctcttgcatttttccacaagagcaccatgctcctctccttctccaaacactttcaaagaaagaaatcatcattacttatgcatatcattcccaataagtatatatttgaaagataaatggtgtaatttaagtgaatcctgatgtgcatacaaaggaaggagctacggagcaattacaaaaaccgcctcccatggaggctgcagttagtgtcacagcacgcagcccaatgaatgaagcaacagggctgggagcatataggttcaaacgcttaaaaaaagtgaaaatacccaaagaattgtttcatagtgaagccccatttggatttgaggtttttgtacagcgactattccgtattggaagatttgactgtacccagaatagggcttttctcgtgacagtctaattctaattatttggatcctatttattcacgaaaaggaacaaaatggaccacacggttacatcacgtgtccataaaagtacgttaacaacagttaaaatcatgtttgttaacacttaaacagttggtatgaatttagtattagagtcatatcagtaaatttgtattggacaaatgcaatgacttagacctttttttagcatagcatagtttctgtaaaagaaaaacaaatttcggatgacccaacacagcaagcaactttgtagtgatttcgtagaggtaagcaagcagagaaatagagtgggagttaccatggaggcagcatcaacaagagatgcaagaggagcaagacttgtatgaaagtagtaaaaccagtgaaggtaggcattgtactgctgcaaagcacacggactagagtttttcaagtcacaaggaagtagtctgttcgttcctagtgatttgaattcatctgatttcgccattaggaagccacatgggaaaaaaaacaaaaacaagttaatgtaatgaacgacagtagagggaattaattaaattaaataaacaaaaaaggattgggagttaccagggcaatttaaaagatggagcggtggggaagaagaagctgtgtcaaaattgataatttaacactcttttcaaatgggtttcgattatttgacatcctgacgcacttttattcactcagatggtcccatatgtcatcctcacaaaagtgtcaaattatcaaatttttcgggatggaccgccttggaatcggatctcgcacttgtccgaaactgaggaggatgttagggtttgagaagtgttgacatgggaacgagcacgctcaagtttagtgatattccccatggacgccgatcgagcgtcccttccctccgattcgcagtcgcacatgatgaagaatgaagcggatggagagtgaagagggagagggagcggaggaaagagacgacggtgcgatcgttttgggaggtgaaagaaggaaggcgagatggggtgccgcccaccacatcacagcccaacaactaggaataagttcacttgattcacgccaactatgacttgtgcagagcaggaggggccatgggcgagcatgtacgtacgtcatcgccatgcggatcgagcagcgcggcgacttgtgctccctcatggcctgcacggcagtagcggcggactgaggcgagccattatattattcattgcataatggactgtagatcgataccgcacagcacaggtaagattagagataagtttgtccgagagaaattcatcaaaataaaacaactgcgtgcgagcagaagagaggttgttaatttctaagtcggagtatcgggactagcactcattgaacttcttgcacacacacactgccactgggaataggtttagccagaagcatcggaccaatgatcagatcacccatgacgaaaggagactgcactaggggcattgcccgcacggctggagcgggcaggctgcgcccgcgtccgcacgcccgcattagttgtcactgtcaatgcaagaaaaattactgccttctcttcaactgtggcatcaattacatctgctaattaaaccaaaatgaaaggaaaaaaaactgcgatatatggtatgcaagcatgaagactcagagttcttcagtataagcaaaaatgcaggcttgcaggggtgaatcttcagatgaaacagaaaatcagtaaatattagtaaccatcttgagccctgaaatcttctgaaagacagtgactgcagcgaaaagcagagtctacaatttggcataaaaatccaccgatccttaatcaaattgtcctaaaaaaatccctttccaaaatattcatagcttaacaacagcataaaggggaaaaaaaggactcaaaagacatgcatatcctgacagcaacaaagccgcctgatccttgcatctattcctgtcactcatgcagaattcaccaggcaaaatcaaatatgaatttcaggctcaacggcagaaaagaagtccagaaatcccaggctcaactaaatttccaatacatcatacaaattttggatgtaatctgacatgtgtgggaaacactgatatgagctgggaaactaagcaagctccactgaccactgctccagaactagcaaaatttctcagaacccagattgcatagaactcacatggtaatttgcctgagatgtcaaatgatttaatgtcctgcccagtgacaaaaaaaggggttaaaagttggaacataatctacattgccagtgccagaacatcttggattgaatttaaaagcaatctaacagaatagaagtgaatctgacccccagaaaaagagaggtccaaactacctagaaatgaagataaaattatgtagtactatttaaggaacagaaacaattcagttacagttttatgaccatggtgagggggtaatgcagcatgtgtacacaactctttttccagatctagcaactcatttaagaagcaaatgtagaataaattgtaaattattattagatcatcatagtacccatattcaattagacatacagaaatataaaatcaagtaatttgaatacctaatagttgcatattaacatcatcgccctcagccgtatcagttagaattgaatatggatcaccaaaacctaaaacatcagaatacaaaagttcaacataaataagttcatggcccataatataagtagcaatgcacaactaaagtaggcttcataccatcggctcgcatccaatcttgaaggcaaaccaatgcctccacagttccactagccaacctactcctatagtcgctaatgattcttgatccagtagaaaatgcagactctgatgcaactgaggatgcagggacagcaagcaaatcaagtgccatgcgtgataatattggatatttgcaagagttcaccctccaccactggagtatgtcaaaatcatcatcagggaaatcattttcttgaggaatatcttcgagatatctagttaactcagtctttactttactcttgctttgatcatgaagatatcgcctcgtgtgcgggtgaagggggcgagaccttgtgcctgata

SEQ ID NO: 55596 - DNA, 2890 bp, Oryza sativa
  unsure (1)..(2890): unsure at all n locations
cttgatggaaatcccctcagaggtaagaagtaggaacaaattgttgagcccattgcatgcatgcatacattgaaatagaaacccaactcacatggaaccatgtagacctgtgctgctaccgattttatatcgtgcataaccataggattctgcagtgctcaccatataattcggaactacatgtgaaagaacattaaaatggaaaccatcgtaatgccataattttctcagggcatatttagaatatgaaagggaaaaaaaaaagaaagttgcagttcagacatgcaccggcagaaaaatcactgaacttcctgttgatttcgtctgcagcatacggcggactctgctggagcgaggaacgaaagcaattctgaagtatctcaaagaaaagctacctgctgaataaattctggtgggaattaatgtatgctgcatgatgtttattgatcagttcggccctctcgaactgcagttaccttttcctggagtccatttatccccaaattgttttttccttgattgatgtaatttttgcttggctatcttcttggtgatcgttatcattctcctcattttatccgcggattgctgtcacactgaaagcttctcagcttgtgtataaccaaccttgtatgcagtatacagcagatcagaattcggttatgttgtagtattttgacactggaagtcccgcacgtgtgaaaaaaaatctgccgccacaagtgaaactttgtttcttgccaaagaagccgttcctaaagaataaaaaaaaatattattggatgtggagtgctggtatgttaatgttaacgccactggattcctttttcgtttgagaattcttttgagtctcttcccgtcacgtttgagatatcgtaaggcttttggttctgtaatcgacatggagctcttctcccttcagttattaagattacggcttataagtccatggatacataatcaggattaggtcagcaggtgatcagcaatcggattccttgcaaagcatccaatccatcggtgcccgcattgatcgaaacgagtaataaccatgaagaacaagggtagtcgccgtatccgcaacgtaagcagctcctctcttctcctgtcctgcccgtcagtaacttgcaagtcacacatgcaccgatgacggagggattattattggagatggcttcttcctctgatataattcacttccggtcttagctgctttgccattcaattaatttggaatggttcttttttttttgagggactggaacatttcactattgtctgaatctgtactcgactttgatagtgtgttcagtttgctacccctaccaaatttccccttctgtaccagattgaatctgtattcagtttccattgtctgaatttgggaaaaattagaatgtaaacttccactgttatttttgtcgctattctttttagataatataatggattaagaaaccccagagaatgcatgataactctataagctcaagcatgtttgtaaccgtgtgtatgcaagatctgggcttgaccgtagtgcagactgcagagttatttcatatctatttgatcagaacagggaaagctcagtatgtgtgcaaaatttcagccgcacggcaccaagtgaaatttactatctttgccgaataatcgtttccaaaacaatactataatatttagggtaatcgacgttaagtgttggtatcttaacgccaatggacttgtaagatttcttggagtctctttcaaattccaatcacgtttgagatatgtcggaagcttttgggtctcttttcagtttagggtttaagtcggcgatcatcaacaaatcgaattcccccgtgcgtgcccgatcgagttgccggccggcctccatcattcgagctcagatcatccctgaagaacagaaagcgtcgccgcacgcgcaatgtacgcatgcatgcaatgcaagccttcttcttcttctgctactactatttactaatttgatttgattaatctagcttaatttgatctgcatgtaatgcaatgcgatgcagacaccaagtttagtccctggaaaggacaggctgaacgatttgccggatgatgtcgtgctcaacatcttggagaggctggacacctctgacgccatgaaaacctgcatcctctccaagaacatgagggccaccctccccgacatgctgtcccggatcgccgtcgacgtcgccgccttctcgcggccaaaccaccgccgcctcaccctgcgcgaggtggtccggacgaacggcgccgtggccgacctgacggccgccgtcctcgaattccggcggccggagatccccgtccaccacctcgccctccgcttctacctcaggtactacgactgcatctccatcgccggcacggtggcccgcgccatggccgcccggaagctcgccgccggcgccgccgtcgagttctcgatcctgacggagaagcgctgcggacgacctcgtctacttcgccggccagttccacaccttgttcaccgcctacccggccgtcttcgccggcctcacccgcctctggttcggcgattcagacatcgccggcatcctcctcacctgcaaaaacctgcggtttcttcggctgttcaactgcaaatcggtgagacgcagcgtgctgcaggtagagcacaatcatctcgttgagcttgagatatcacacggcaatttcgagacgatcgagctcgtccatgtacccaagctccagacgatgaaatgtcagggctggatctcttatcgggatccactgttttttggttacactccattgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55597 - DNA, 4779 bp, Oryza sativa
aattacacagttatgggagaaatcgcgagacgaacttttgagcctaattaatccatgattagccataagtgctacagtaatccacatgtgttaatgacggtttaattaggctcaaaagattcatctcgcggtttcctggcgagttatgaaattagtttttttattcgtgtccaaaaacccattccgacattcggtcaaatgttcgatgtaacacttaaaaattttcattatgcgaactaaacagagcctcagtcaatagagtagttcagagatataaagtactactgccaaagatgcaccgcttcagcttgcctggtgagcatattgggttatatgcatgatgatatcagccagaatggtgttaatatctaaatttaacactagaatcaaattatagtaagtttgaactaaatttggaaaatatcgaatctttcccgcgaaggacggtttgactgttgttgtgtggacggtcagaccggataatgaactgcagttagctagcaggtgtctggcgtagtggcgtagggttgaaagtgattcgaatagtttccatccaaccagacttttttcggattcggatagtttcggtcggatatattcggaaattttcgaattcggaaatgagttcggatattattatttttcggaatgaaaacgaatatgatattggtgatatccgtcggaatcggataacggtcggacactatccggtattcttatgcaaaaacatatttttcttttctctacttaggtggaacaaaacaaaccatatgaaaaagatacaagaaatatcaaacatacaaacaaatggaaaaaatcgattctaaaaagtaaccacacaaattttcaaaaactttcaattcaattctgaaaattttaaaaacttttaattcaaaaattgaaaagttttagttcgaattcaaaacatcttattattatttgaaacgaaggcagtaactattattatcgttccccgctcgcaaaaaataattgtgagttgatcatcaaggacaggcaattagagtagagggtttagagagcattgcaatgtcaaatgttgcaaaagcagcaaacagtctgcatgtgcgctgcgctggaattactatagtatagtatagaacataatagtaaatagcgtaaattgtacccacggtacaacaacttgacgggtgggagcgatatagtacaggaacttgagaattgaacattcgagtgcaacaacttgacaagtgggtacgttctagtataagaacttaacaatttagtattttgatgcatcaacttagctaagcatatgctaggtgagtttttttttcgcgatgtcgatatgccattacatagcaatcctacggatattaccttataatattgaatttaatctttaagaattatactgcacatccaattaccttcaagaatttttgttttcttcaccttcccaaatctcaaccgaaatacaataatttccacatccagtttaattgaatttcaattattagttattaggataaaaatataaatatgcttatatacaaacccacgctagtatattatcaaaataagcacttaaaaatcaaatatgtgtaaaaatgtgctccaaataattaagttgttgaataacttcttaacttattgtatcataatcatacatatcttacaagttgttacatttatgcgatcacttatgaagttcttgtattaaattgcacttatctgccaagttattgcactagaacgctcatttctcaagttcttgcatcaaattgcacccactttccaagttgatgaactgtgggcatagtgcaaaaaaccggaccggccatcgaaccggtcaaacttctggttcaccggtctgaccgctgggtcgtccggttcgactgcagaacagaagacttcatattacatgtgtattctccttaaagcaacatctgtaggtggtcttgttggcttagtcgtcgaacctgtaacgagacaaccagggttcgagtctcatcttcccacccttttttcatttatgactccttttttttcatttatgacttgggcctagtgggcctttgtagcctggtccacgtgctcgtcagaaccgctggttcagaagcgtccggttcgccggttttcaccaaaaaccgcccggttcatccggttgtgaccggttcgattgcatatccggttcttgcagcaaaccgaaccgactgaggggctggttccggtttttcccggttcaaccgccgggccggtccggtttttttactaggactgtgggtgcaatttactctagtaaataatacggagtactgtttaggtgggccataatgggccccgcgtctccttactgggctgtggcgtggtaggcctggggccaattctcccaaaacgaaacgcagtcgcgatcggtagccatggcggtgaagcgatcgcgccgtcgtggcggtcctctccttcatccgctccctctccccctctttctctccactccatccccttcattctcttcggggatggcttgcgcgcgcgcgccgggaaaagaacctgccgagcactttatccctttagtcttaattacgtatattagttaatatacttaacactaatgatagtaattaagaaaatatttggaaatttttttgggatatctttttactaacagattgaaattttttgaagttagatttgaaaacttttgatttaagttttaaattttaaagttaaattttaaaaactttcaactaagatttgaaaactttcaactttagatttaaaaactttcaactccgatttgaaaactttcaactcgagaatcaagattcaaaaactttcaagtccagatttgaaaaaaattaaaaactttcaatttgagatttgaaaactttcaactcgagatttgaaaactttcaactcagatttgaaaaactttcaactcgagaatagagattcaaaaactttcaagtccagatttgaaaaaaattaaaaactttcaatttgagatttgaaaactttcaaatcaagatttgaaaattttaaatcgagattcgaaaactttcaaatccagatttgaaaatcttcaactcaaaatttaaaaactttcaaactcaaaacatgctaaaaaattaaaaaaaatcagaaaaaaaagtgaggaaaaaaaaaggaaaaaaacgaaaaaaaaagaaaaaaaaagcgtgcagaagggcgcgcgccggcactgggccttctgggcctaaaacgcgccccgccggcgcgcgcgccaactagcttttccgattctctttcatcctcatcatgtgcgactgcgaatcggaggaaggggacgctcggcgtccatggggaatatcactaaacttgaccgtgctcgttcattcccctgtcgcttctcgcaaggtcgcatctgcgcgcgtcaatgtcggacaagtgcgatatccgattccaaggcgcctcaggcggtccaggacaagttgcccaagccagagcttcttcttccccaccgccgccactgctagatcttttagtttaccctggtaactcccaggccttttggtttgtttaatttaattacgttaactgttttttttcccatgtggcttcctaatggtgaaatcagatgaattcaaatcactgggaacagacagactactttcttgtgacttgaaaaacactagtctatgtgccttgcagcagtacaatgcctaccttcactggttttactactttcatagaggtcccgctcctcttgcatcccttgctgatgctgcctccacggtaacccccgctctattctctgcttatctctatgaaatcactacgaagttgctgtgttgggtcacgaaactctattcggaatttgtatttcttttaataaagaaactatgctaaaaaagtaagtcattggatttgcccaatacaaattaatttagtgatgactctaatacaaaattcataccaactgtcaagtgttaacaaacatgattttaactgttgttaacgtacttttatgggcacatgatgtaaccgtgtgatccattttgtgcctcttcgtgaataaataggaaccaaataattataattagactgtcatgagaaaagccctaatctgggtacagtcaaatcttccaatacggaatactcactgtacaaaaacctccaatccaaatggggcttcactatgaaacaattctttgggtattttcacttttttaagcgtttgaacctatgcccagccctgttgcttcattcatttggctgactgctgtgacactaactgcagcctccgtgggaggcggtttttgtaattgctccgtagctccttcctttatattcacagcagaattcacttaaattacaccatttatctttgaagtatttattgggaatgacatgcataagtaatgatatggtttctttctttgaaagtgtttggagaaggagaacagcatgacgctcttatggagaactgtaaaagcctttagttatattcaaggctccatagtgggtgagtgcattgttgaatggatgcgtaccgtgattaaagaaaaaggtgaaatagaacatccatttggcatcgatgctgctaaggtacatctaaatctcctggctgtttagtttggcattgattaccatattgattctgttttaatgattgaaagagaggctcactagtttcttgtattggttatttgcaaaaaaaaaatgatggatggtttcaagtgcattgctaaggaggctgagttgatttctgaatggctgaggcatgggcgccgtatgcttaccgatgatgagtacacc

SEQ ID NO: 55598 - DNA, 18063 bp, Oryza sativa
tggatttgcccaatacaaattaatttagtgatgactctaatacaaaattcataccaactgtcaagtgttaacaaacatgattttaactgttgttaacgtacttttatatatggacacatgatgtaaccatgtgatccattctgtgcctcttcgtgaataaataggaaccaaataattataattaaactgtcatgagaaaagccctattctgggtacagtcaaatcttccaatacggaatagtcgctgtacaaaaacctccaatccaaatggggcttcactatgaaacaattctttgggtatttttcacttttttaagcgtttgaacctatgcccatccctgttgcttcattcatttggctgactgctgtgacaattttttgttttgaaatattgttaattttcttttataaatttagtcaaatctaaaaaaattacctcataaaaaagtcaaaaggacttatatgatcaaacgacctaaagtagtagatagcacaattctcaactcaacccagttggcattggcacgaaatgatatctatggatgcgtcaaattattttgatatttgtggagcgatttatttcatatccatcatgtttgatttcctccatcgagctaagcatatatataccgatggagaggatacagcaattatcaggtgatgttatgacatgtacagtacaggtgcagcttaatttaccatcagagagtggaggtgaatgggttcactcacttgacaagccctatgctgaggatgccgaaggaggtgtgcggccaatccttgtccttggccttgatcagcatcgccctgccccatgacacccaagcctcccatggcatcctcttgtcccagctgctcccccactccagcaacagcttcacccctgcctctatctgctcctctgcctcctcatacatctccatgttcagaagcacctgagcaagaaccaggtgaggctctcctacaaacgggttcctgccaatgcaccgtcgcaggatctcctccaccttgcgccaatccgtctcgtcctcgccgccgctgcaaactgcatcccagtagaggtcccgtgccgccttctggtcgtcggcggtgagcacctgggtgcagccattgaacaccggtgggatcaccagctcaatgtcctcgtcacgatcgtcttcttggccattgttgctatgctttcgttgagctatgtgtatctcttcctcgcgaacgatgaggctgtagagcgcgcccatgcgggatatggaggcagtccagaggccgggcttgccggtgcctggccagagcgaagtccaggtattgccactgaactcgaggcggccattggtgttgtcgaagaggcgatcctgccagtcgaagagctggtcgctgaagtccgccattgtcatgagaaggaaggttgccgcgatgcgcctcgacagtgccacatcctcgccagtccttccaattcaaagtacagacaaaaatcaggtgcaatctgatcgaagtatgtagaaccaacttcgaaatgcaactaagtttgtttgctatctatgcatggggttggtttgcctttgcattgtactcatgcactgtagattacagttacttgtggatgatatgatctaaattgtaagttacgttattatcgcagcagtaaacaaactagatactcccatgtttactggatatctccccaaattttattggcactagctgccaacatgagcttatgttcttttgtattgtcaggtataataaacaacagtctgtaaaattgtcaagacatctttctgccaaatcctctgatcgtataaaacatgtatgagaagattaattttgtcatgaattgttaagtgtttttttcctggtaaccaagatgagaacggctagacaacgggattccgtttcaacgggataagtgctgacgtcacctgctccgcatctagcgcttcgtcgctcccaactaccatgtctgaaaccaaagtcgcacatgccgctccacatcaaacatgcgctattccgtgttcccactagtgcaagtgccccagcttgaccggtctacatgcatgggtctcaacgactaggtctcgagagagctgcttagttgggcactttgagttgtgatatattaattgagtttgggcaggcatggccagatgtcttggcagggcaatatgcctcccgagccatggagcgaggcttgtgaaaaataaaaagattttttttgtcttgataatctttgatgatacactattatgtctggtactgagattgactagtgcacgttgggctcccacgatgcctgatttatatatggctcgcaagtaccatgtaccatataagatacatgtatgtatcatacgtgatactcaggtatcaaattatcatacctgatacccgatactaggtatggcacatacgagtaccaggtcagatatatatagataacgggtctgatactcaggaaccggatctggcactagtatcactgtatgaaaattgtttacagcggatgctctccaagcaacagcgtagaagatgatgacatccgacatgcctatgattttcactcgagctgttgtcgtgagatttaaaaacttctaaattctaaattctaaacgtcgaagatgaaattcacacggttttcggttgatgccatggtaaccgtcttgctatgtatgtgtacaccaattttaatacacgaaaatccacacattttcaaccaatccgaatcttcggaaatgcatctaggcaatttaaattcaaattttgaccaaatccttactaaattacgtagaaaatgcttatttttggaagagggcagctaccgtacgagattccgttgcaacgtagcagccacgggataagatctccactaccttgtctccttccctttccctccacaaactctctcacacaggagaagaaaacgagaggcggagatgaagttggccaggaggaaggggtcgtcgtcgtctccggcggccgtggatgacgacggcacggcgtcggcgaggtcggggcggcatcgagggtgatctcgccgcacctccacgacgtcgtcctccgcccgctgcggcgccgcctccgcgcgctgtggcactgcttcttccactggcgctctcgtcgctgccggcgccggggcctctcccctcctccctcgcgctccttgccaaggtcgccgtcgtccttgcccgctgctcccgccgcctccttgccggtgagcgtaggtggctcctcctccgccgctacagaagcagaagaatctggcgatctcggtgtctcggtcactgcaacgccggcggcaacatgctctggaacctctacctcctctccatcctgatacctggtaccttggtatcagtcggtaccaggtacctttggtaccgactgatacctttggtacctggtaccaggctagtacctagtatctggtaccgggtacccgtgatatctagtacctggtggcctggaggaggagagagaggaggaggtagccgcgtggtggagcaggagaaggaggtggcgcgcgaatccggtggtcggcgaggcgaagcgtggaggaggcagcggcgaatccggtggtcggcgaggcggggcagccgatgagaagaccgacgagagcggggagccagagcggcgcggcaagggaggcgagcttgagggcgacccttgccgaggccgcgccgtcgtcgtcctcctcggcggccggggtcctgagccagcagcggcttccccggcgccggcagcggcctccgcgcccccgctcccgctctccctcttgttcacctcacccgtcgccaagctcctcgtcgtcgccgcctcccccgcggcggtggccgccggctccgacgagcggtggggcgacggcgacggggacgacggcggccaccggctccgacgagcggtggggcgacagcgacggggacgacagtggccgctggctccgacgattttggggagaagagtgaggtatgatgaggggatcgattctgattacttatccgtcttcacgggatgtcggtggaatagattttctgaaccaagatatatgctgtgatggactctgtccgattgattcttcaccacacgttctgaatcgaacggttcccataatgaactcatcatctagggtcggagaaaaattaattctcgtaaccccatctggtgctgagcagtagaaattaagaagatttatttattgtaactaattaactaactcacctgatgtgtttgacagtgattccgtggggcgggaggaggcgctggatcttgagccgccaggcctcgccgtcgtggtggaacagcccgcgccgcgcgtcctgcagtgacgcctcggaggcggcgaggtcggcgacgaggtcctggtcggcgtagtggaagagcaggtcgtcgtggatgagctggtggcgcgggacgacgcagaagaggtggacgaggcgctcggcggcggcgccgacgatggggcgcacgtggtcgcgggcgacgtcgggttcgaagatggcgaggttgacgtaggagttggagtaggcggagtggtagaggccgcagcgcgcgacggcgtcgggggcgccccagaggcggaggatgcggtggacgtcgaggaggtgggcgaggaaggtgccgtgcttgtgccagcactcgccggcgccggcggcgcgcagcacggcggccagcttggggagcgccgggtccacctgctcctcctcgccgcgcaggaaggggcgcgccgcgtccagcgcgccggcgaggtgcgaaggcgaaggcataatttggctaggtgcggcagcggcagcgagaggagtgagagtgatcgatcgcgtgaagtggcggttggcaagttgtgcttgtgcacgatgatcaacagtttggtttcgattccggtggaccggattagtgtgtgtggttcacaccaaatctggtaggagcagatcttttatttcctcatctattgggctgtgggccgcatcatccctttcctctgggccgtaatagtaccttttcttgtttgcttgtgattttcatcttcattcttcagtacattacataatccacgctgacgtcttcatttctttgtttgctccttatttctagttcatcatcgcaacatgggatttgcctgcctcacaggaacttaatttgaggcgtagctacataggagtatacagtacagtatttgtttttttccttatcatctcgtcttctcatcatatatcaatcctctacatattcttatggctcagaggtaagtagagtattgcttctttgaaaaaaaaaacagtacatcaacgtccttgttaacgtattcgttttcatctgtaagcatcagcatatccatatttaactctatccaattcaaacatgcacaacagaatatatttggaattggactgtactactactaccaagtactccctccgtttcaaaatgtttgacaccgttgaatttttagcacgtgtttgaccattcatcttatttaaaaaaaattgtgaaatatgtaaaactatatgtgtacatgaaagtatatttaacaatgaatcaaatgatatgaaaagaataaataattacttaaattttttgaataagacgaatggttaaacacgtgctaaaaagtcaacggtgccaaatattttaaaacggagggagtactaagaaattgcagaatgggtcatgactacatacatggtcacataaaaacagtattcagtcggcctcaacatacatttctttctcagagtctccaacaacctcctccaacctttcagataggactgaattggagcaatctgacacgtgttgaagcctgattaattggacgagtaacaaactaatcagtaaattgatatgacgtactagtacattttgccttgctatcctttactacttgattggatgatgattgccaatcttagttcctctaatctcaagttacaagttggttagcttctgtcaagcttctcctcttgcaaccgatggtttcacaattaaggaaaggagctgagattcttaaatatctgtgaagtgtactgacatccactcaaaaggaaaattcttggtctatcatagcatgacttgaagcgtctccaaacggctggattaccagatcttatccagattagggatgaactaaaccttatcagaatgacactagctgtattgtagtgtgagaattaaatactcctgcacattatcattgttgcactggtgacttacagcaaccgttgctactccaaaatccagtgggcagaggttattatgctatgctacaaactacaatccgaggtgtgtgtttgccttctccagaaagccatgattctcacttgagttttcttttttcgccgggccagagaatagccggccaatgtatattaagagtaagaaaagaaatgtacaaggtagcgcgatgagtcaatgcaccaccattacagacataaaaagaaagctaaaatctcacagaatgagttgctacagagtgacacatggggctaacaagacctgcagctatccaagtctcccattcatcccccatggcggaacaaagatggagaatcgttgcctcgatcccttcgaacacccttgcgtttcgctctttccaaatcaaccaggttacaaggatcacccccgcatcgaacgttttgcggtcaaccttagcaacagatttccgggctgcaagccaccaatcagcaaaatcagccgacggcgaggagcacgaaaggcccagacgtgtgcgcacccgaccccaaacctgttttcagtttcactgaagagtacagcacgtagtattgtgttttgcaaggaaggaacaagcctttaatttttgcaaaattacattgacccggtaggagtgggcgtaaattcttatttgtaaaacgaaaatggtgtgaagagtgggacccacaggtcagcctcatctgctttccctccccttgctctcttctttaaaaccgggaaagccctttcacgtttcggcgccatttcgccttcttcttcacctgggtttcgcccccataaggccggtaagcgactcctccaactccatatctagcggccaatggatttgaacttgtcgtgcttgattcccttctcttctttaatttcgctcgtccaatcccactcgatcggttttcttcactgattctttaattactccgaatcgtctcctgcccagtttttatgcggttccttcaaatattcctgaatatctccgagggcagacgcaaaaatcgatttctttgtgaccaataatagaagctgattggttctggatacagtcaaactgtccgttctaactgaaggttgactttgcaatcaggtgctaacagtttctttttattgttattattactgagaaatggaaaagtgtgagaaaaaataataaaattttcatgaatgattcatgcaaggggagaaaaagtgcgaattctagttgcaagatcgatcgttgacgtgtcgtggtagggcatgtgagcttgcagccagtactttggttgtttgatgtcgatgtgatgctcgtgactcacttaattgcttccctctcttggttggcacttaataattcactaaatcaccacagtttaattagctagcatattcagtttctttctttcttctacctcccccccatttcgctttgcaccattcatcgatctgctctctgcaagacgtggcaccttcctccttgtgttctctgacttggtaatttccatctttaaattggtcttttgtctttgagattatcatttgtaactgattaacctatgcattcgtttgcatcctagaactagctagcttctcaattcttgccagattgttattgcttgctagtgcttacaattcaatcaatcgctgcctgccatttttttagtttttattgaaagcaacactacctttcttttgctaccttattataaatgcttgtatgtatgtttgtttgtttgtttgtacacgtcttacctttcttcagtttgttaccacttctgattattattcatgtccttgcatgtagttcagctataggttgtgttcattctaactgaattcacggacagatcaagctgcaaacttgcaggagatgggatgcttcaattccaagccaaacgacaccggtgcgatcagaagaagacccgggagcataggcgaggtggctgtgttcgtgcctggattgagagtacccgagagctcggatgagctgccccttcagccgctaggtgatggcctcccaaggaggctcaccgaacgcctggccgcgttgaggaatcggataattgtcatggctgctcatgaggcactgtacatgaccaagcccacctggaggatcaccatcactcagcatggttcatccttttatggctcatcatctgatgacaagaagaataatgtcagaggtgatgaactaactgtctgaatttggtgcttgcaggggggtctaagtcagctgatcttctgcaagctttggaggattacttgcccactcttcttggcctagtaaaagatggtaaaactcctcatgtatgcttttcttccttctctttgctctttgatgaaatccaggaaatttaactgtcagtactcctggttcttcaattcttttgcagggagcgagttggaagataaggtacagtttgcatggatgaaccaagaggatgacgcagaggtctacatgctgttatgcgtactgtttgattttctgtggcaagtaagagtgatacgactgtgattaatcgtctacttatttgtgttgtgtaggatacgtcaatgcccagtgcttggtatgaggtgctatcagttctacacttgatggctctgctgcgtttgtcccaagcaaattcccttcttgttccaaagacatccattgagggataccatgctaaggtatctgaaggtctgtaccatgatcaccattgattcctcgctgatgcagaattagtacttgttacttctgaattttgaagtagtacttgttacttctgaattttcgatgatgttccttacttctcagctgttgtccgttgcagcattttgactgttctgtgtttcccttttttacttttcagaaaacaaacgagcttcagtggagatatttctcaaggcagccggatacttggagtgtgcaatccagcatgttctacctaagatatcgccggagaaaaggtggtgtgtttgatgaacaatgttgcgttctgtagttagtgcaggtcggacaggagttattgttgctgactgccatttcgtgtaggaaaggtcttcctgtggacttagctgaaggaatcctgaaagctatctgcatgcaagccctgggtcaagtaaagcgtttctccatctgcttccttttattttatttttttgggtgaatctttctttcaaatcaaatagctagaaatcacatgactcatgtaaatagcagttgaaatgtccatttctaagcccaatcgtcataattttactagtataagtcaaatgccatggctttgcgtacatgctatagttttgtggcttttacttatgtctgaagaacatcatcctgacaaaatgtccatgtcacgcggcttggtgtactgtcaggcaattgatgttcagcttggattggcaattgacagtccaaaggctaccttggcagtgaagaggaggctggcatgtgagatggtcaagtgctggcagcaggtagtacttgttttccatatcagtgctatatctgaagtagtctgttcttaagtaatgctgttattgactaagtagtaactgacaaaggcacgtgtaacacttggaagcagcttcaattgttatttgcctcatctttgttaatcttgaattgatactcctggatattcatcattatggcctcactgtgaggcactgaggctatagggattattgctactaatgatgttcaacctctgctgagatcttagtctgggttttacctgttcctcaactgaactctgaacattgtctgaacgtagctttgcagtcagtaagcaaatgtttgagttcagaaactactcctagcagcctatgaggagtcacaaatcaaacgataaatgctcctgcagtttagtttgataaatagagaatcaatattcttttctgtataatctctttcatttgatctgttcaatctttcttgtgtactatttcattttcaggcacatgaaagcatttcggacctacctctgcttgatggctgggcagaaaagcacaggctctttgttacatggaaacacatcgaagcaaaagtatgtaaaacttctttcatattctgaaacattaatactacaacgaatgatgctgtaagcacaaacaaattaatggctgtcctatacaaattaacaagaagtacattaacacatagtgtagttgtgtaaagataatttagtcatgttgcaaaaaggacggttttgttgtgagtgtgttaatttcatactccatttacactatgataaaatctatctataactgaagagaaacatatgtggatcctcctgctacaaacaggctgcggcatactactaccatggactaatccttgatgaaggaaacagtgagaaatctcataggacggcggtggcagcgctgcaatcagcggaggagttgctcaaagagagcaaagctgcatgtgaagccttccatgcggcatctcctgtttcaaggcgtgcattccattcttttcagatgtagtgttatctgcagtgagctagcttaagaatctctaagatttctgaattttggtacctgcatgcatgtgaataataatgcagaagcccgccgctgtggggatcgatgaggtatcttcaggagaagatacacaaggagtcgtcgtgcaaagttcggatcaacaaggacctctacaacaaggacaacatcatcatccatgaccatgctgacagcgcgccgccgctgccggacttcgccgtggctctcaaacccgacgagtatcgccttcctcccccactcactgacaccaattaaggatcgagtcgacaagggagaaattattaaggtccaaggcatcatgcagatgcagaggaggaagaatcaatcaaataaaatctattatgtatattcattcatattgtgccatgtatgtatgcatgggtgtcacaccgcaccacatgttgcaagaaaaatgaaagagaagctagttactactacctccatacatatatgtatgacattgactagtataaatttgaactagccaacatcatataaaaaaacctggagggagtactagctagctagctaggaaaaaaaattaaaatttttataaaagaaatctcaaataatgtgtatcttgtgtagctgctctggccgaatctcgtagttattagaattactagtctagaaatgtcatacttattattatatcatggaaaaaacaaatactccactcgaacacaggtccagatatccggtgttgtggttgagggatatgaatcagattcggccactagttaagggagacaaagtgaacttttattcgggcaggccggacttgcattgatgtgatgggccagcggcccatactgaaagtgaaggagccgccacgtctgacttttctttcttctctctctctctctctctgcgtccgtccctccctcgcttgacttctctctccgcgtcacttctcttccacctcttgtagtagctgcttctcctcccgatcgagcagaggcagtagtagcttagctagcagatatatactgtagcgatggagtaatatgatcgtcgatcgagccgatccgcgcgatgcagattcgccacgccctcgtcacctcattaccctgggtaacaatcgatcctttttttcttttcttttttgcataatattacgcctttttgcgcttcgattaaattgctagtgcctgtagaccttgtcccttcatatgcctgactgactgactccaacaggcgtgaattcaatggataaagacagtgaattttgattagaattagtgtgtttgtatatgctgctcgttctccctccccgtttagttaatctgtttgttgtttggcactgacagggatggttatcagctcggcattgatgatatggaagggattgattatcatgacagggagtgagtcgccactagttgtggttctatctgaaagcatggagcttggatttgaaagggtctgtttattttccttcctccatcccatggcatgaattcactactaatcactctaccattttcttcaaactgttgtcatctatatgtcctagcttgtgattcacctgatcaatgttagtgtgtttgcttgcctggcagggggatatcctgtttttgcaaatgagcaaacaccctatacgaacaggagatatagttgttttcaatgatgtaagtccctactgaattgtcactggtttatcgatcaccataaaaatattttctgaatcatcaacaaagcagccctttctccaaccttgttttaatgatgctaatacacgtgcatcatttgcaaggcactaattaacttattgcgatttgcctctttgatttgtagggccgtgaaattccaatcgtccatcgcgttattgaggtcgttaagctttgtaatatccacaccaatcagtctccccttacatttgatctcaggtattatgtctgaaaattttccttgttaattatattatatctccttgtaggttcacgaacgacgggataatgcacaagttgatttcctcacaaaaggtatacttacacttattactattttctatcagtggttttgacctcctaattttgttccttgcatattaattaagtaatctgaatcatatatatctgttggctcaagtgatgagcatgaattaatttgtactgtgaatagcgctgcgttatactgatcgatgaactgtctcattatcaggtgacaacaatcctatggacgaccgaattctttacacacatgggcagctttggcttcagcaacatcacatcatgggacgggccatagggtaaaaatactttcaccttggcttaattgtctactggagtagtacttgtgaatttgtgttttggtgatgggctgattaatatactgttcttctgtaatgttaacaggtatctacccaaagctgggtgggtgacattggtgatgactgagaaaccagttattaaggtatgcacatttacccttattatattactggtctatatagctataagcatatactagtgttgcaagagtcctactgtgagctttgcatcggtgcaaagaagttaattagttcgtgttttgtctgaaatgtgttgtttacctgctgatcgatgcgctggggctgctgctcatcacatcaagctagtacaacaaattggtcggaacatgtttctaacactcagggaattggaggaaagcattggtttttggaaggctaaaaaaaccagcagcatacttgtgtttagaggagtattaattagctactcctacagtattgtaatgtcgagggattttgcatattcttccgcccggacggttgggttcagaatgctatccaaaacttgtttaacaatgcgggatgcatacggaacctcacttagcttttacaactttctcgtttatcataaattcgcttaccaaactattaaatattctgtaaatatttttatattaaaaaaatttaaaataaacttatttttcaagtttatagctagtacactaatcatgttttttttttcattttgtgtacggcaaaaagcaaagcttccgagcatagactaaggccttgtttgtttcaatttaacattactgtaatccagattattgtaatctttaacgacttgggaaaaaaaattcaacaacaactttgaaataaaatttcccttgcaatctggaccgttcagtctgtggatcagacggcaaggcagatacactcgtcgtcatcggctgctactagtagtagcaccttgagtaagaggtgattcccgctgatggcgccgcctcccgccggcgtggaggccgtctgcgccgccgtcatcaaatccacgctaacccaaccccacaaccaccaccacctgctcgcggcctcgccctccctcctcgccgccgtcctccaccgcctctccccgctcccctccaccgcgctcgccttcttccgctccctgcctccgccccacccgctcgacgcctccctcgccctcctccgcctcctcgccccccacccgcgccaccaccccaccgtccgctccctcctccgcgacctctccctccgccacccgctctcctccccgctcctcctcccttccctcctcgccgacccccacctccccagctggctcctcctcctctctcccagtccgcccgcccgcacgacgccctccgcgtcttcgaccacatgcgcgcgcgcgaggtcgtccccgacgcgcatgcctcctccgcgctcctcaccgcgctcgcgaagtcccggatgacggccaccgcgcgcaaggtgttcgaccaaatgacgcgggccggggttgccatgaacacccacgtgtacaacgccatgctgcacgtctgcttgaaggccggggacgccgcgctcgctgagtctctgatgacgcggatggacgccgccggtgtgccgctcgataggttctccttcaacaccgtcatcgcgctctactgcaggaagggcatgcagtacgaggccatgtgcgtacgggagcggatggagaatcagggtgtcaaggctgacgtcgtcacatggaactcattgatccatggcttgtgtaaggagcgcagggtgaaggaggcgagtcagctgctgagagagatggcgatggcaggggtggcaccggaccatgtcacatacaccacgcttgtgatgggtactgtcgagcaggcgacttggaggaggcggtcaagctgcgaggggagatggaggcaatggggatgctaccaggtgtcgcgacatacaatgcgattctcaggaagctctgtgaagatggcaagatgaaggaggtcaatgtgttacttaatgagatggatgagaggaaggtgcaggctgatcatgtaacgtgcaacacgctgatcaacgcatactgcaagagaggggacatgacctcagcgctcaaggtgaaaagaaggatgatggagtcagggctacagttggatcagttcacttacaaggctctcgtccatggtttctgtaaggccaaggagctggatgaagccaaggaagccttgtttgagatgatgggtgcaggtactacaaatctaactaaaatttatggctctgattggtagcgatagtacatcatcaagacttaataatgcatattgagagatcctttttgttataatagaaaagcatgcagcatctttgactctgttttatcagttatcaatccatatcagtattttctaatgatgtttggtatatcttgtgttttttccccttgtacgcaggattttcacccaattatagtgtgttgtcatggattgtcgatggtttatgcaacaagaataatgcagttgcagttctagccattcctgatgaacttatgaaaagaggatttccaccagataaagcagtatataggtctctgatccgaaggctatgcaagaaagggtttattgatcttgctgggaatgtgttcaatgaaatgcaaggcaaaggtctagaagctgactgtcttgtgtatgctacacttgcgtgtgcatatctgactgctgggaagccagttgctgctttggatatcttgaatgagatggcgaagaagcagttgtacataacaccccagatttacaactgtatgtgtacctcttatgctgatgagaagggatcgcttaatatgctctgggttcatgccattgagagaggcctaatcacaaagagcgtatacaaagtgatgcaccaagcaagaatgaaatcttcaaatcctgcagtctagaatgcgaggaggggaatgctcatatttcagggatgaacttttcagagactgtgaattgagagtgggctatagaaatagtcttgcactttggtcttttgatgtcgatgatgctcgtgagtcacttaattggttccctctgttggctggcacttaatttactaaatcatagcaattagttagcacaagcagtttctttcttgtaccttccacatgtccctttgcatcattgatttctgctgtctgcaagaggtggcaccttgtgttctctggcttggtaaattcccatctctattccctttcatcctgcccggaacagagtggaggcgtgatgtttgtgatatgtaggtagggcagattgctagtgcttacatttcaatggcctgcctgccatttcttttagttttattggaaggaactctatctttctttatcaccttaattatcaatgcttgcattgcatgtacgcctgtatacatattagttcagttttctatgtctgattgattcttcagcccaccaatcattcaggtttttgtccaatgctattctgctttaaattgatgtttctttttctgaattcacagacaaatcaagctgcaaatttgcaggtgatggggtgcttcaattccaaaccaaacaatgccggtgcgatcagaagaagacatgggagggtagaagtggatgtttgcgcctggattatgagttcctgaggctcagaggagctgcgtcgaggacttggataattttcatggctactcgctactcatgagcactactcctgactaggcccaggaggcgcacgatcactcttcatggttcattcatggcacatctgctaaattgattatcaagaagaataatggcagaggtgatgaactaactgtctgaattcagtgttttttttttcgccgggaaggctgaaggagaccatccgagtatattaagaaggagtaaaagttacaagaaaaacaccacaactgaattcagtgcttgctggactgctgatcttctgcaggctttggaggattatttgcctctgctcttctcagcctagtcaaagatgataacctgatttccccttctttttaattggtctgaatgaaatccaggagatttgtgtcagtcgaggttgaattcttttacagggagcgagttggaagatagtacaattttgcatttatgaacgaagaggatgatgcagaggtccgcgtgcacctatattgttgcatgtggtgtaggacaataggagtgatactgtactgtgtttgatcatctatttgtcttgtgtaccgtcaatgcccagtgcttagaatgagatgctacctgttgtcttggacacgtgacggctatgctgcattcgtccgaagcaatttttgtgcgtcttcctaagacatgtattgagggataccatgctaatataaggtatctgagggtctggagcaatatgtaagcatatgagatacagataattagactctgaaactttgtgtttgtattccatgataagtttgctgctgtgatatcaactgccctctaaattggaactgttagtttgccggaataagttcaccggaggtccctcaatttaacagcgagattttttgaggtcccttaaccacaaaaccagaaatgtgtacccctaaactcattcaaactgttcaccggaggtctctcggcagtatttttgcccggttttactgacgtggcatcctagtcagcaaaaaaaatttaaaaacacatggggcccacatgtcagcttcacatctttttttctcctcttttcttctccttctctcctcttctcttttcttttctctctcttctcttctccttcaggctgcgggcggagcagccgcgcgccgtggccgccgccgtcgtcggctctccaccgtcgtcgtcgccgtgggcgaggctatgcggcgcggccgtccggtggcggagcggaggcagcggagcgcggcggcggagcggaggcagcaggcggagtggcgagcacggatgcaggcggcgcagcggagggcgagcgcggcaacagagcagcggaaggcgcgagcgcggcggtgggccgagcagtggagcgcaagcaggccgcggacagagtagcggagcgcgagcgcggcggtggagcggcggcgagcgagcgcggtggccagcgagtttaggagggagggggaggcagccgacaaccaagaaacaatcg

SEQ ID NO: 55599 - DNA, 3912 bp, Oryza sativa
aagctcctcgtcccatccactgtcttccgcttcgctagctcgccctccgctgctttgcccaccgctgcgctcgcccgccgccgctcctccgccgcgctcgccttccgctgcaccccccgcatccgcgctcctccactgcacgtaatggcatatatacatgtgagtgtgctcagccatatacacatgcttggttaatatatacgtctgcatgttatcgggcggcaaaccaacaagaagctagctaggctatagctggtcgtctccatgcatgcatatatatgctcgtacgaagacgcatgtacatgcggccatctgtacccggtgtatatgcgtatgagctacgacgtcaagtgctaccgcgacgtcggcgaagacgacgagggtcaccgcgcccgcgccgaccaccgtccacgacgccgatggcacgccgagcgtggacacgctcctgctgcagctgcgcgagctgggcgtccgggagggccatgggatcaggccggcgacgctgccgccgccaccactgtcgcggcgtcagctggcacttcgagccacctatgcacggccactgcgacgcctggccgatgccgccgaacggccgcgccgtgtagcctcgcccatggcgacgacgacggcggccacggcgcgcggctgctccgcccgtagcctccgctccgccgccgggctcgcccgccgtccgctccgcccacagcccgccaccgctctgctgccgcgctcggccatcgcgactgcgcccgccgccagcctgaaggagaagagagaggagagaagagaaaagagaagaaagggagaagaaaagagaagaaaaaatatgtgcagctgacatgtgggccccacgtaccttttattttttttttgctgagtaggatgccacgtcagcaaaactgggcaaaaatactgccgagggacctccggtgaacggtttgagtaagtttaggggtagacatttctggttttgtggttaagggacctcaaaaaatctcgctgttaagttcctccggtgaacttattcctagtttgccaccgctcgctgggattgctcttcttggattattattattgggccttgagtttttgtacagacgggctgctctccgacggcccacctggttatcaatcagtacggccgggccaaccaatgtgcttcccgacggcgacggctgcgaagaggataagcaaagcagcaagagtgagctgctgctgctcagctcggcgatgagatgatgccaccaccagttcaaaccctacgcctcctcctcctcacccctttcccgccacctcctcgcctccgcttccaccgccttacggccacagggaggtccgacaatgccgccgcggcgtccggcaccacggcgagggagcgccgcctcgccaaggtgcgggaggagcgccgccgccgtcagcacgagctcgacaacacctatcccggctgggcaaggcactgtccttttaccctctacatactctgctcctggatctggattcgcctcccttccctgctcactcaaatccatcttctgcatcatcatcaccatcatccatacagatagatacagtagatttgtgggctggtgctaatgctgcctgctgtgcaaatgcagggttctggagaatgcctgcagggacgacgacgaactccgcgccattctcggtgatagcatcgggaacccagagctcatgaagcaaagggtggttccctaatttatttgagctttctttctcgccacttcaaacttctcttctagtaatacttacttgtacatttacttgtgtgcacgggtggcagatccaagaaagggtacgcaagaaaggcagggcacaattcaacaaatccaagacagggtctattgttgcattcaaagtcagctttcgagagtgagtttcaattccacctaagatttaatgactgataaaaccttcaatgtcatagttgagcatcatctagattttctcttctttttttttctcagtttgatacgatgatacgactttggactattaatacactaactcagtagctaaattgatatcatactcctctgtgtatgcatattagttccactgactgaatgccacttatctttctatctttgcagcttcaacccactaaattcattcatttggtttgaactctttggagaaccaacggatcgagatgttgatctgcttggcggtgtaaagtgacattgtatttctgttcctttggattctcattattcagaaagaaatcaccctgtcttgacatcaacatcatttatattctgcaggtgattcaggcttggtatgtcatggggagattaggagcttacaactcttcaaatttgcaggttggacttgttcaagtgttggaaactacaatgattacattatttttttatgactcgtcacctacgtagggagaaaacaaaacatctcatctttttatttcttgaaaattcctacgtcaaccatcatattgcctaattaaccaacaatgcgtcatatctaagatacaccttctgggtttcattgccaaagcatggaaacatgaaattaattattcacgtgtcatatgtgccttccgaattttgtggaattgtatgcactattgtaatttgtgaaccatcttcttttgatgaaacttgtgaatcttctttacatggctagctttggacttaacttatgttgccaactcatggtcacatagtctaagttaatagcttagctggcttccttaccagtcatttttgtataatgagccattagtaaactgtaaacatgcctttttggtgctacctttttatcaactgcttacacaattatgtaacactggtgtgttatctatgcaagctgacttgcaattttgtctatttcaatttcagctggccaattcaatgctggactatgacccttcatatgattctgatcaagcttctggtgtgatgccttcatctttccatgatatcagtgatgtcgaattccaagacaattggggcagagtttggtgaggattggaaacatttatagtctggaaattgtgttatgggttctacagtactgaaaatgcactcttcattcagggtggatcttggaacatcggattatcttggattggatgtattactcaactgtcttacacaattaagctcagagtaagtcatctttctctataccttatacaaaacagtagcagctatagcttcaaatctgatcctatagtctttagttcaattgtgattgtggagataaatctgatcctatagtctttagttcaattgcggagagaaaatgaaacgttatctgaattgtgagagtaatataccactgtagaaatttctggcactctgcaaacatgtcagtttgtcacatgcctgtttctgaatatgtcacagatcagtcctaatatgtagttcatcgcccatcacgtacattatgagttacttttttgtattcaaaatgtttgtgcattgtaattagcttttgctgtgattgtggctttgacaaaaatttcaggcacttgggcatcaaacaagtggtatttggtggcaaaaaaatgggcgactgggaagaggggatgaagaactctgattacggatacaggcatttcaagatatagctgtaccgaggagtgatatgcaatggtcatgtgagggaggccttcatatgtactccaggcctctggggattctccggcctatagtggcaagacttttcacttgaagcagagaaattttttggacgactgaccaagattagtgtgcctagattgatcttgtgctcgtgtgtgtaaataattttaattttcctctaggttgtattagaactgaatccaacaatccagtaaaatgtattgtagcaattatatcaaacagttacaaaatcatgagcaattactgactgtactcctcgaatgacctg

SEQ ID NO: 55600 - DNA, 7021 bp, Oryza sativa
catgtaggttggaagagaagtaacaagctcagaagaggatgggatgtgttcactaccttgaatctgttaccgataagcgagccaatgtgactgttggtaattttcctatcaccaatagaagattcgatgtcccactctaaatcaggcattgatgtaaatccgtaccagagttgatcagaaggaggaggtttcacatgcacacgcaggacacctcgaacagatgaaatttttatcgccagagagagcggcacctgtgcaagaagatcttaagatcactggtgaaatattcatattgttttaaagagaaatctccataactttaagcttctaaaataagtttgatgtacgatttcactggcagagatgtaccaaggctaatgttacagtttttaagagcaacttatcaaatacagagatgacctgagatgtgctcagaaacatgtaacacgtaggaaagagatgcatgaaggccaaaaggagaggtgtaaacctgtgagacatgatctgctatggaatgcatgatatttttccaccctgatatataggccgatgtccatccagtgctcttgggctgactaccatctgatacaaaagatcacacaaggtctggatcactaaacatatcttgattcttgatgcatcagaggactgggcaaccttctaaccataattgtaataaagcttacatcaagtcagtacaagcatacataagcaaaacaggaaaacaacaagctgatcatgccagcggtagatcataactaattggattctttttactcttaattgtaatgcagtcattggtaggacaatcataaacagttactcaaagaaacaaatgaaataaacaagaaaacacatatatgaaattgaagcatacctggttcacctttttcttcaactgaggaaactgaattttgggaatctcgaaattggttaccgtattgttcaatactctcaagaagatctgattcaacctctccatttgagtctgtaccaaagttacttttcattatgtccttctgtaactctggttcctgaacctcgagtcttgtttcaatgtgcagtagtattccactagaatattcaaaatcaacttcaaaagcccataactcattcaaatccagtggaaggactctcatcgcgtgtacataaggtggaagctttccaaggctgaagtcagcaagtgtgatgtcaccaacataaggtggggtcctcatgcttgataacgttcgctaacaaaataaaattcaactaattaacaagtacagacaagagcaggttactttgtaaacataagcagtatatctaacctgaatgcgtgctttgatggccttgtgtatctcatcgctcattttagcatcaaaaaacaaccgtgaagataaaaggttccaacaaagtgtaccttcatctgctattctatcatcggcatttacatcagggaaagctgaaggttgtccaatttgacccagagcaggagacgttggactgggtttcactgtatcttgtgatgaactgctattggacttgtcatcttgtgaacccattaatccttcaataaacggtgtgccctgatagctgcgtaatttatccaatatctttctttctccttgtgtagatgatccggaacttgtcttaccctctaacggaacctttgtagatgccttctttgccagctttttgagaaagagacggaccttggaagacccatcagtctttattgccctgtccataacctcatggtcctcactagaaaatactgtaggctttaggaaacctgggtattcagaatttaatgatgatatgtaattattgaactcctcgctcagcttggcatgccaattctttttctccttgtcagcagtagctgcaagacgaagtgctttacaccatgattccttctcccaggaagtttcagcataaagatagcataccttgcttccattataaatttgatattccttgctttccagtttaataggataccttttagccctgaaagttaagcaaaggtactaaagttacacatagagtgaagtatacgagcaaaaaaaaaaccctagtagcagaagtaaaacagctgaatgaaaggagcagaacagaaagctgcttggcaagtacttctaactgtcttctaaagaagtacattccgtctctataggagttccttcaagaaataaaatccatataagctggctccaacatgtacaaatacatgatttaccttcaaacaaaagcatttctacatgcctctgaaattttatttggcaaatcgcgacacaaggttaaacttgactgtaaattcacaatgtgtacaactggaaactggataggggtaaaaaaaagatgagctcatgatgaaaagtatcattttctcctgcaccaaatactgaccatttgcgagagggcatacttgatgctgaaacagcaaatactgtgcaattcagaagcttaatggttgtgtggaagccatcaggaccagacaaaataagtgaacgccccttgattttagccgacctctttgcaggaaaaacctccacaatattctttttttcctttgtttctttagggcctccaatcgatgagcgttcattactagctttaggtgtcttttctggctctagtatccacagaaagccctgtaaacatacagcatctattttaagcaggatcatccttagtaactaaaaaacatggaggctctaaagaggaatctaaatgaaatgttattgcaaatatagtatgccaaagcaatttggatgagctctggattgcaatggtatttaagccattttatccaaaatgcaagtatattttccttgaaccatattgttcaacctttataagctcaatgttgagtacccatgatgtaaaacagaactagcataaagatgcagtgcaaaaatatgtaaaaacaaggaacatcatggtgaaaggaagttacaggaaaaaaaacgttgcattcatgaaaatataaccaggtcgtatgtatattggtcagtggtgaacatgtatcagctgtgataattggaaccaaaaggaaacgattatgtttaggtctcttcagcatgtaacctactagttcatccatagagaattcattaagcttagttgtggagtctactacatgtacaagtacaacacttgtgatgaagatgagaacatgtaggtgtttccgcacaggagaacaatatacactgagatgagcaggtgtatgagctgggcatgccaatggatagaatcatgggccaaaaactaagtagaggtcaatgccaggagcaaattagaatttgaaataaaaaaaaggccaggaacttaagaagtaaacatatatggcatgcatgaaccctaggagcaatttgcttggataacaaaaggggaacataaaattttgcgatgaataaccagaataacagaacccaatcactgatattagtatttggaacaactgaacgatccaggatgtacaaaaattgcggtctgaacacaaaggcatgtcgattctctagttgaagtgcagcaattggggaaaaagaaaccttgttagcatatgaatgcacagtagtagcattttgctcctcccaagtaagtaattagcagtggaagcaagctgcaactatttcatagtaagataaaaaaaaacaggagatcgaatcgagaggtgatccctagctccaaagctgcagaagcagttactgttactagtattccagcgcgccgcattcgccctatcccctatcccctatccccgaggagggtaatcgaagcgagaggtacgtgagtggaagcagcctgacctgcttctcgtacgggaaggggcgttcgccggggagctcgtcggcgtccggcgcgggctgcggggcagagtcccggcggcggaggcggcggacgagccagaggagcgcggcggcctcgagcgccgccagagccaggaggccgaggaggaatcccagcaggaaggcgagggccatggcctcgccgccgaagacgtacggcgacggcgacggcgacggtgagcgacgtggaggttgaggacctggttgtaaataatttgtaggagtgggagggaccggaatgtaaagagacaaggttggggtgggggggaacccgatacgcaagacgcaaggatggcgcggtcgctggttgggtcgtctcgtctcgtctactttacacgatggcgcgtgggtcccacgcggtgtctctgcggtgggtgggacccacttgtcggtgcccccatcactgcaccttttcttttttctttgagtggttcgttcgcttcgttgcttcacgccacgcgttgggttgggtttgaattcttcgtctttgcttgctgctgcaatcatactactagtacagtatttgcttcaaacgtccgaattaattaaattaggctactaatttgggaaaaaaaatagagaggacaagagttcctagctacctataaattaaatacttccacggataaaaaaaaagttaatgtttagaacaagattcaatcactcttaatgggcgggttcggttgtaagaacagtgaagcaagcaaaaaaaaaaaaggcagcggctgcaagcaggcccaatattacaaccagcttatattagaacaagttataaaacctagtaacaactcatatacatttcaaagtaattatcttcatgtcatcccttttgtttcaaattaaacatttgaaaaattatcaatgaatggaattttataagtaaccgaatcttattccaaatgttgaatattatcaaccgaatgggatagtccatattttcacgtgtttttcatagacgacgtggagggctactttatttgagattttctctcatccttggagagaagggaaaaaaaagcaatttacactctcatttctcatttacatccaatttatctttccagctctattgtcgatctttttccctgtcaagtcattaccagcaacaattcctacgtagttcgtacctgttcataattctatgaagatagagtgatgtagtctactccctccgtcctataaaatacgaatctagacatacgtttgtctagatttatagtactagaatgtgtcacatccggtactatatttgttttttatgggacggaaggagtacaacatacttgctgttgatgaaaaaaaaaaagtcctttaaattcagtatagctcgcaaggtgactgacaaaacaatttcctccatcctagtttggccttcttctagcaccaccggaggctgagtatcgagtataattaagcttaagcaacaagcgtcaggttcagaatgcagattgccggcagtgagacgtgaagaagatgaagtcaggatggtaagctcgcagctgcttgagccaagaagacgctgcccagaagagatcagagctcctcgacgatgtccacagcttcccttccgctctgtacgtcgccagcccaaacggcgaaacaccaacaacgctcctcccctcctcaacattatctgcaaattagcccatgcatttccatcatcaacatcgatctaattacactgtcagtaatgcacatatcacagccacaagattaacgaattgatgttatataggagtatgtaatatgtggatggattacgtaccttggaaaactgaggagagggaatgataggttaggaaacacgtagataaccccttgaggtttccacgagctgggatatgataaatcgggtacctgaatgcatgcagattattgttgacaagattagttgagttcaagtcaagcatctcaacaagctgttcctttgtttagttttctgaatatacattagatgtaatgtgcaattatgtatgcatttgaacctctagcttcagagcaataatttaacaatcaaagaagtgaaaatgatgtgtaaattcaagtaccatgctacagacatccagctcgaaggtgaaagttgtgcactgctgagagatgtcaagcatggataatgctgagccagctctgccacctaatcaataacacaacgtatgcaacaccaaacttaattagagtactaatgtggtaagttatttgcattgatcacattgaagactgaaacaaaactagtaaccttatctgctagcgggactctctcgtagggcgagctccactcgttgtactgaaaattcaggcagccggcaccttgctttgcagaaaccgattcagagctatcatggcttgagtcgtcgtcatcagacatagcagcatcccatgatcttgataacttgtcgcctgtactatcatcactccaagaatcactctcgctccctgcgctgcctctgtatgatttcatcgaatggcattagttcgatcagatcggaaacaattaataggccaaagaggattaagggtttgcagtaaagtaaaacaatgtacaggtaggttgcatacagctacaagagacatgagattgagaggtagagagagtagcaacgaacctggagaaagcaaggagagacttggtggaggtgtatatctgaatggcagataagtagggaacaaaatgttgggtgatggtgttgccggattcaagacggacaggaacagcaaggccatacgcactgctctcagcgtaatgctcccagagatcctcaagcgcgaagtaatcgacctcgtctttcttcttgtcgagttgccaaactttgctgggatcttggaaacattcctacattattgaatattgaaagaagaagaagaagaagaagaagaagaagaagaagaagaagaagagagagaaatagagatgataatttgtttgctgaaagtatgcaagggcaggagagatgttaatttgagcagaatgtataccatggaggcggagcgccagcgcaggcatggagtggcggcctggaggaacacctccaggttgttatcggtattactcttcttcttctccatcctcgaatcgaatcgaatcgcccagaagcgaccaatgctcctcctagctagtacaatgcaatccttgatacgctagttattcaaatgcaatatgaaccagctgctgatcaatctctctctaaaat

SEQ ID NO: 55601 - DNA, 1125 bp, Oryza sativa
tgcatcgaatagcagaagtagctagcacccggagagcaggaaagctaatatgaggcagttggtggcaagttagaagtaaaagacaagcatgatattctcatgatgacaagcatggtatcctagtaatgacgagctgatctcgacgcataacgtgaaatgggtaacttctatgaggttgacgccaaaaatataaactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcatgctagcctcctcgaatctcggggacgagattcttgtaaggggggtggatttgtcacgtcctgataaattcatcccgaattaaaaatcattcgctaaaaggaataatagaattaattaaaattcggaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatgtttttataaaaagaaaaaccctaaaaagttccctttccctccccctccccctcttgggccggctcggcccagctccctccctctctcccctcttccccgcggcccatccggccttcccccgcgcgcgcgccgctgacgggcgggcccgcccgccaccctcgctgacgggtggggcccacccgtcatcccctacctcccgccgctcccgccgcctcgcccgtgccctagcgccgccgccgccgcaaatcccgccgctcccgccgcccccgcgtgcaataaagtggggggaatcattccccgtgattccctctccctttccccccatttttccctctctctctcgcgttcaaacgggcggatttgcccccgcaaatctcgccggcgccattgatggagcccgagatcgccgcgccggtttccttc

SEQ ID NO: 55602 - DNA, 730 bp, Oryza sativa
ctgggtggcttgggacgagctgggacccaaggtcggggtgcccagttcggtctgaatcatcgtaggcctggggtaaggcaggttcgtgtgggttcacgcccttgaatactaatactgtgtagctctaggatcgtctttataaaatggctttgggcaactaagtgacttttaaatgctgtttactgcaaaacttaaccccgatattattaccccttgtacccccttgcattaatcatgcatctgccagtgtggcttgctgagtactgtggttgtactcattcttgctctatctttctccccccttcagtaagagaagcttcggagaagatgtcttaggtggagtcttggcttataccccagttgagcgcctgtgaagatggagccgtaggcccgctagtccgctgctgtttatttttgattgtcaggcctgaagtgcctttgtaataatgtaaatattgtcgatataataaagatgtgccttttatatcatgtttgtttggtgtaccccggcttttcctgggacggggattaatacactagcgttcgggaaaaggcaattttctcggtcgcgacaagatggtatcagagccatctcgactgtaggataagccaagtggataaaacctaaggacatattttataaataaaactatttgcgaaagttccttttttctccttcccctaatgctatttgcaaaaggtttactcccttcttccttattcggatttc

SEQ ID NO: 55603 - DNA, 2592 bp, Oryza sativa
  unsure (1)..(2592): unsure at all n locations
nnnnnnnnnnnnnnnnnnnnnnnnnnnnnnnnnnnnnnnnnnnnnnnnnnnnnnnnnnnnnnnnnnnnnnnncttggtgcgaggaggctggtttagcgatgtctgccctgttaaaccaaatgaaggggcttctctggcatatacccatggacaattcagggcatagtgtccttgttctctacaatcgtgacaaaaggggacatcctcttctggcattggaagttcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttactggagacatacccgctgacattctttcctttttctctgttaaacatctgttacaggaattgaggtgagagaggaaacaagctaggaaagaatagaccagaactagagataggaccttaaaggaactaactcttcttgttgatgtgttgtttgttttgcttattctgcaagttgattaagcaaacaacctagcatggttacatcacaacccaccgatgcaaaccacgcgctacacacacaagcaagaaacacacgactaacgacactaccctagagggtggcttaggttctgcgacgggttctccaagatcttcactgcttccttcactttactagcggatcctgcagccttctggaatttcgacaaacaactgacgatgtcttcttcttcactgacctgaccatctagtactagttgaaatccgaagaaggaagaagggagtaaaccttttgcagatagcacaggggaaaggagaaaaaaggaactttcacaaatagttttatttataaaataggtccttaggttatatccacttggcttatcctacagtcgagatggctcagataccagcttgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaattggggtataagccaggactccacctaagacatcttctccaaagcttctcttactgaaggggggagaaagatagagcaagaatgagtacaaccacagtactcagcaagacacaccggagaatgcatgattaatgcaagggagtacaaggagataataatacaggggttcagttttgcagtaaacagcatttaaaagtcacttagttgctcaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccacattttagttgtttgagcaaattttaagaattagaacactgacttgggtacattgctcggcttgcccatatccgagggctcggctattcgaatagatttactctgatcagaggtgtacatctttacccacaagacacatcttcctcacgtgtaaccacgcgccacataccaccacggtatacggacggaagacgtgacatagtttccaacccatcctagccttagacaagagtaccaacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccataactggcatgcacccaaaccccaccgaaaacaggttttaggggttttgaaagaggaagagaggtgtatgtccaattccaccataaaccaacaattccatagtgtccaaatgatatgagaatccccaaagtctaaagttataaaaccacctaatgttgcctaattaatcagcgaagcatctacctaaatttaaactagggataccacgagtagagtgtccactagttgaggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaggatgatgtgacttgccttgctcagagagaacggacttccgatccttcggcgacgaccgcgaaccacgcttcgggaacctccggaacgacaga

SEQ ID NO: 55604 - DNA, 6238 bp, Oryza sativa
cgatgctccggtgaggagggagaggcggctggaggtggccggcaaggaggaatgagaagggcgacggcgggagtgcgcctccggcggtccccgcgcgaaacggagggtaggccggcgaagaggaggcggctgcgatgctagaggaggcgacggcgcgcccgcccggcgcacgggcgaggcggcacaggcggctggaggtcgccgccggcgtgggagagagagggcgacgccggggatggggctagagaccacggggaggctcgggatggggttaaaacggtagaacggagtgcggggatcccattttatatgagagaagagggagccggccacgggggaggtcggaacggcggcggaaaagccggccggcggcaatggaaggcggccgggaatggcgcggccgttcccggcgattgggggcaccatcaaaggggaaattaagggggaaagagagaggagggaaaggggattaattccccctaattaatttggaaggaacggttggattcggggcggatttggaggaggaaacgagctagggttccacgggagtgagaggagccgggcgggaggaagaagacgcgcctggcgcgggggccccacgcggtcgggcggcggcgtcagcgcgcgcacgcgcgcggcacgtgcgggaggggagcggcttgggggctggggcggcttgggccggcggccggcccaggaagagaggattgagaggcggcctgggccgggcaggccgggaggggaggggaagagagaggcagcccgggagggagagggaagagggaggtgggccgaggggaagggggcccaagaggaggagggagagaaaagagggaggagaggaggacttcggactgggcttggcccaaaggaggaagaggagggatttttaggttttctttttattgaactttgataaatgttgttgttgttttataaatatttccggtgctctgaaaattccactaaaatttgagggctccttttagaccaaggagaatttaacaaaaattctccgggccacatttgaatttttcttgtacgtattttagtgtttgccaatttctttccgaattttaattaattctattattccttttagcgaatgatttttaattcgggatgaatttatcaggacgtgacaacagcggcccctagcagaacgtattgacccaccgggcatacataaagatcatatcggctgaacctctagtgcatgtatacttttatgaacccctttgcctcacgatatcgattaagctcgaggctaaatatgtgacatcctctaatagctcaatcattcactcgaacctgtgatagattatataacttatgattgactcctcaatcacctttggcaatttccataatctacaacatcgagagtgtaacatcctcaaattttaaactaaaatttgactgcatcatgctggcttttgattaaatttatttggttcaaaaaatctatttgatgtttatttaaaaattggttcaagtattattagaacccttccaatttactctaacttattccctttattctaaaccctagtgaatttgagcaaattctctcaaattcaaaccatagattatttctttagcctatcctattattagtggagttttgctttactctaaaccctagtgaaacccttccaaactcctagtttgaattcaaatcttttctagggaaatattcaaaaattctgaaattcactgttcattgcacataaggtgttcggtagaatgcctagcccaactagagcagcccaatcccttccaatcttgcacaaagtttagatttggtcctagtagaccacatcccactcaaaaaccgtggtttagttggccttctcctccccttcgcgcgcgctctctggcagtcgactttgccgcgcaccatgtcgccgcgcgtcggctttgaggccgcccgcgcgtggccgaccgccttggcgcgccatcgcccgtccgacgccctcagcccaccgccaccgcaccaatcatgacgacgacaaagctaggacgacgaccgccgcacgaaatcgccgctcgacgccgtgcgctcccatccaagccgccgccgagtgcgatttcgcttctacgcggggtgaatcgcgccaattcttgccacacggttggattgaagatagacggtggtatcccctctcacaattcaaaccattcaccccccaagccggccgttttcaccctcgccgccgccgcgcgtcgcgctcggattggcgccaacacatcgccagccgattcctaccgcggtcaagtcaatccttcgccggtaagtattcgaacgtggcctcccgccactcaaatcgatcttgcccgccctctctcagcctctgccacctttgcctcatccaaaacccgagctcatccatggtgatgacagtgcccgagctcatccgctcctcctagcactataaataagaccccaatcccttccctgtccatcatcgatcatcaacaaccatagccccacaaccccaaagctttgcttcaccaatccatctcatcaaccaccctcgctcgtcggtcgaacaccttgtgcgcgatcgactccacccctctccatccatcctccgccctaaataaccattagaaaacctatatcctaccatgttctagcataataagccctaaccaaagccctgcgtcgagttttacctcgccacaccaagccgagcatcgccgcccccgtgctgctctgttcttcgccgccgcgaagtttttccggccgcaatccgtcgtttcaaccaatctcggtgagttcttccgtttcaaccatctacatactacctagattccattttagcaatccctttgcactaacatgccaccctctgagctgcggacgtgagcacggccgccgcctatggaggcgctcgtcatcaactatgttccgcaccttgccaaaggttggcaagctgccggaatccctctagatacctcatagatgctctagagcccctcccctagccatgtctaactcttatcaccttgatcgccatctcggcctaaccgtgccaccgccgccctagccgctaagccgtccatgcatcaaattaactcctccgccgccgctcgccgtcgccggagatccctagctccctcccctcctcggccgcaaccactttctccctctagcgccgccgcaatcctaaaccctagcaccgccggcctgatttggggaacggccggaggtagaagaagagaagagagagagactgacaggtgggacccgcatacagtgccatttcacttttattcaattttcaattttagaagcccatatcttttaaaatatagatccaatttcaatgaaacttggaccaatattcttctaaaatcattctctatcttttggacccctttttgctatttttgcattttattttattttctctatttttcttatttttagattttatttaaaactcctttttgaatttggattttatatgtctaaccctaggtcttgaggattcctctgacactctagataatatcaatcaatctcaggacatcgagcaaggcaagttaccatatacctgttgatcatttaagcctatattttacaaattatttatttatagccttctattaaatattctattttctatgcgtaaattaatcatagaaacccagataatttagtattgcttattttgcttacaatctggttaaaataccctatacttagattgggacaatacgtaagatttggatgatttccgggtggatagtattgtctcaatcgatataagttttaccaggtacttatgtcgaacgaacgggtacgaccgcagtttctagaatggggacagacctagttattatgttaattagcaatatggcacctctgtatagtggttcttatttttaagtcctcgcacaggaggcaactatagccgcgaagggcaactttaaccattaccatgtacaggtaaatggtttgtgatactcgagtataaactatatggtatatttctaaaccctgatcgagatgacgtggtgtcatacgatcagttccccttaaatacctcgggaacgccagaactcctcttgctgctgttaatattatgttcagagcatatgaggatataagttcatggaacaggtgccataattgttaataacttaatactgggccatgactaaagccgatgtttatcagcaagtcgtggactgcgggtaaagcgtacatctgctgcagtagaatatctttgaaactatttgaatagccgtactcatggagttgagtaccgggactcatatggtaccctggttagaaacctaaagtttatatgttttataaactcttgctataatttttccagattgtccaatactgctttttgcaaagaaccatattatatgtcaatgcataacatatttccgtgataacttgctgagtattgtgaatactcatctttgctcttataacccctttttcagatttgggtcaagaggaggacccatatgactattactacgaagaccccgataatttagaaaatccctaaaggttatacctcactagtcagaatgtatagaaacttccgctgtgtattaatcagataggtgagtacctattattgtaaaacccttagtattgtaagactttaacatatgcaatgaagaaccagttatattgcatgtatcaatttttaatgatccaaggattgatacattaatctcagtcggatccaagttgttaatttgggtcccgacagagaggcccagagatatctctccataggaggggcaaatcccatcttgattattcatatcccactacatgtttcacagcatacccgaaaactacttttataactacccaattatagagtatcgtttagcagtccctaagtaagctactacacatgttgagaaccatgataatctcaggtctaaggatcaacaccaatactaaatgagatcactgatgacacaacacatatggctcttgcaacgtctcatgttgggtctatccaacaacatgttccccaacatgtgtccacattattaatttgttatctctgtactatgatctatgagatatgatcatcaattaatacatgtgctgatcatttaaacatatttgttccacatatgatatttgatcagggatcctttagaaatagtaacaaacaacataaagagtctcatgaaagaattacatattcattaaccaataatgagttatctattttaaggaacaaagtcggataaatatgtaaacatagtatgtgatacaattatctctatgattgtctctagggcatatcactaacagcgtgctggaaaggaatcacggtgtcgtatgagctctatcagcgggaaacatatagttcaactgtatgactattgcaaacataaattttagtgctgcgcatgtcaatactaattgggtgcattgttttgctgtagaaaacagtaaattagggtacttcgaaaaatgatactccctctgttttaatttacttattgaatctcagactaaattagaaggtcctagctgtcacgcccggaatttctatccaaaattccaaacgcttacatgtgtgttaaaccctcgtccaggaatcagccgaggcacacaataacaaattgataatagagtacaaataaataactatttaatattcgcaaataataaattattacagaggtggatagttcctctcaaagaataacattctacgcagcggaaaaaaaaaactaaaacaaattacggaacagctatggcgactccactccacaggcatcttaaccaagaacaagcttaatcctccagatcatcaccttcgctgagatactcctcttctgatgattgaatattgcaagaatgagcatatgacatactcaacaagccacacagcaaatatgcaagtgcacaggataacaaaggatggcataatatagctcatttgcataaacagcatttaataaatatttaagataatagtaaaatagttgaataattaatcaatattaaataacaccatacaacatacccgtgttgtataggcccaacctcatatgaacaaccaaccccggttgaacaaattaaacctccaaaccaggaatataccattccaaaccaggagtccaattaattaacacaattaccattaatgaatagtgtgagactaatcacgaaaaacattgttcaactcacccataaccgcgggtacggctattcgaatagattaaactc

SEQ ID NO: 55605 - DNA, 7408 bp, Oryza sativa
caaacgcttacatgtgtgttaaaccctcgtccaggaatcagccgaggcacacaataacaaattgataatagactatgaatacacagctatttaatattcacaaataataatttattatagaggtggatagttcctctcaaagaataacgttctacgcagcggaaaaataacagcaaactacggaacagctatggcgactccactccacaggcaacttaacccggatcaagcctagtcctccagatcatcaccttcactgaagtactcatcctctgatgaatgaatattgcaagaatgagcatatgacatactcaacaagtcacacagcaaacatgcaagtgcacaggataacaaaggatggcataataaagctcatttgcataaacaacatttaataaatatttaagagaatagtaaaacagttgaataattaagcagtattaaataaacaccatacaaaacacccgtgttgcataggcccaacctcatctgaacaaccaaccccggttgtacaaatcaaacctctataccaggaatataccattccaaaccaggagtcacattaattagcacaattaccattaatgagtagcgtgagactaatcacgaaaaacattgcccaactcacgcataaccgcgggcacggctattctaatagttttactctgatcagaggtgtaccattgtacccacaagatacaatcccacaacatgttaccatgcgccttagtaccaccacggtacctcggaaagaaactgtgacattaccccttgcacaacaccactcaccacagtgcaccgtccctggatcataatctccccctcaaaaccagaggcaatggactccccagcgacccccacggacttctcgccgcttcacagtctggcacactataatgaatcatgctatacaaaagataaagccgttgcccacgctggcttgtggttggcacagtaaatatttcacaacagtagctcgcgaaccggtccttaattgtcatgagcacaaccatcaaaaccatatactcacaacccaccttaaccaggttttaattagcaattaattaccatcacacgattaaccatcgtgagctaccattgaatataaccataattaataataataattatataatataatttatatttaacccctttagttagctaatgtttctaagcatagctaagcgaatatacatatagcatttagctgaaccaatccaatatataaggttcatgctaatcaaattataacccataggaaaataaagtcatcttcggccattaattaacggggaaaggttaaccacccgatgacattcgaaaataatgcatagttgaaataaaacaatagctttaaacgggttcaacatgctcaaagggttgtttgggatctgtgtgacttgccttaggcttccacaaacgcttcggaaccttcctcaacggaaacactctcctccggaacgtcggaaactaacgcaattaaacaaaaatcaacaaaacagtaaaaaataagcataaacagtacatgtggatatttttaacatgtagatctcaatttcagaaaaatttagcaacttgaaccacctgaaacggatctacggttatttagttatgattttccaaagttttaatctattagaaaaacgggaaaaagaaaaaacgatgatgacgtcatgatgacatcatcaatggccggcccgggttggcgacctcgccggagattggatggttggccgggattttggaggacatgtacacgtagaggacgacgagacgaacccaacggtactcaccctcgagccaaacgacgaacgacgacggccggcgacgagatgaacggcggcggcggctccggtcggcggtggcgggtaggctccggtggtcggcggcaacgggggacgggcggccgggcttcccctcaccttggcgcacctattggcggcggcggcaagcggcggcgacgacgaaggcggcggcacggcgctaccggagatggccggcggcggtggcgacgactctacggggcactagagagctcgggaaagggggcaaacgaaagaggaggactaggggatcctatttatagccttggattggagatatcggactcctcccgcaagaaatcgatccgggaaatcaaaaactcggttttggagataaactcgaaaacgagttcgatttggataaaatactcaacgattagctccgatttttggggtaagatagaggaggatgagatgagaaaaccccctcaacaatcggactcggggaggccggattcgatgcggatttggaggggaaatggggcggctcgagcggatgcggatttggaggggaaatggggcggctcgagcggcatggctgggctcggccggccggctgctagaggttagggaagggtccgacatgtggggcccacatgtcggtctcccaagtggagggggcggctggcgggttgggttaggccggctcggtggctttgggccggctcgggcgcgcgggagagagaggagttgggccgaaatcggcccaacaacttagggaagggatttttgaactttttaactaaaataatttgtgaaatgttgttccaattattaaaaatacttcccttgctcaaataattcccagaaaattctagaaaatagagaaacaagtaaagtatttaataaaattttatctagctcatttttatgttgaaaattttcctagattattagagtttaacttgtaggcttttaatttaatttctaaaaaagacttaaacaatgtatttataatttaggcgatttttagggcgtgacactagctagtcgtaatcaccatcctaatattaaagcttccatcatatatttttacaaattataccagtcttggatttaaggagcagcctgtgccaatttgctactttgtaatcattaactcctaattttagaatgaaaatcacaaaatacatagagtagttctactataagattaacatctccaaattcaaaattaagtaattgtaaaatatgtagtctcagttatagtatttttttcatgacttaatagttatgatattcagaattataattaataagtactgagttgtactcaacgttatggccattttttcatttttttaattcaataagtatgaatttataaatttataattatgaaattatatgattttagaaattctaatataattgtgttgtacttacatgtcctcttatttaatctattcaatcgcaattgattttatttttttagatttgagttattttatattgtatatgggatggacttttttttgctctaaatctaagtccatctaccgccaccagaattagcacggatagattattttcaatctagtgtaaatgtgtaactgcacactctctagccaaaaagataacaaggaaaaaaattgcatgtatgtgctcgagcaattaatgtaaacacctagtctgtagtggaatgaaaaatcctatacttatgtattctcataatatatacagcttaagaatacaattaatactatggggcatggttggtccagaagagagattaggtagatagttaatctcgccggaaaaaaaagaaaggtagatagctaatcttttttagacagaaggccaacggcccagcttataatgaaagaggttttacgtcgctaggggttacccagtttaacagcagcacaaaaacaggagggatagttatccttacatattcttttatctaagagccgtgggatcgctgagagattaagagccgtgggatcgctgagagattaaggctgccacgtcagcttgatttggacaaagctaacaacgataaagctaacaacgacaaagccacaaatgaggcctccaatcgttttggttgggcttaatattacctttgccggcccttccttacacatgggatgtttcctttcttatcgctcggcctgctcaaccccctaccttggtgcgatactgctgtttctcctcttcctacacgcagcagcgccgcatcgatttgggcgctcactacgtacggtgctcgccggattggccggcgtccctgccgccgtacacggtagtggaggtcccttgatgaaaactcctctctgctggtccgtagacgcctcctttcgccattctctcctcttcagttttttcggtgaggtcgccgcacagtacccgttcttgctttctcccctttcttcctgtgcaaatctaatccagtggattcttatgtttctcttctttcccagggatttcttcaccgtccggttgtgcattggcttcccctaggaccttcttgcgtcgcctgattgatctgcagggtgtgccgccgtgggagaccctaggcctccacttcccgtgctaaggtagtttaatcatgcttgggtgataccaattttttccttattgtgtgacattgatttcttagcttttttattggtttttcagtttgttcatcatgtttattattactctatttaccgatgccaaccgcacttacctctccactaaccaatctaccgccttgcctacatcggccgcatcactagcttccaccatggaagggggaagcaaaggagatagcaacagcttaggggcacaaccagaagatcaaccggttcttctcccatctactgatctacatgtccataaagctgtggaatcacaagatcaaccgactattctcctatgcactcatccagatctcctacaaaattaggtattttcgtcaaatagatctcctctacatatttgttcgtggtttgtcttagaagcatccaattaatgcttattcttcccctacatacatacacccattcattgagcctgcctttgctcaaaaatacctttcacttgcaggaatcaactaccaatttcgtctagcagatccaaacaagtcaaccaatactgcatattccacccacacatgacgatctgtcacagctattggatctgatgaatctatcctagatccaaccgtacacggcaaccctgctccagagcaatatgtctacctcccaggggtaagtcaaaagaaaagaacactcacaagttttttcccaagcgtgcaatttaaacttaaactacctacaccacattagctcaccctctatctgcttgaaattatgatgcattcactgctttagtcatatagttcaaacatattacaatataattggccattatatatatgcaaagtaaaatatcattgcagtaaacatatagaagaataacaagacatattgcacccatatgaataataattttaacaaacaatactaatatatatatctacatgtacatctttattttttagacaattgtattaaggtatttgtatccacacacaacccaattgtgctcacaaatgtttttttagtcaccttgatataaataggctgcaactaaagtctatatctcaaagcagctcctgctaacgcgattacatccaagcctggcttagtcatacattcgtcatagatcaagttcgaaggaccagatcagtatagggccaatttaaacatggatttaccaagagtaggcattcgggtataaaaaaatgagatacattctatggtgaggtagcagacacatcctacgaagctaaagagagtaccacgcatgcagccattcaatgccttcagagaaagaaaaatattgcaataaaggatctactgagaagaaactccacacaaccaagcaaatgttagacctgtttgcacatagtctagaactccacagaaacgaaggtcacctcctccaacagaaccaacagaaatataacatgttagtgaatgagatcaacatgatctgtgcccaaagtgcattataccttcccaaacatgtcaaatggttgggacaaccagcatggccaaacaaatgatatctctgttgcatacattggccattctccacctgtcacatcaaatgagatacttgcaaagcatctgatagctcttacgcagtacaagcatgattgatcatccttccttcccacataggcaagtattattcaatctcctacattatacatatgagtattttcaatgtaccaacaggtcattactaaacaatgtctattaccgaccaagctatgcatcccaaataatgaattgcatggattttcattttgcaggataaacaaatgtgtatgtcacatggctaggaaatccaaatgtggctaaaccatcaaagtgctgtgtccacattgtgctagcttgcatttgcccctttttgtagcatatgttcaaaccgcttggaccatcataattgatgagcaaaacaatatatccctatatgttatcaccactgttataatgttaaggttgttcaaatattgtaccatgtacatatcgtacctgatgttatctgtataaatttcgtatcctgtacacatagatatcgactccatgtaaaataatctactctatgttactgttgtttcctcttttatgtaaaaatgtctatgcctattatcttcatcaccatcttattcacagttgaataacatgcaacctcctgtttgcatacttcttattaatcttaaggaaaacaatttattatgataactatgacaaacttttttatatatgcaatgaaaaatgcttaactcatggctcatataagatcccttggccaaagctgaataaaaccgcgcgcggcatagcgcgcgtttattgctagtcagctttatagctgagaataaagattgcacgcaggccaaaacacaaaaaaaacaaagccctcagaaccgtgataacatgtcatccaacagtcgatctaagcaactgcacggcagtcattgtgttctcttccagctgctccaactggttggcgccttccttagtctatgccactgtctcaaaaagaaaatcactcgaaagatcagcgtgagagacgtagaagggatcttcttattgaaaatcatgtttttcctggctagccaaagtgcccaggccgtcgcccctaacaagattattaggttattggatttatgtcatggtaagccaacaaactgttcaaaaaataattgatgacataaagagggaggggctccccaatctagtgcatatcttagaatacaccacaggaaagtggccaaaggacaagtgaaaacaatgtgatcagcatcctctgagctgtggcacagggtgcagctatcccctccccctatacgacaacagtgaaagaatcagaagatacaatcaacctgttaaaaggaagggtagaataccgaaagagcatcaacaatgaatcaatctaatattgacggctggcggatgtgattgcttggtcctcaactctatggtcgttgaatattagcacccatcgttgctgctcttggcggagagatataataatgttttcatctacggagaatttgagatcagaacgaagggatcaac

SEQ ID NO: 55606 - DNA, 3695 bp, Oryza sativa
ctgattttgatctctaaatcggctccgctagccggtttagctgtttttctacaaaacccatcttgatttggccctttggctagatcgaggtggttggcgactccatatcaccgcaaggcgtttaggtgttgcgatcgtgcttgtcgacttgtcaaaaaagttgccaacagaaaagattagtaatactagccgttatagcagcaagttatgttgcgatggttcaggcagacagctacatgattcacagtacatctgaaattcggtgaagttcggcaagtttttttgtagagggcctgatgactgtagtccaatttctagtatgaaaaatagagcccaacaaggttttccagcaatttacgactcatatattcctatagcatgtggattctcgtgtgtttctaacatataattccagatgataatcgttaaaaatcacatctaaaagtaataaatagttaaatatctctaattttgtagttaaaacttatcacacaagggtggtaaacgatagctgggttgaaactgaacacaaccacttatccataggagtgcgttgtcattcgcaggggtggatgaaatgttttccatagaccgaaatatttttaccctataaaatatttgaggactaggtaagctcatgaaaaaacccattaccaccaccggtcatccagtgatattatgccatgcataaaacagaaattttgaccactaacccttaagccaaacagcaccatatatacacttttaatagtccctagcagtggcagtgaatctgtcacctatatataactgtttttacaaattggctcctgaatattatggaatagcataaatatttcgttcaaacaattaaaaaagttgtactaacatatttgacaattttttaatattatattatattttatccatagcaaatcattggtatttttctagtgaaccaaaaagctcccaaccacagtagacttcatcatttcacttattgacggaataagcgaaacaccatatttgcaaacggaaaatggtttgtaaataaaacttttatatacatgttcttagccatctaaaagtaaaggttgaaaaataaactacgatgaaaaccctaaaatcaactccaaatttaaggttgaaaatttaaattttgtcttataagaacaagtataatccaaaatataggactagcatagcatggcacaaagggtttggttagccagaaggcacggtgtggtggtacaatgctgccacgtcatagtcaatgggcatagcatcactttactactatggaatgtccagcttcatggactattacaatatgactatttttggaatttcaaaacataaaaacaaaaatcttaaaccagtattaaggcatgtacaacagtgcttaattattaacaggctctctccgttactatgcaagtaaatttggaaacatggaaggcagagagaagaggaaaaagaaacatcgttgtaatgcatgacaacatcttagagtcgactcttagcaattattaaataaaattttgttgcatgtggatggagaaaaggaaacaagagtaataaaaaaatattttggtgcattagttgttaatatgttttcttatgtcaacaattgttgcccctaggatttcttttttgttcttctcgtgacttgccactagcattttcatgtgagttctgactgctttttgatccagataatttgtagggcaggttgtagttttgggctgtcaataccaactcctccttcatattttcacttctatagttatcgtctaaaccttatccctaaattaaactattttgttctggttgatgtgcacctgaagatagttcaagtccgggaactcctgggaagcctggcagctgagatgccggcattcttatcagacaccaccatccgccgtttcctaagggcaaggaactggagcacggaacaagcaaccaagtcgctcaaagaaactgtcaagtggaggcgtcagtacaggccagaaagcatttgctgggtgctctcacaaatcccaaatcaacccctttgttgagtttgtaccaattgttttttctaaagcataattgtttgtaattattatgttttggacgacattgctgacaaggagtatgagggtaggagagcatatatagctgactaccttgatgccaaaggaagatctatactaatcacaaagccgacaattaaggtcagatttttgctgactacaggatatatatatgccggtctgactgtgataacaatccactagtaatttggagcaaatgaaatgattcaagtccccggttgaaaaaactaaagacgttctcgaagaaaatcaatgaatactaacaggatacaatgccaacttaattaggtgactgaaagttaacttttctgtagaattcagaacctcagacttgcatgactacaaaataaagttatatttctgcagttctcttaccaacagattaccatactaggggtggcaaaaagtgctgttcttacagttcaagttgaatacggtttttattatgtatgatgggtttatgggcaataattaataaattttgaagggtttctaatgtggtacgaatttaggcagggggtaggtttcagggaaggagcagataaaacactttgtatatctcctggagagtttggctatgaactctgcagatgaacaagaagaacatgttacttggctgatagacctcagaggctggagtatatcaagtacgccattatcgacatcccgtgaatccatgcacatagttcaaaactactatccagggattattgcagtagcaatactcagcaacactccaaggatttttgaatctttctggaaggtactatgcaatattcaggacttctatttactcttactaaatgatgttctgtgatttagttagtgaatatatgtactacctccgtttcaggttataagactttctagcattgtccacattcatataaatgttaatgaatttagtcacacatatatgcttacattcattaactggtaataattaacatatctatgaatgttgacaatgctagaaagtattataatatgaaacgaaagaagtatgaactagtagttgtcttgtcctcatttgcagattataaagcacttcttggaagcaaagatgagcgagaaggtgaagtttctatatactaacaatccagagagccacaagatagtgtctgaaatgtttgacatggatctgctggagactgcatttgggggcagaaattcaattaccattgatatagacaattatgctgagagaatgaggagatcagatcttgcgagaggagttttaatcatccaaacggacataaatctgattagtcgacatcactgaatctctattctctgtggagaatgcctattgcttaatgacagctaatgaagaacaagaaggtaccgtgcaaaaaagtggaagaaaaagaacaagccatagaaaactacgtgctcaccttagctgttttagatgttatatcaattaatctcaataattatggacgacatgttgcgcatgatcaaaaaaccagttaatccttacagtatgtttatgtaatctaatactacctctgttttatattattaattgttgttgacatttttctaaatccatcttctttttagctttgatcaagatttgtagaaaaatataactatattttcaatgtaaaacaaagg

SEQ ID NO: 55607 - DNA, 6454 bp, Oryza sativa
atcaattttatacatttggtaaaaccatgttactgcatgtataggcccttgttactgcaagttacacattctgttactgcatgtggaggattaaagttcaaaatgccaatttttgaaaagcaatatctcacaaggtatgtattattttttaaaaccgttttcacaatgatactatagtgcatgtgtaggtttaaacttcaaaatgcatttacatattctcctcctcaagaaatcgttcttcctccctcttcttaagaaaaccggtctcctccctccaatatagtgttattgcatgcatgtatatgacattactgcacttttgacagtaatattgttgtgaattacagtaaaccaggaattgaaataaaaatatatgggttcaaagtcttagatgctaaccatatacttgttactgcacaaaaataaaagtgttactgcacggcatatacacgttaccacctgacagttacacattaccgcatgtttacgtagtaacactatccaagaactgcagtaaaacactttgttactgtagaacatatagaacgttactgcacctttggcagtaacatcgtggtgaaattgtagtaaaccagaaatcaaaagaaaaatatgggttaaaagtctcacatgctaaatatacatgttaccgcacaaagtggaagtgttactacatggcaggtacacgttaccacatgtttatgcagtaacactattcataaattacagtaagatgcattgttactacaaaacttatgggttttactacacacttacagtgatgttgtgatgggattcactacaagaaatatgaccttctgtgacgaattcctcgtgacatcggagctattcgtgattagcacatttcattttatgacgattagtatgagatggggtggcctagtgacgaaaaaaatgtgttcgtcgttaataccgactagaaatcgtcataaagtatttcaatgggacattgtgacgaatattaatttgtcataagcggcaaaaaaacaaacgtcacagatttatataatgcatttctagaaaaatatattaaaaggtgaagcaatttaatcgagtgaattaatgagtaaactaaaattttcttttaaaaatcatgggcgaaattattttgtaatattctacatgtttgaaattattctctaaaattttccgtgaattttttttaagctcaataactaattttaataccacaaagtttatttaacctattaaaataaatggaaaactaattaaaattgctccctctacttgggccttattcggcccaagtgttactccctccttagcccacacagcctctctctccctcctcgggccggcttccccttcccctactccctctttgggccgccggcccaatctatttgctcctccctcactgagaagtctattttatcaattcaaataaattttcgagtagtaaataatttcaaatgaaaaaaattctcaacaacaaagttgtataacttatcaagatctataacttttgttttggttattttgctatatgactttgtttcaataatttgaatttgaatttcaaattatgacaacttcaaacaacattttcaaatactaaatgatttcaactgaaaaagtcatcaacatcaaaattgtataactcatcaatatctataacttttattttggtcatttcttcatccgataaagtaatagtaatattgttaacaaaatttatatatccctcttatagtttataaataaagtatataaaagatatatacattttgtgaacaatgttacaaatcactttgtcggatgaagaaatgacccaaataaaagttatagatattgatgagttataccactttattgttgatgacttgttcagttgaaatcatttagtacttgtaaatgttgtttgatattgtcataatttgaaattcaaattcaaattcaaactgttcaaacaaagtcatatagaaaaatgaccaaaacaaaagttgaagatattgataatttatacaactttgttgttgacaacttttccatttgaaatcatttacaacccgaaaaattatttaaatttcttatattttaaaattcaaattttatatagttcaatcaaactcggatggagaaatgaccaaaagaaaattggtagatctcaataaaagttctacaactttatttttaacaacttttttacatgagttcatttagtataataaaattcgatttgaatttttaatattttgaaattaatttttttccctccaaattttttcatctcctcttctctctcctcctgatattttctcctctcctctcctctcctctcagcctctcttctcactctttcctcctctcctctctctctcaccgactggaggttgggagcgggcgggagtggcggccccggcagcggcgggcacggcaacgacggtggcgggtggcgggcacggcgacagcctgcggcggcggatccggcggcgccgtcctcggaagggcagcctcgatctccgctggtccttcgtcgggaaggctgtccgacacccaagcggctgaaggatcaaggattcaaggccctgaggtggtatggcgagccaggagaagcccacgccgcctcggcatccgcctccgcacccaccggcgccggaggtcgcgcctcttgtgtgcgggttcggagggggtccaccgggccgcggcggcagcggctcggcctcccacccaactccagcgccgccgcccggccaccctcgccccctccttccctcccccgtcgccgccgtcctccctcccctattctttccccttggtacctcctctgatcgaagctgacttgacctgttgagattgcccccatgtcaccgccgtggtcacctctgggatgggaagcacgggtcacgacgcggaggtcacctgggccgacttcgacggctcgtctttggcgtcgccttcttcgtttctcagataaatgaagattttcacagaaaacaaagattttttttatgatctgggttcattatgttcttggtgcccattgatttaataattaggtaatgttaaaaagtttgtgctctcaggacatctaagatggaagcagtggataaagaagttgcagttcattatcaatatacaaggtaacaacaatttgcagttctttgctatttggatgtacaatttactggtctgtggttggtccagatgcactccaatgaaatcaaacatgtcaggcagcaaggtgaggagaataccaacccatttacttaatggatgctcatttggtaactacaataatccatgaaccataagcaaactgaaatctttaacttgtacctagttatttctcaaagtagtattgaagtaggcagcattagcaatcagtaatgactctgcgcaaggttgaagcattcaaactgcatatatttactgcaagaacttgtgcatagtacacaacttgttataaacgcaaacctgtcaattcttcatgtttgtgtgctactagtgggagagttcagaggacatgaagagttgctgcaactctgctcatttgcttgaattggtggtccagcatttctggaaaataactgcaaaacttttggatcaagcaaaatcttgcaattaggcgtcaactaatatcatccaaactgaattaaaaattaggataggtactgctctaagattacctcaaacttacttgatctagcagcgtgtgttgggctcctcaaagggtcacgttaatgggccacctgcgtcaggaaatatggggagaagtagatgcccaaataacgaccgtataccacataattttaacaaggactaatatggtggtcgtcagttttggtttaactagctggaattaactgtaagtctgtaacgaccaggactgtttactcttcatcgttaataattgaatgtctagtagtgctctttgcctcaggaagctttgatgaaattgctattgtcgctggtgggtgtgataagaatggacaggtgctgaaatctgccgagctgtacaattcagagactggtcattgggaaactttggcagacatgaacttggcgaggaggctctcatccagtttcttcttggatggtttctacaggtttgtgttgtctttgttttactaatgacaaacatgattaatagctgcgttaattacatgttcttggaactaattttgagtattgactaagcagggtaatgtataggctgcctagagtaagaattgcatttttttcgagatggagtatacaggtatatcgtagagtaagaattacattgttggtctaaagaaaaactcattcgacacgttctttgtactttgacttaacgatgttaagctttttttatatacgacaagtgtgccttgcatgctctctacaattatatgactgtaacaaactagagaagatgtttggggtttgcctgttgtgttcactggaataattttgtagttgaaacttgaaagcaagttttaagagcagcaactgtttcttgctccctcctgtgattttgttctccgggtactttctgattgcaggagctcagctcttgctcctcaatttagtttgtagtatttgacagatttttagcttactactgaaaagaagttatttattctatctccttaggattatattatttccatcaaacttggattaaattgggattcttcactcttctgtgttttatcatttccaggtcagcccatacactattctgggcatgcataaaaaatacattgatatattatagttagaatttagttaacatactgtctccaagaataacctataagtgcaaacgtaattacttatttacatctcttgctaaagtgtcgatgtaaatatcctgaagcaacaattgctttatggataagaaaactttacaatgattgcttgttgtatataacccattaactctgcatacaaaaaatctttcagagtgtgatggcatgttttgtttacaaatttttgcatcttgtatttacaaattgtttgcatgtaatttcagatgtaaggtttgtccatcctcttcgtgtcgccttgatgattcatgatgagacggcagtggtattttggttggtgtgatttcgacacatggttttgtgtttggtaagtgaacctgagattgtatttggacgtggttgggttggtacatatgtattttgacatgtgattatgtgttaagtcagtactaatgtactgcacctgattatgtgccgatgtattttgttttggctagttaatctgtaatgtattcatggtcagtgaacttgtgactgtgattgtatttgaatatgtgactgggttggcacatatgtatttgcactgtattagatgaccattggtttttattggctattataagggctgtaattttgtgctatatgatttattgggcttgtatagtcttttgaaatgggcttggcccacttggtatctggtactggtattgctagtctgctacaaatggattagcaaactgggctgaaatagtgtataaattgctacgtaattggatttggcccataatcaggttgcttacgacattgctctaaacaggccagtagtatgtaaattgctattttttagatgggctaggcctaaagctgacaagatttacaattgggcttagcccacgagaactacatggttcttgacagcccataataaagtttatgacgttttataggctagataatgacgaatatgagcgtcacaaagttatgacgatggaaggatcgtcactagattaatgacgaaaaaaataaggtttcgtcatagaacgtcattagagacgcatgataggtgacgaatgaattttcgtcatgcgagcgtcacagattacgaaatgtgacaaaattttatgtgtttgtgacgtaaatgaaacgtcacctatcataagatctcttgtagtgattgtagtaacgcattacagatagtagtaacaagtagtaatgctatagtattactacttgtggagagttaagataaaaaaaaaacccaagcttcgaataacaatatctctcatgtgatgtataattttttaaaaccgtttgtaccatgatgttacaaaaaaaatgcttatcaaaagtagatccgtcatgactatattttaactaaatttgaatgttgttactgcacataagacacagttttactgcacaatggatgtcgcgttactgcactgtttcacaagacgagagctgagaagaggtgggtggtgggggagttagtaggcagtttgaccgggttttgaccgacgtgggggtgctttgactgacctttgactgaggtggaaggtgggttttgagcccttaaaaaggaggggaggtgggtttggcccttgggagggaggggggtatagaatagctattctatatccgggtgtagtgtatatatatatatatatatatatatatatatatatatatatatatatatatatatatatatatatata

SEQ ID NO: 55608 - DNA, 11706 bp, Oryza sativa
attattatttgtgctctgaaaattccactaaaatttgagggctccttttagaccaaggatgtcgtaggctctccagaccttccattatatttgagagatgaagtgaataattcaaatcatcaaacaagcataatgaaacatccgacgcctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagatccacactttcatcttaagcatgattatacatagcaaacacaactaagatgaaagaaacttaagacttacaacaacttaataattacataggccaaccggccaaatagacttattagagaacagcggaagcttgactacccaatcacaagcacaccgactaggggtttaccccattaagttctcatcctagaagaagcaatcggaactcgcatcactcaaagactaagactaaacctgcaaacaaaaggttatatcaacagcaagagtcagtacattaacaagttaatgtactggcaagcacaagtcaatcctactatactacatgtaaggcatatattcaaaggaaggcaatatgtagttcaatttcagcataaagcaagttttgttttgcaattcttttgtaaaggagttgatgcttcaattaacaaagacaagttttaagtttcattattaacttcttcataattccatcataaataatctcttattgccatacttaacaataagtcataatgtatcaccacatacacaactcaacacatttatcaatttcaaaccaatgtcacatgatcacatttttaaaacatagtctatactcatgacacatcaccaaagcgctcatgaccgtgagcacggctaatcgattagtttaaagaactctgcagagtttgtacagctttacccacatgatatgaactctctagtttgttttgagtttgcaagactccatcacactcttcatgttgaatgtgatctagagatcataacgaagcctttacactacttagaatctagccttgcaccagcacgatacgtgttcctccatcctaggcatacttggaatatacctagaaccgttaagtggcgggcccacgccttaaacttaacgccgtggtggcggacacgacgggaacccaccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacggataactttaaatgggtgacacaagttcggtccttatggacttgggcaaacacttcccctatcggtatgcaactaacaccatatgcacaccacttgctgcccaagtataaaatcacattttacacattttagttcgcaaatacccatcatattcattttattccagcaaaggttcaagtatcaaaaccacattttaattatagatggaatgagcatttgcatatttctaagcatggctaagcaagtagttgcacatagagcatatataaacccattcgagcacaatgaatgtactctaatcatttctaggggttcaaacagcaagaggatcaattattcaaggtggaatatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccacttcttcaccgattatgcaattatctagataaaggacacgatatgcaattaaacaccgaaagagctgaaaatccaaaatgctctaaaatgcatgatttatgcacagtgggttggtactgatctaaaatgaatttaggtgaaataattcctattttattttattccatttgggagttatgaattttagaagttttatcggtttacaatagtatagtcttaggtagtgttatgaaatacttttgtaaagtgatttttattatattggacttcacaggggtgtggagatgtgttttctaagactaacacatttggtttcacaatttttggatttataatgaattctttatgcattttacaagttataacgtgttattggtgtatagtgttttatatgttcatgacttttgagttataggttcagaacatgctacttcctgtttaagttgaataaaaggaataatttggttaactaaaacatttttatctcacctgtttatggtctttactactatggttcatattttataaagtagagatgctttaatctaaactagcaatatattatattaacctagaaattgttatatgagctaagttcttctaattttagtggatggaaatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacaaaaggtgacaaattttattttactatgttgaagataactatttgctggttctatagaaactttgttcatttcatttggactaaaaataaattttctacaagttttacaaattaatggctgctctgtgttagtaaatctttatatgaatatttagagacttttactacacagcaagtatataatcttatttcataacttggaaatacatgttttagtgattctacagaacttaagtttactcaaattgaagctaaattgggttctacatgaatttctaaagtttagcttatctaaaactaatcattatagagataatagttttagaggcatttgatgcaaagtaagtaattacttttatttaacctaatcagagactgtatgatgatgaatctgtagaatttgattttgtttcaaaatgagttgaaatgaattttctatgcattttataagtttgtacatgtttatgtataacctatcttagataaattttagagacattatttgtacagtgagtgtcaagttttatattcctggaataaagttcataacttcaagaatctacagaaactggaataacttcaaaatgagctatatttgattttatatagattttacaactttgtgcatttttctgctaaacatatatttgtttgggcattttcctaatttttcttcagattttaaaggatgggtccacatggctgtgagggaccaatatgcacaaaggcccttgaggtttctaggaatcaacccgcagtcctaggcccatatgtcagtgtgtttctacaattgtaaacagatccctgcacttaatctaattcacggaagtcatccctctgctctaggcagagcagagctagccatggctgagctcgatctggagctcgccggcggcaaacggtggctcgtttgaggttgaggtcaaaagataaaatgaagagcaagctctcgcgattccattcctctagttttcttggttagaggacatcggagtagcgccgatggcgagtgtgagcggcggtggttttggggtgaaagtgcatgagcgcatggaagtcgatttcgaacgaaaaggatgcatgcatgtggtcttctagacttcaggatgctcaccgtgggtcgagctagggttgtcgaggtcttggcggcagcgacgacttgaggaacggctcggcgacggcgctcctcctcaggtgaacgacgacggctcgaacgggacaatgagctgcttcaagcaagcatgcacgagggttgtgaggtcaaggagatggtgtatgcgcaaggaatcgaacaatggctcaccgaggcagcggtaatcgacgatgacggcggaggcgatcctagatcggcgttgaggaagaaaaggatgtgttctccgtgttcttgatgtttccggctggggttcttgaggcgttttgaagaggaggttgaggcgatgacaatggcgcagcggttttctctgacgtggatgagaatggccggacgacgacgatggttgatagcggcggcgctccggtgcgtgctccagggcgttggcggtgtggcttgcgttcccggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccggcggcgaggttgaggatgacggagaggctgaggacctctccctcggcctcttcagctccagagtgatgtgtggagttgggcgactcggtctggaggagatggaggcatgactcagtgacttgaaggcgtcgacacgtcgtcaccacgcgtcgacgtgtccaggactcggtcggctctcgatctctccctctctgtgcttcttggtcggctgaggatgagggacagaggaagggcgaactggagaggctgccaggtggggccaagtcgatggaaactaggctagggagagagatatgggtagaagactgggtaaacttgatttttagattaattttcggaattattttctcctctaactttgtaactacataattcaatgtgtggaccaaattaattagtgttgattttactagaggtagatgattacacctagattccattttctttggttgcactcaaaaataatgggtggactgctcacagaaattaaacaaagatgggctattagaaagctagattaaatttttaggaggattaaacagagaaggaaaattctagaaaaattatatttattcacgataactaatctagtatttgaataaattatttcccatgttcacttatatgcagttaaatgtacttttggatgaaatatggttttagccgattaaaatttaatttgatttcttttagttgtctgcttcgaccgattaatttgagatatcaacttgagtgttaacacgttaccaaattacggaggataagtttgtgctcatcactgtccacataaatttttctatgattttatcttgcacaaaatattttagagaattaggatgacctttgtttgtataagtgttcccacttcataattgcatctaatattattatagggattacattaaatttcttttagactgagaagatgatatttgagtttaatattaagtccacatgttatcacccaagattaactataggtttgtttagtgaaataattcttttagattatgctcatgggacctattatggaatgcaagaccaaaactccaaatgcacaaagaactcgagcctaggcatgcaatatgtacatgtatgcttgatgacatttctagtctaatgttgggaatgaaaaggttttattttgttctcaaattttaatcatgcaatggtttaagttgatcatcacctaaattaaaacggaaatttttggctctcaaaattggagaaattaacctctaactattttgacaagaaattttaagtcctaaaatttcgggtaagttacaaaggagaatttaacaaaaattctccgggccacatttgaatttttcttgtacgtattttagtgtttgccaatttctttccgaattttaattaattctattatttcttttagcgaatgatttttaattcgggatgaatttatcaggacgtgacaaatccaccccccttacaagaatctcgtccccgagattcgaggaggctagcatgaagataggttgggcggtcttctcttcttgtctgacttcttccgctccgtcttctataacaaacttgcctaacaaaacttctccactctggactgcttggctcgatctcctgttgcagatggaatcttctcttcacccgacttgtccctggttgaacctttagctgacttcgactgggttgcggcacttgaagatggtgcttcagttccagaacttcgcatagtttatatttttggcgtcaacctcatagaagttacccatttcacgttatgcgtcgagatcagctcgtcattactaggataccatgcttgtcatcatgagaatatcatgcttgtcttttacttctaacttgccaccaactgcctcatattagctttcctgctctccgggtgctagctacttctgctattcgatgcaagggtcgataactttgcctttgaattatgtttcttaacagaaccaacttatcccccttgacatgctttgacgtcttcccaaatggctttactgctggacttcttattgtctgatcgtgatcctgccaaatctgaagcttcgttgttagatgtgattttaatctaacatctgtagattatcttcgaacatatcactcggttcataactgggaatagctctcacgaacaagcaactcggattcactttctttacatttggttcacttcctactattctcttcatgttgtcctcagttagcattcaacgtattcctttacaccttcaaccttgatgtgttctttcccgatttctcttatcaatcacctttcgacctacttctttgcccggtaataaacatctttttcgatatcttctatcaatcatcttttgacctttgtcaactaagtactcttcactccgagtgttgtggatgcttccggtgacgaggtggtacttgagcctgctgcctttcagagaaaccttcaagtggttcgtcaaaagctagactggcgattgttacctttgatccgaagaaggcacatctgaaactcttagtccaaacaaatgtctctttggttgatcacttgattttcttcgccatcaatcgctaggttatttgattcataacagattatgggtttacggaaatgagaccctaggtctccctaatcaacaacaaaatgtacacactcacagcacttgcaatcttaacatggatccttcataaacttatcaaactcattcattatctcatgtttctctattattacatgattgacggggaacaactataaaacaaaagtatttgaacactgatataagagtgttatggttgcttctgactagcgctaggcttaacaggtactgcatttgctccagtgaccacttggcgattggcatgtctgcttccttaacaggtactacagttgtaaataactttcttacgctcgggttcttcatcttgtacttgatttcttggctgctgtgctggaacatccaaaggtacaatgccgatactggcctctgtcttgtcaactgatggctggggctgaaattgagcattgacaccttgtggtaatgcactcgctggagttggagctgttgcaacgcgggctataggactgcttcgggatgcatggatgacaattcgctgaggagcaagcttctgattgtagggagttgcgtggactgacgtgctggcagctacgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttccttacaatgaacgcatgtagtggcacacgagctggcaacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgttttgtcaatcctggtggaggccattctgtgctggtaatgatcatcttacggacttcatcttcggttcgcattggtgtttttcttttctgctgaggacactcccttgcatagtgcccttgctcatcacacataaaacaaatgatacttgcttcttttgagtcaacatgtggcacgccaccatgggtctttcgggatgctggcggcatgctgacttgtggcgtgagtgcttggactgcctccaactgcacttgaggttgtatctgactcaggttcagaattggcgtctgatgctgctgtagtatctctataagcaatcggttctggttaatcaggtgttggaccagtgtcacacaactggtgtctggtgcttcattcactcgggagcttgaggtaccaatgtcctgacttctgaccttattgcctttctcattgtcagccatctgttgcaaaggtttggggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaccgaaacactagagggtagcttaggttctgcgacgggttctccaagatcttcactcctgcttcacagctggcttcactgcttccttcacttcgctagcggatcctgcagccttctggagcttcggcagacacttgacgacatcttcttcttcactgacctgaccatctagtactagttgaaatccgaataaggaagaagggagtaaaccttttgcaaatagcattaggggaaggagaaaaaaggaactttcgcaaatagttttatttataaaatatgtccttaggttttatccacttggcttatcctacagtcgagatggctctgataccatcttgtcgcgaccgagaaaattgccttttcccgaacgctagtgtattaatccccgtcctaggaaaagccggggtacaccaaacaaacatgatataaaaggcacatctttattatatcgacaatatttacattattacaaaggcacttcaggcctgacaatcaaaaataaacagcagcggactagcgggcctacggctccatcttcacaggcgctcaactggggtataagccaagactccacctaagacatcttctccgaagcttctcttactgaaggggggagaaagatagagcaagaatgagtacaaccacagtactcagcaagccacactggcagatgcatgattaatgcaagggggtacaaggggtaataatatcggggttaagttttgcagtaaacagcatttaaaagtcacttagttgcccaaagccattttataaagacgatcctagagctacacagtattagtaatcaaggccgtgaacccacacgaacctgccttaacccaaggcctacgatgattcagaccgaactggcaacccgaccttgggtcccagctcgtcccaagccaacccaggccaaccattccacattttagttattaagcaggttttaagaatttaaaacactaacttgggtacattgctaggcttgcccataaccgagggcgcggctattcgaataggttttactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccaacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaataatccaacaattccaaagtgtccaggtgatgagaaaattcccaaagtctagagttgtaaaaccacctaatgttgcctaattaatcagcgaagcatctacctaaaattatactagtggtactatgagtagagtgtccactagttggggttttgtttaatctagggtgaacaaggaaataataacaataacaataataaggtcataacaaaggtaaataggcatggctagataaaacagtgataacgcgggaatttaaataaagcgataatgcaataatttaaatcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggctcttgacttcttaaggaaaaattagagacttgaacggtccaattccgagttcaaatggccaagttatggccgtttgaagtttatatgctctttaaatggatatttgcgaatttcttcatttaaattttaatttaaaaactcatttattgcgtcagccgggagagagggcgcgcggaccgggtccacgggagtggggcccacgcggtagcctctcagtccacggtggaccgggtgcacgcggctgacgccggccggcgccgtgggtcccacgcgtcagccgcacccgcgggcgcgggcggctgacggccgggccccacctggcagccgcgggacgcgcccgaaggcggccttgccggcacggccgacgggaggcggcgcgcccgcgcccctatggtcgccggcggcggccataggcatggcggagcggcggccgagagagaggagagaagagggaagcgaagcggcggtcctcggctcaccccgggtcgacggcggtgacggaaacggcgaccgaagcggcgagaggcggcggcgcggttcggatcgacgaggacggcggcgctccgacggtcggcgggcgaaacggaggagtggacgaggtcgacgaggacgcggcgaagccgaaggaggtgatgccgagacgggaggaggtccggggcgacgacggcggcgaaccggagctcggcggcgacggcggagagagaggacgccggtgcgggcttgattcccacggggagagagagcggcgagcggcggaaacggagcacacaggctcggggagcgattatatagcgtcgggagggggagagagcgcccggagaggaaggaacccggcgcggcgatctcggctccattgatgccccggcgaagattgcgggagtaaatccgagcgaa

SEQ ID NO: 55609 - DNA, 14355 bp, Oryza sativa
  unsure (1)..(14355): unsure at all n locations
gcatcatcctgaagataagcatagggatcctcctcgacttcattgccatccactgattaaattttgtaatagcaagagtgagtaccaaccgtactcagcaagccatcataacaacagtgcatatgatagagatattcaaggtacggccattggtttatttgcataaagctaatttcacaattcttttcacaagcctattatctagtatagactagtccagttttaattccagtgtttattacacagcaacggttctgttcgccacccctttatcttcccaaagatggcttcccgttaccggccgtaatggttttctggggtttactccttttcttctctcgaggaggtgatccgccagaagaaaatcatcatgcatatcccatcctaatcaatttaagaatttagagtctagccaagtgtaatacatgtcccgatgctcaatatccgcgagcacggctattcgaatagattggttttactcacactgcagtggatgtacactttacccgtactccgcgacttgcccaacacatgagcctacgtcccaacgaatgagacttgccacggcaaagcctttcaataacctcacgttgacagtacccgctccatgaacttgcatcctcatgcactctaggcgttataagtttctaacagtgagaggagttctggcgctcccgggaagggaagactcacacatgcattaagttttagttaagtccagtttacacatggcagtcctaccgatggcgacaccattgtaggcactcgcccctcgcgaccccaccaatggctgccccaccgtaggccctgacccacacacactaagaataaccactatgcagggatactgccttcgcttggctgtgtactccgctaggtctatacccatacgagaagtacggttgtacgagggtcatttcatgcttaacttcatggctcggtgtcacgaccggaaataacccaacgggcgttcctgacgtgcgtgcattattccttgtcccaggaggcaaggtacaccaaaagttgatacaattcagagtttaacaagcggaagcgtaaatagttaacttattacatgggcagcgaaggcccagcacacacagagacaaacgagaaacagcggaagactagggcgatgaccacaggcgcttgacggcaggcacgagctagacaccaaagccttcatcttcaaggagctcctcttctgggcttgggaaaaaattgagcaagactgagtacaaccaccgtactcaacaagacacacccacaaatgcagaataaatgcaagggagtacaaaggaattatactataaagggttagggtttgcagtaaacagcatttaaagatatttagttgctcaaagctattttgtaaacacgattctagaactgtacaatattatttatcaaggccgtgaacccacacgaacctgccttaacccaaggcctacgatgattcagaccgaactggcaacccgaccctgggtcccagctcgtcccaagccaacccaggccaaccaatccacattttagctgttaagcaggttttaagaattaaaacactaacttgggtacattgctcggctcgcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgccctggagaatgtccatcgacccccgacttcgtccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccatagtatccagatgatatgaatatttcccaaggtctatagttgaaaaaccacctaatgttacctaattaaattgcgaagcatctacctaaaactaaactagtggtgccatgagtagagtgtccactagttgaggttttgtttattctagggtgaacaaggtaataataacaataacaataataataaggtcataacaaaggtaaataggcatggctaaataaaacagtgataacgcgggaatttaaataaagcgataatgcaataatttgaatcaacataattttataaactgggattcaatatgctcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacggtccacggtggaccaggtgcacccggctcacaccggccggcgccgtgggtcctatgcgtcagccgcacccgagggcgcgggcggctgacggccgggccccacatggcagccgcggggcgcgcccaaaggcggcctcgccggcacagccgacgggaggcggcgcacccgcgccccgatggtcgccgccggcgaccaccggcgcggcggagcggcgcccgagagaggcgagggaagggggaaatgaaacggcggtccacggctcaccccgggtcgacggcgacgacgggaacggcgaccggagcggaggaaagcggcggcgcggctcgggttgacgaggacggcggcgttccggcggtcggcgggcgaagcggaggagtggacgaggtcggcgaggacgcggcgaagctgaaggaggcgatgccgaagcgggaggaggtccggggcgacgacggcggcggaccggagctcggcggcgacggcggagagagagggcgacggcgcgagctcgattccgacggggagagagagcggcgagtggcggaaacggaggagggaggcacggggatggtttatatagggttgggagcgagagagggcggccggaggagaaggaaaccggcgcggcgctctcgggctccatcaatggcgccggcgagatttgcgggggcaaatccgcccgtttgaacgcgagagagagaggggaaaatggggggaaagggagagggaatcacggggagtgatttccccctctttattgcacgcgggggcggcgggatgcggcggaatccgcggcggcggcggcgctagggcacgggcgaggcggcgggagcggcgcgaggtaggggatgacgggtgggccccacccgtcagcgagggtggcgggcgggcccgcccgtcagcggcgcgcgcgcgggggaaggccggatgggccgcgggggagaggagagagagggagagggaggtggaccgagccggcccaagaaggggagggggggaaaaagggactttttagggtttttctttttataaactcattttaactttgtttatttcttcttaattattatttgtgctctgaaaattccactaaaatttatttacgcattttaggcttttaggaaatatacaaaaatcctccaagccttattcgacttttatatttgcacattttaattgttggaggctttcacacgaattttaattattctcggcacaatttcgaggatgtattttagagtcgttttgggacgcgacactcggtccttaactgaccagggacagcactagccttttccggacaccacccaagtaccctagccgccccggtcgaaaacagtgtttaattttgtttctcttttcacaattcatgttatccttgtcatggcaatgtggtgtccacgcctccacatgccgcatctcaactaccttccctaaggtagttgcccaagcatatagcacttgataaatatgagaatgcatgattctaattagcatgactaagcatttgttcaatatcgactaagtacacacgttagcacggtttgcaatggtcatatggataatcaatatcaaggcatggcatatttaacaagtagggcattcatattcacatatgtatagcatgcaattttatttaaatcaacataattttcgcaataggttcaacatgctcaaagattagtgatgacttgccttgatcgcagtcttgctgacccagatcttcgattaactcagcaactccttcggaatctaaatttacgtgcgaaagattgatttgaattcaattagaattcatattaaatcaccaaaaattcaacagtacaaaaataaatagcaaaagtggttccatcagaaagatcttgattttagatgaatttaggttcaagtttcattcaaatccgagctaaaatgaatgagttatgcttgtttaaagattcaaatttgaattaattcaaacaattgtgaaatggcactgtgcagccgagaggggcattattacagtggctgacatgtgggccatcccccaattttatttccggtttttttttattattattttttttaaaggaaatcctattgtgtcattgacaggtgggtccggccccctgttgactgaggtcaagccggccttttaatccccggtgcgacccgcatgtcattgagacatttacttaaaacctaatttaattagatttctaagcatccgggcctacatgtcataggttcataataatactattagtttggggattactgtgcgctaatgaaatggggtccacatgtcataacccctccctctctcgtgtcttctctctctcccgtcgtcttcaacctcgcgcgcgcggccgaacagaggagcagtgcgcggcggcgcgacggcccgagccggaacagctcggcgcacggcgaggcgagcggcggcgcatcaccggatgcccgccggtggcggcggcgaagcgcggcgaccgttcggcgcgcggcacgacggcgcgcgtcggcgccgagatcccaaactcggcggcggcacgatgaggaccaatgtgagcgcaaccggctacgattcaaccatctagggtccacatggagtatatataagcaaaatctagcctaggttgtattggaacgaagtccccccacggcgagctcaaccatggcgcagtggcggccggtgccggcacggttacggcggcgcacaccccaaatcgagggggccgggggtttctaggtgactaggcgggactactggcgcgagggcttaccacgaagtggcggaacggcgaagttcgacggcgagtggcgcggcgcggtccaaatagggacggacggcggtcggcgacgggcgcaggtgttcgacgctcgacctccctcgcgtaacggctcccggctccctccatagcagcaacgggaacgggcacacctncttaaacaccccgccacccacactggccgagaagccctgtggcggcggcgcagccggcgcccaccaggtgttcgacacccggcgacggcgtgatcctgcccctcttcggtggagcaaaagttttagagagaggaagagttaatggaatgttgagttcggataagaacgagccaaggacaagcctatataagcgagagggagagcgattccttaatggataagggtgatcgatgacgcggctctgtttcgattcctcctaggttcgattcaatgccctgggccggcatgattgcctacgcggtagtatgcaggagaggtctcgctagctggagaaaggggcaccgcattacccagcggtcgcaaccgggggtgacaagatggagacgcgacggggacgtgatggcgacaagagcgacggcgatgggcagtggtaacggcttggatagggggcgccgggctatgccctagggtgacgcgggcacccgtggtggccattatcactccatcccgagggcgacgcgcgaggggacgggatgacgcgggcacccgtggcggcgcagcctttggcgcgggcttttggccgcttggtcggcggcgggcccacacagcttggcatgacgcggtgcggcgcacgggcacgactagtgtggcgcacgagtcggaaggcaggcgcgtggcacggcagcgattggcgagggtggcgccgggtgttcggttgggttaggcacagatcgaacacctggcgcgcaatgaacagtagcgccaggaaaagaaaaaggaagagaagagaaaggataagggaaaaaggaagagctaaattgcaaaatggcttggaattgagttgtaactctacatattttgaattcaagaattcaaacatttgatttgaatatttatttatttattcatatatctaccaaatgattttacccatcacatatacttctaatttcctgatttattgaacctaagaattaaggattaatattattactcttgacctatattccttaatccctgattttataaattctaatctttgtttttcctataacctcatttttggtttatttcaccttaggtcattactaatattccattcgcattatgtttttcttattttgccatattctggattttattatttgacttccatctcaacatacacctcttatagtatttgaattaaacaatatatttgcaatatataaacgaataacaccagcatgatgcaaagtttttaaaaagttcgaatttttagtgatttttattattgaggatttttaggatgttacatctttctcatggggcactcgcgggtggatggtcttcctcacaatgaaagcaggtagtggcacacgagctagcaacatgaccgatttctccacaacgagagcatgccttatgttccattttattctggttgaaaccttggggagacttctcatcttcatcatctgaggagacttgatctgaatcttcactatcatacactctacctccactagctaaaagatgctctgtcaactgtggtgcacctcggaaggaatttcttctctgacgttttgtcattcctggtggaggccattctgtgctggtaatgatcatcttacggacttcatcttcggttcgcattggtgcttttcttttctgctgaggacagttccttgcatagtgcccttgttcatcacacataaaacaaatgattcttgcttcttttgagtcaacatgtgacatggcatgaggggccttctgggatgttggcggtgcgctgacttgtggtgtgagtgcttggactgcctccaactgcacttaaggttgcatctgactccggttcagaattggcgtccgatgctgctgtagtatctctataagcaatttgttctgcttaatcaagtgttggaccactgccacacaattggtgtctggtgcttcattcactcgggagcttgaggtacccatgtcctgacttctgaccttattgcctttctcattgtcagccatctgttgcaaggtttggagagggagagagggaaaacaaaggggagagacagatcaaaaactaaggataggaccttaacagatctaagtcttttgctgttatgatgtatgttaggcttattctgcaagttgattaagcaaacaacctagcatggttacatcacaccccactgatgcaaaccacgtgctacacacacaagcaaggaaacacacgactatcgaaaccctagagggtggcttaggttctacgacgggttctctaagatcttcactcctgcttcacatctagcttcactgcttccttcgcttcgctagcggaccctgcggtcttccggagcttcggcaaacaattggcgacatctttttcttcgcaaaactaaccatctagtactagttgaaaatctgaaggaggaagaagagaataaacattttgcaaatagcattagggaaaggaggaaaaaggaactttcgcaaatagtttcatttataaaatatgtccttaggttttatccacttggcttatcctacagtcgagatggctctgataccaccttgtcaccaccgagaaaatttgcattttcccgaacgctagtgtattaattcccgtcccaggaaaagccggggtacaccacacaaacatgatataaaagacacatctttattataaagataatatttacattattacaaaggcacctcaggcttgacaaacaaaaaaaaacagcagcggactagcgggcctacggctccatcttcacaggcgctcaactggggtataagccaggacaccacctaagacttcttctccaaagcttctcttactgaagtgggggaaagattgagcaagaatgagtacaaccaccgtactcagcaagccacatcggcagatgcatgattaatgcaaggggggtacaaggggataataataggggttaggttttgctgtaaacagcatttataagtcacttagttgcccaaatctattttgtaaacacgatccaagagctacacaatattattaatcaaggccgtgaacccacatgaacctgccttaacccaaggcctacgatgattcagactgaactggcaacccgacctgggtcccagctagtctcaagccaacccaggccaacctttccacattttagttattaagcaaattttaagaattaaaccactaacttgggtacattgctaggcttgcccatatctgagggctcggctattcgaatagatttactctgatcagaggtgtacatctttacccacaagacacatctttactccgcattccatgggcatggaacccgtcgtaaacatgtgacataacccttcacccatcctagccgtgtagtcttcatttgcctagacatctcgattaccgagccgcagctcgcgtagcctttatttggctcagagatatccatcgtcgcaacgacttcatccatctctatccatgtccttttgttcaggactagactgagcaccaagttaagccttacccattagacatgtggttagtacggtagtgctttgcaacagaggcccaaagaccggtccttatagtggccgaggtgctactagcaaaaccctgcacctcgagcccagcctaaaaccattttgggagttttgaatagaggggggaggtgtgtgttcaattccatcacaagccaaccattccacagtgtccaaatgatatgagcatccccaaagtctaaagttataaaaccacctaatgttgcctaattattcagcgagcatctacctaaattcatactagtggaaccatgaatagattacccactagttggggttttattttcctagggtgaacaaggtaataataaacaatagcaataataataaggtcataacaaaggtaaataggcatggccaaataaaacagtgataacacgggaatttaaataaagcgataatgcattaatttaaatcaaaataattttataaactaggattcaatatgctcaaggatgatgtgacttgccttgctcagagagaacggccttccgaacgctcggcgacgaccgcaaaccacgcttcgggaacctccggaacgacaaaagctacgcgaagcacacaagcaaagctacaagcctataaagaagcaataagaatacataaaaagaaagcacagggttcttaaggatataacaaacattaagagacttgaacgggtcgattcagagttcgtatgaccaagatatgatcatccgaagtttaatgctgttatatgaagatttacggattattgtgatttggtttcgcaattataaaacatgtgtaagtgctaacctggaaaagacaggaaggctgcgcttgttgacatgcagactccacatgtcaacctaagggaccacggtggaccgggtacacagagacggtccgcgggtcgacggaagcggaccccgtgtgtcaaccgaggcgagtagccgacaaacggactccaccagacaccacgcgggctgcacacgtagaaaccacgtggctatcgagcgggcacactaacatggtctccacacgcacaagcgaacgactaccgacaccggtacacgggtaccggggtcgacagccgcacaacgggtacggggcgacaccgaaaggacgaggacgagggcgacgagggagagatccttaccaccacgcgatgaggcgtgggaatgacaaagacgaacgagcgcggcggagacgactcggggacgacggaggcgaacggcgagggaacgacttcggcggcgatccttggacgaaggcgagacgcggccggcgcagggcttgacgacgcggaggcgaggacgaagacgacgacggggctgcagcggcacacttgacggacgcggacgacggacgagaacgacttgacggagggacgaacgccacgacgaccgggaacgacgagaggacgacaacgatgacgaccagggccggcgaggagacgatgatggcagctggcggcagctgcacagagctgaggccggcgtgggacacgccgcagcaatgcccacgacggcggcggcacaacgagacgaggagccggcgaggaggagcggccgaccgaagggacgtcggcgacgacgaggatggagaggaggcgatgccgaggacgatgtcaccagttcgccgctgcgatgccggaggtggtggtggcgcggccgacggcgcacgggtagaggaagggccaaccggggaaattccggcgaggtggatggagaggccggcacggcacggcggtgttccggcgaaaccgaggagtggccggggaaggagacgatgccgcggtatcgaaggaggagacgaaggcgtcgatcggcgtatcggtgatgaacaggagccggccggagacggtgtagtggtggcgacgccactgaacgccggcgagaacgcgcctccggtgctctccgcgctaaacggaggacggcccgggggagaggaggcggctgcgaggctgctggtggcgacggcgcgaccggatggcgctccggcgaggtgggagaggcggctggaggcggccggcggcacaggagagagaggaggacggcggggagaggtggtgaggccacgggagagcgcgggagggggctaaaatgatagaacggagtgagggggttccattgtataggatggtggagggagccgggcatgggagagggcggaacggcgacgggaaacacggccagcggccatggaaggcggccgggaatggcagggccgttccaggcgttagagggcacgaatcaagggggaaattgggggtaatcaaagaggaatcaatggggattaattccccctatttaattttggaatcccatgagtaaatcgcacggatttgagggaggaaaggagctagggttcacgggagagagaggaaggaggccgggcgggaggaggatgatgacccggcgcatgggacccacgcagggagtgcggtcagcgcgcgtgcggcgcgcgtgaggggtgtgcggctcgggaggctggggcggcttgggccggtaggcggcccaggcgggaggggaggaaaagggagtgggccgggaggggaaggggaggcccaagagaaggagggagagaaagagagggaggaagagaggacttgggccgcgggccgagggagagagaaagggaggactttgggccagacttggcccaaaggtggaaggaggattatttttaggtttttctttttaataaactttgataattgttgttgttgcttaataaatattttcggtgctctgaaaattcaagtaaaatttgagggctcattttagaccaaggagaatttaacaaaaattctccgggccacattcgaatttttcttgtacgtattttagtgtttgccaatttcttttcaaattttaattaattctattattccttttagaaaataatttttatttcgggatgaatttatcaggacgtgacaaatgtgccatttttggatgctatgcaagtaccaacatacgcccgttatctcaaggtcatactcaacaacaagagaccgctcccaacaacggaggtggtcaagctaacggaacactgcagcaacctgatactccacaagctccaggagaagaagaaagatccggggtgtcccacgatcacctgctcgatcggggcacaacaattcgtccatgccttgtgcgaccttggagctagtgtcagcgtcatgccaaaaaacgtctttgacaaactcaacttcatggtgttggcaccaacaccgatgtgcctccaactggctgattcatcagttcgttacccggcggggatagtggaggatgtgcctgttaagatacggaatttcttcatcccggttgattttgtggtgctagacatggacatggggaaggagacaccgctcatactggggcgtccgttccttagcaccgcaggagccaacagtgacgtgggaacggggagtgatacagtattaccataatacaaacggagatagagagattaatagttatagagatttacaaccgaggaacggaacaatgcttcatggtcagaatcaagtacaggccaaacccgcagaacattcaagaggtcgaagtggagcaacccaagacggatagcctggtaaggttcatgcagaacttcctgggaaaggaaacaacaatgcccaggaaccgttattggaggacgctagtaaaatcacctgtaccggccaagaagttagagcagccagctcagaggaagccgtcttctgcactaaaatacaaaggtgtggaaggaaaagccaaagacgcccgctccattacctccggagacgggtggaaaatccgtgaactgaatcgaaaggaggtatggtcttgcacgacggactttaaatgacgcgaccttcgccaacaggtaaattggtatgtatccgcatatttgttttcaacaatttgaatttttgcatcaccacatatttgaatttcaaaattgcttttaggacttttgaattttgaggaaattcttcaaatgaatttttcagagcaaaccaaaataaaattttcaacgaaaattcactgtgccacgatcacactgaccgttggattccaacggccgaaagtggggccggttgggcccactaggggttcgcccgaaccggccaggcaacggtcagctgcctcactttttgaggcaacggctagtgggttccacatgtcatttttgaccgttgtgggtatcctacaaaagccagccggccgagagagggaattctaccccatttcaactcattttcatttcctctccaaagtttgctcccaagttcattcatgctttgatagttttcctcaacttcaactctttagttgcatacatacaagttgctttggtgaaactaacaggcgggtgaaactcttgtcatttctaacccccgccgagttagcctgttcttgctccattgtgtagtatgaggaggcaactgtctcgtctgttcaaggggtcgggctctctatcaagtcgtcatgacgagtctagtactcgttcatcagccgatgcctcgatggaaaacgccgacgctccgcgacaactcctgagcgacactgacctcgaccttgtcagtgatcgggagagacaagcctactacatcctgagcgaccgggagtatgctcacacgcgagaatactcaccggagttgctgaaaaagataggtttggatgttgaatttcgttctatttggaaagctgttggttggcagagatttgctgtggtagatgagtctggttctcgtttgcttactttgcaatttctgtgcactttgaaagaaatagaagatggtatttcttttcgccttttccgtaaggagttcacgctcacatggaaaggcttgagtacacttcttgtttttcacgattcctttaaaatcgatctccagaaaggaatttcttggttcaagaaaaataggttttgggaagatatttcgggtgctccaatttgcaagaaacctagaacgaatgatatccataatcctgcacttaggctcatgcacaaatggattgctatgactttgtttcctagagtgatctgagacccattaggggagatgaattaattatcatgtttgccatggttagaaagatc

SEQ ID NO: 55610 - DNA, 2651 bp, Oryza sativa
ccgatggatgcagggttttgagggaacggtggagattcacaaccaatggcggttggagggtattaccgacctttccaaccgccataaccgtcattacctgcctatttaagaagctcactctcttcacttcaacacgcacctcaagcaagagctctctcattcctctcaagtttagtttagtattatctagctggtggaatagaattagaataggaatcaggagtccggaagccttcagaagagttcgggtttggctctagtagctttcctttcctcttttgtaagctttgtacttttattacaatactcttctaaatacattaatggtattggaatactttccgagtatataagtacctactttacattatgttcatgttatactgagtatactgctagcttatctgggagatgctttggtgcgggtatagtgtttgcttatgcaattactctatgtcatgacaatgatattagagtagtatctggtagtttagacgtggtgtctagattagaggatatcattatttggggttatatattgaagacgagaggtgggccactgatactgacagctcagtacgggtattcctcctcgcctatatataatcctaagttaatttcctggggagggtattcctccgtatttagccccggttggatggtcatgacaggctgtcgtaaggaactcggcagtcaagggtggcttctcaaagtactaggaggccatcggatagagggtattagctagtataccagttaactagaatgtatgtatactatgtatattagaggtataggaatagattctctttctctttttttccacctagcttagattaattattatgaggatgagtagtaatgcttatgtgtcaaactacccttggattatcttaacccctgcttagaatacgattatcacaagtaatatgtatgttattagttgagttctctctacatgatctttccacgggataaaataaatacgataccctttgaatactctcgtgtgaaataatacaatggtatatccgtgctcttgtggatgaactctgtaaccataatataccagaagtattgatgcgtcattgctgtgaattatatttctagtaatgtccttacgaaataccaacagtaataattttaatattatcgatataataaagatgtgtctttttatcatgtttgtgtggtgtaccccggcttatcctgtgacggggattaatacactagtgttctggaaaagctatttttccggatgcgacaaagagaaagccaagttagatatgctctctgccgggccaattcagccgaacatagatcggcttgaagcccgcaagattgatctcatagctcaacttgaagaatgtaatgccgaactagatctggacaagcaaaagttagccaatcttccaaatgctgtcgaagaacagaaatccagactgaaattggctatcaagaatgtagctgatatgatcaagtacctcaaggtcatttctggaaccgatgctcaagatatccaagctatcgaagaagtagatcaaatcaggcaacgggctgtgtcggctatccaacgctacttgtctggataattaccctgtgtaataggacttagcaaattttgtaatcggctcagaaaccttgatactccttttgtcactgaactgttgtgccgattaatataacttctcaagttgctcaaaaatttgcaacttttgtatatatgtgcccccctaattttgcaatgatgaaggcattgataaaattataatttggactaagggcgatataaccatatcggccattgtacatcggcaaaacacaaccgattacaacaagaaaacaactaagggctatataaccatatcggccattgtacatcggcaaaacacaaccgattacaacaagaaaataactaagggcgatataactatatcggccatctcaaggcgatgtaaacacatcggctatcatgtatcggcaacatccagccgatcgtgcattaacctaaacactggggtaatatttcttcaagtacttgccattgagcgctcgtccataaacttctccatcaagtccttgcaacatataagctcccttggacacaaccttatggatttggaacggtccttcccaatttggtgaccacttgccgaatttattatcacgagtccctatcggcaaaatcaatttccaaaaaagttcaccttcagaaaaagactagggcaccacttttttgttgtaacgtcgagcaacgcattccttatccttggtaacttttacaagagctctcaacgtagattgaactaagtcttccctttcatcggccatgagattataatattcatcggctgtcaactcattttgcaactctgttctccttgggtgtcacaccctgaaaaatcgctaaattataaatcattgtgaaaaagaaatttttagaaattacttaataattaaagcaagtgtgtgaataaaatctatgaaaattttgaacattaagttgatatagataaaattgtattaaatatttttaatgtccaagtattttaaggatttttcccagaattatttgagcattggaagtatttttaataaatgaaagatcattcagtgattaatttaattggaaaagaattaataattctttc

SEQ ID NO: 55611 - DNA, 793 bp, Oryza sativa
gaacgggtcgattcgaagctcgtatgaccaagatatgatcatccgaagtttaatgctgtatatggagattggcggattattataattgagctttgcaactataaaacaggtgtaagcgctagcctggaaaagacaggaaggctgcgccgttgacatgcggaccccacatgtcaacaaaaaggaccgcggtagaccgagtacacagagacggtccaagggtcgatggaagcggatcccgtgtgtcaaccgaggcgagtggccgacaaacggactccactagacaccacacgggttacacacgtggaaaccacgtggctaccgagcgggcacactaacacggtcaccacacgcacacatggacgactactgacaccggtgcacgggtaccggggccgacaaccgcacaacgagcacgggcgacgccgaaaggacgaggacggggcagcgagaggacggatccttaccaccacgcgacgagtcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgacgacggctacagcgaccttgatgaaacaccgaggacggacgagaacggctcggcggagggacgaacgccacgacgaccgggagcgacgagaggacgacgacgacgacgaccggggccggcgaggaggcgacgagggcagccggcagcggctgcacggaggcga

SEQ ID NO: 55612 - DNA, 784 bp, Oryza sativa
gcaccgcatctgtctcccccacctttcctttctaggcaacccctcctcccgtatcgttttcctccctccccatcttttttctgtttttttttcagccgcccctagcctcctcctcctcctgtttagccgcctcctccaacaccctagccgccgctgccgctagccgtcacccttcgccgtcgtcgtcttggtcgtcgctgtcatcttatccggtgagctttcctctctcccatgtcatttaccggtgtagtttatccctagggatttaatctaatctaatctaatctaatctgttgtttggccctagcgtcgtcatcgtatccgtgtgttgtcgccggatcgtcatcgtcgaccctccctctcctgtccctttggtttggtgagatttctattcgtgtcccctcgggttaggtttagatccctcggtcgtgtcaccgccgctgttgctctaaccctagcgcagctgttgccgtgtcgcttgccggctgtcctgtgcaccgccgctgtgctagctgccttgttgccgctgcgtcgctatttagtcgctgtacgtcgccgtcgcgctgctgctgtaggtgtgccaccgcaaccgctgttgtgccgctaccgtgtgtcaatccaagccatccgatcttggtcgactcggtcgagattaatctcagccgtccaaaagcgatataaatccgttctctcttttcaatggcatattattcctttttaatatatgtcatctaccaaatatgatctaatctatttcccgttttaatcttttgtctcagctata

SEQ ID NO: 55613 - DNA, 1495 bp, Oryza sativa
cccattgctccttgcaaaagcttttctcatcctcccttccccgtctttcaacttgctttagatgaatcccttcaaggagaggttggaaaagatgatggcacactttgatgaaatttggggtgatctgcagacaaagattgatcagattaatgagaggagagaagctctggaaagcaaggcattattctaaaggaagctgagaaatatgggaacgatggttttacaagtgagctttgtcgtatgacgtatgatcttggatatgaggttccaccaatgtacactaaagtatctacttatgttggagaccaattgcattgaaagacaactgttactctcgtttctgacaaggaagatcttctccaactatcatttactagtgaggccgattgtttcttctatgctcgtgaaggagttgtttacgaagctttgtgtcgtctccggcatcatctcaaggatcgtctggggaatactatatatcactaccatctaaaacatggtgatgatttttggatgatttgtgcacatagtcgaggagaagagaatcaaactatggtacctatgactacaaggttggatgcactttatgacctccacattgattacaagactcaagccttaaatcagaagcatgcccaacaggagaaaattgccaagctatagaagatggttgaacaaatggaagatatgtctcaacctgaagatagtgacaccgccaagatgttgaaatatacagaagctcgctttgcccggtatcgcaaaggcaccaatcgtaagctcgttcttcgccagaagagaatcttcgaattagaagatgcactatggaagttgaaaggagaaccttaatcggaaagacgattatgaagatgtgaagcctattcatgttgtcaagcatctctgcactagaattatttttctcatggaaggtcgattcccgtgaagatgagtcacttgagaagcccaagttcaaatgtaaaatgaagaagtcttaaagcacctatggcagaacctaagctttaccctcaagagtagtggtctcttgtttagttagatcgttgtgttagcttgcttgcttaagttttgtttgtgtgtgtgtgggttttagcgtatggagtatatcgagggttgtgatataaccatactagtttcagtgttcagttcagtgttaaagaacaacctacctcacatcaataaaagttaaagtttagtaaaaaaaaaagtctattctattctgagtctcctatctactttcttaacccttcctttctctctcttacctcctacctaagagaatggatttaaggaaaggaagttttgtgctcattagtgccagtggttttaacaagttaacagctaaggaacaatgtgtctggatctccaaataaaattcatcctgaagctaatgtggacaacacagtctgtcatccaaggaaagtaaaaagtcagaagctcaagggataccattgaaaaaaaaatcaagagaagggctgcaggaatt

SEQ ID NO: 55614 - DNA, 2435 bp, Oryza sativa
ttaattcatggccgaagatgactttattttcctatgggttataatttgactagcatggaccttatatattggattggttcagctagatgttatttatagttgcttagccatgcttagaaacaatagctcattaatgggatgaatcatactacattattatttatggttatatttaatggtagctcacgatattcagtcatgttatgataattaattggtaattaaaatatgattaatggtgggttgtgagcacatggttttgaaggtcgcgctcatgacaattaagaaccggttcgcgagctattgttgtgagacattaaccgtaccaaccacaagccagcgtgggcaacggctttatcttttgtatagcatgattcattatggtgtgccagactgagaagtggtgagaagtccgtgggggtcgctggggagtccattgcctctggttttgagggggaggttatgatccaggaatggtgcactgtggtgagttgtgttgtgcgaagggtattgtcacgatttcccccttagcagtgccgtggtggtacttcggggcatggcaacatgtgtggaatcgtgtcttctgggtacaatggtacatctctggccagagtaaaactattcgaatagccgtgcccacggttatgggcgagtctaacaatgtttttcgtgattagtcccacactactcattaatgttaataatgtgatgattaatttgactcctggtttggaatggataattcctggtttggaggtttgatctgtacgatcggggttggttgttcaggtttggttgggcctgtgcagcatgggtgtgctgttcagtgttgattaatattgatgattaattgctctactgttttacaaattctcaactctttgctaaatgctgctttcgcaaatgagcctatattatgccatcctttggtatccttgtgcacttgcatacttgctgtgtagcttgttgagtatgtcatatgctcattcttgcaataatcatcaaacctcagttgaagaaaaggatccagaagtagaagacctttggcttagaacccagttgagctgcctgtgggagtggagctgaagcttcgctagattttattttccgctgcagatttcttcatggtgaggactaagtgcctcttatgcaagtatttatcgttttagttattttgatgaatctgtatattaaattgtcagtttgtgttcctcggctgattcctggacgagggttttaatgcacaaattagttcagaaatttcttgcgaatttctaggcgtgacattgggccgattctgacttcctatggtaaaactgcctcatgtccataaagcttatagagaggaacttggatcgaaccatgacaagccatccgataggaccacaatgctttggccaacctagtgtgtcattgccgaggataatcagagatctttctcttaatgaacttaatcaaactcttattagatgcctcggcttgcccattagcttgtgcataatatggcgaagaattcaacaatttaatacccatgctatcggcaaactgaacaaactcatcggacacaaaaatcgagcctcgattggttgtaatggtctgaggaataccaaatcgataaataatatgcttttgaacaaattgtatagcatcccctgaatcaactttcttcaaaggaatcgcttctacccagttggtaaagtaatcggttgccaccaatataaacttgtgtcccttgctcgatggtggattaatcattccgatcatatcaattccccaacctctgaatggccacggtttgatgatatgattcataaccgatgctggcgctctttgaatcgctccaaacttctgacaatcttaacatcccttgtaatatcggaagcaatcttccaacattgtcggccaaaaatatcctacccgccgaagcaaccacttcatcttataagccgattcatgagtgccacatataccacgcctatcgcaaccttggcttgataggcactcaaacatttaagcaataccccatcaatcgtccgataatacaattcatcatccaacaaggtgtatttcaaagctttatagcgcaattttcgtgaagccatgcattattttcgaatgtcatcgggtggtgagcctttcccagataattaatggccgaagatgactttattttcctatgggttacaatttgattagcttggaccttatatattggattggttcagctaaatgctataagtatagttgcttagccatgcttagaaacattagctaattaatgggatggatcatatatactacattattatttatggttatatttaatggtagctcacgatggttaatcgtgtaaagttaattaattgataattaaaacatggttaaaggtggggttgtgagcatatggttttgatggttgggctcatgacaattaa

SEQ ID NO: 55615 - DNA, 6541 bp, Oryza sativa
ttttgctttaaattaatgcattatcgctttatttaaattcctgtgttatcactgttttatttagccatgcctatttacctttgttatgaccttattattattgctattgtttattattaccttgttcaccctaggaaaataaaaccccaactagtgggtaatctattcatggttccactagtatgaatttaggtagatgctcgcaaaataattaggcaacattaggtggttttattactttagactttggggatgctcatatcatttggacactgtggaatggttggcttgtgatggaattgaacacacacctcccccctctattcaaaactcccaaaatggttttaggctgggctcgaggtgcagggttttgctagtagcacctcggccactataaggaccggtcttcgggcctctgttgcaaagcactaccatactaaccacatgtctaatgggtaaggcttaactcggtgctcagtctagtctggaacaaaaggacacggatagagatggatgaagtcgttgcgacaatggatatctatgaggcaaatgaaggctacgcgagctgcggctcggtaatcgagatgtctaggcaaatgaagactacacgggtcggtgcccgttagtcgagatgccatggcactggactagtacgcgggtggtctcaccgctatgtgtgtggcgcacccggtctagatcttgttgctaggggctcaatcctggcctgcctgtcccgggataccggccataggtagggttgggtcggtacttttgttcacggctaggatgggtgaagggttatgtcacatgtttacgacgggttccaaggccatggaatgcggagtaaagatgtgtcttgtgggtaaagatgtacacctttgatcagagtaaatctattcgaattgctgagccctcggatatgggcaagcctagcaatgtacccaagttagtggtttaattcttaaaatttgcttaacaactaaaatgtggaaaggttggcctgggttggcttgggacaagctgggacccaggtcgggttgccagttcggtctgaatcatcgtaggccttgggttaaggcaggttcgtgtgggttcacggccttgattaataatattgtgtagctcttggatcgtgtttacaaaatagctttgggcaactaagtgacttataaatgctgtttacagcaaaacctaacccctattattatccccttgtaccccccttgcattaatcatgcatctgccgatgtggcttgctgagtacggtggttgtactcattcttgctcaatctttcccccacttcagtaagagaagctttggagaagaagtcttaggtggtgtcctggcttataccccagttgagcgcctgtgaagatggagccgtaggcccgctagtccgctgctgtttttttttgtttgtcaagcctgaggtgcctttgtaataatgtaaatattatctttataataaagatgtgtcttttatatcatgtttgtgtggtgtaccccggcttttcctgggacggggattaatacactagcgttcgggaaaatgcaaattttctcggtcgcgacaacattgatgtgaatcttttggattacttcaacaaaacgagtcaatagatggcgcttcttttgacatcccattagttcctacaggcttaggatatggcagatcacgagtggacttacctcccctcgttgtgatcgccttaacattttcaatggaggagtcgggttgccccggaatcctcccagattcatttgtagggactaaagatgccaacggagctaactgggtttcgatcatcttattaaagctcagctagttttgaaatgcggaagcaaagccatctagcttaacatttatgttctctaagatcttatcattggcagcaagctttttgcttagtgcatcagtggtttagcttgcacaaaaagaagatccttcaaggagggttggttaaagaagttactgttattattacctccttgataatatgggcgtggttggttccactcctgacctccttgtggacgatacccattgttgttgttgcccatgtacatcgcctcctcacggatttccgggcagtcgttcccagaatgacccgtgccgccgcagacttcacacgtgatgtgagagtccaaggccttgacggtgccttgtggccgtttctcatggtcgtccaatcatttcatgaggaggtccagcttggcagcaagtaactctgtctccttaacggtgtgcatgcttcgctgacgggtctggagtcgttcctcgctccaacccatattggagaccatcttctctatgagttcaacggctccttgaaccgttttagagaagaaggctcatccagatgccgcgtccaggtgatcgcgggacatcagggtgagcccattgtaaaagttctgtaggatcagacagtcatccatcccatgatgaggacgggctagcctgcgccatcgtgatgaggctggacttcaaatcgaaatccacatctcctatgttgacttgtggcccgatggccacattgtcagcagagggagcagcgaactcgcgaagagtcttggtggcgctggtacggctggtttctctgtcggtaaagttttctgcgaagcaatgactcgcggcctgatgctccggaagaaaacttatggattttctttgaagttttccggcaggttggaaccagtcatgcactaccaacggaaaggaaaatgattatacagaggaaaatgcactaccagttattttcacaagaaagagtgaaaacaaccaagataagcctgcaaaggaaaatgattatacagaggtaaatataaagtattagttcaagtaatctctatcatgaatcttccccggcaacggcgctagaaatgcttgctggtatttcttaacgacattactagaaatataatttccagtaatgacgcagaaatacttctggtatattatggttatagagttcatctgcaagcgcacggatataccattgtagcacttcatccgagagtattcaaagggtatcgtatttattttatcccatgggaagatcacgtagagagaactcaactaataacttatatattacttgtgataatcgtattataagcaggggttaagataatccaagggtagagtgacacacaagcattactactcatgctcataataattaatctaagctaggtggaaagaaaagagaaagagaatctattcctatacctctaatatacatagtatacatacattctagttaactggtatactagctaataccctctatccgatgccctcctggtacttcaagaagccacccctgactgccgagttccttacgacagcccgtcatgaccatccaaccggagctaaatacggaggaataccctcccatggaaattaacttaggattatatataggcgcggaggaatacccttactgagctgtcaccatcagcggccaacctctcatccgcaatatataaccccaaataatgatatcccgtaatctagacaccacgtctaaactactagatactactctaatatcattgtcatgacatagagtaattgcataagcaaacactatacccgcaccaaagcatctcccagataagctagcagtatactcagtataacatgaacataatgtaaagtaggtactcatatacttggaaagtattccaataccataaatgtatttagaagagttttctaataaaagtacaaagcttacaaaagaggaaagggaagctactagagccatacccaaactcttctaaaggctttcggactcctgattcctattctaattctattccaccagctagatactactaaactaaacttgagaggaatgagagagctcttgcttgaggtgtgtgttgaagtgaagagagtgagcttcttaaataggcaggtaatgacggttatggcggttggaaaggtcggtaatacccttcaaccgccataggttgtgaatctccaccgttccctcaaaaccctgcatccatcggcttcacgggaggtttggccgaaccaccaggttcggccgaacctggggccagcccaaccagcccacattttcgctggtggcctcctctgctgctttactttgtagacttgtgaattttggtctgattcgtcgtgtcaattctgagttcttggcccattcatacataagtctggacttcgacatcgttcgattgatttatcatttaagttgatgtcgattctccttcattttattgtcattctctgcaaaaggttagtaaacccaatactagtggaatattattattctaacatatttatgcattgcaagcatcactagttctcctctattttggtaatattgacggtcgaaactaatcaataacgaccgtcaacaattacaaaggcgcttcaggcctgacaatcaaaaataaaaagcatcggactagcgggtctacggctccatcttcacaggcgctcaactggggtataagccaggactctacctaggacttcttctccaaagcttctcttactgaagggggggaaagatagagcaagaatgagtacaaccacagtactcagcaagtcacaccggaagatgcatgattaatgcaagggggtacaaggagtgataatatagtgttaggttttgcagtaaaacactatattattaatcaaggccgtgaacccacacgaacctgtcttaacccaaggcctacgatgattcagaccgaactggcaatccgacctgggtcccagctcatcccaagccaacccaggccaaccattctacattttagttgttaagcaagttttaagaattaaaccactaacttgggtacattgataggcttgcccataaccgagggcgcggctattcgaatagatttactctaatcagaggtgtacatctttacccacaagacacatctttactccgcattccatggccttggaacccgtcgtaaacatgtgacataacccttcacccatcctagtcgtgaacaaaagtactgacccaaccctgcctacagccggtatcccggacaggcaggccaggattgagcccctagcaacaggatctagaccaggtgcgccacacacataggggtgagaccacccgcgtactagtcctgtgccatggcatctcaactaatggacaccggcccatgtagccttcatttgcctagacatctcaattaccgagacgcagttcgtgtagccttcatttgcctcagagatatccatcgtcgcaacgacttcaaccatctctatccgtgtccttttgttcaggactagactgagcatcgagttaagccttacccattagacatgtggttagtacggtagtgctttgcaacagaggcccgagcttaatccttgtattggccggggtactacttcccacaactgacatgcacccaaaccccaccggaaaataggttttaggggttttgaaagaggaagagaggtgtgtgtccaattccaccaaaagccaaccattccatagtgtccaaatgctatgagaactcccaaagtctattgttataaaaccatctagtgttgcctaattaatcagcgaagtatctacctaaattcatactaatggaaccattaatagattacccactagttgcggtatcattttcctagggtgaacaaggtaataataaacaataacaatgaaaagactataacaaggattaataggaagtgctaaataaaacagtgataacgtgggaacttaaataaagcggtaatacaataatttaaatcaaaatagttttacaaactaggattcaatatgctcaagggtgatgcgatttgccttgctcagatagaacagccttgcgaaccttcggcgacgactgcgaaccacgcttcgggaacctccggaacgaccaaagctacgcgaagcacacaagtaaagctacaagcctataaagaagcaataacaatacataaaaagaaagcacatggttctttaggttataacaaacattaagagacttgaacgggtcgattcagagttcgtatgaccaagatctggtcatccgaagtttaatgctgttatatgaagatttgtggattattataattaggttttgcaattataaaacatgtgtaagcgctagcctggaaaagacaggaaggctacgctgttgacaagcgtaccccacacgtcaacctaaaggaccacggtataccgagtacacagagacagtccacaggtcgacagaaacagaccccgtgtgtcaaccgaggtgagtggccgacaaacggactccactagacaccacgcgggcttcacatgtggaaaccacacagctaccgagcgggcacactaacatggtcaccacacgcacatgcgaacgactaccgacaccgatacacgggtaccggggtcgacaatcgcacaacgggcacgggcgacactgaaaggacgaggacgggggcagcgagaggacggatccttaccaccacgcgacgaggcatgggaacaacgacgatgaacgggcacggcggtggcggcttgggga

SEQ ID NO: 55616 - DNA, 1053 bp, Oryza sativa
cgtcgcgtggtggtaaggatcagtcctctcgcttcccccgccctcgtccttccggtgtcgccccgtacccgttgtgcggtcgtcgaccccggtacccgtgtaccggtgtcggtagtcgttcacgtgtgcgggtggtgaccgggtagtgtccgtgttagtgtgcccgctcggtagccgcgtggtttccacgggtgcaggccgtgtggtgtctagtggagtccgtttgtcggccactcgcctcggttgacacacgggttccgcttccgtcgacccgtggaccgtctctgtgtactcggtctaccgtggtcctttaggttgacatgtggggtccgcatgtcaacggcgcagccctcctgtcttttccaggctagcgcttacacctgttttatagttgcaaagcttaattataataattcgcaaatctccatataacagcattaaacttcggatgatcatatcctggtcatacgagctccgaatcgacccgttcaagtctcttaatgtttgttataacctaaagaaccctgtgctttgtttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgaacatattgaatcccagtttataaaattatgttgatttaaattattgcattatcgctttatttaaattcccgcgttatcactgttttatttagccatgcctatctacctttgttatgaccttattattattgttattattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatcccc

SEQ ID NO: 55617 - DNA, 7333 bp, Oryza sativa
  unsure (1)..(7333): unsure at all n locations
tgaatttatcaggacgtgacaacctatgtcaatttcttccaaatcatcagccgacacaaaaccctgtccttgcttgtcatcgagatcatctaatgtgtccttagtgtagacattcgaaccctccacgacgccctcaaaataatagcttgggttctccatcttcaattggctgtatctcagaatcggacacttttagaaaatctccatcccaaacttttccagataaacaatctagaccatccatctcccaaagagctaaatcggcactggcaacattgactgacctgtcggctggcacaatttcaatcttgtcgtcttgccactgaatcaagcattgatgcatagttgaaggaatacaataattggcatgaatccaatcccttccgagcaacaagctgtaagaacccttcccatcgatgacaaagaacgttgtagggatggttttgttgctgactgtcagctccacattcaaaacccctttggtttctgatggattgccgccaaagtccatgagcaccatgtttgtcttgatgagatctttggcatttctgcccagtttcctgaacgtggtgtaaggcatcaagtttactgcagccccaccatcgaccatcatcttggacatcggcttcccattaacgtaaccatctatatacaatggcttaagatgccgatgctctgtaccctctggcttctcgaaaactgcctgctccggtgataaaatcaacttagccgattcgtcttcaattttatcgacatcggcttgtttgatcccaatttcaacaggcaatgtgaaaaccatgtaaccgaagcagttaccacacttttccacttagccaaccttcttgcttcatcatccgtggcttcatcagctacaggcacttgattcttaacacgccactcctgcctcggctttgttttctttagccgatgattgatttcctgctcgacttcctgaaagcgctccctgttcctcaatatttgaacccttctcttctgattctttgtaaagataccagaaggacaccattgagttttcctgttttcattgtcctcctggccacgaccttggtttactggacccaatctttgatgaacaggaaccattgtctgccttagccgattgcccctgctatacaatcggcttgagctctccgcaatatcactgcacccaggacagtcctcaatagatggcagccttataccttcattccaataaaatctaaagaactcgcaaccccaatgaggatcaaagccatcaccaccttcctcataatgcttctcctgctgtttgtcatacttcctctgatatttgttgataatcttagccgaatttacctgaaaccctcttgcacgacctccatcggctgtccagccagctgtatgtaccatattgacaggaaaaggattgccatcaaccttcatcggcctcttagaatcatcaaacttgattttgcctccttcaatagccgcttggactgctgcctgaagaccttgcaatcattagtagtatgagacccagaattatgccacttgcaataccttttcttgcccaattctttagccgatggaattgtgtgaccagcgggaagttgaatctgcttttctcggagtagcaagtcaaaaatcttgtcagccttggtgatatcaaagtcatacctctcctcttttctagaattcttcacccattggtatggtataacctttttgctccttacccattcgagtgcagctatcttagaatcatcatccccatcatccgatccatatatatatacatatatatatataaggacaaacatgattaacctttctagaattcttcctagcctctgcaaacctctgttcatgcaaggttaccttctgtgtaagatgtgacaagctttcgaagtcttcagatgagaatttctccctgattggagcaatcataccctgaaaagccaaatcgactaactgggcatcagtcaaacttaagctgtagcacttattcctcatttctctgaacctctgaatatactcatgcacaggctcatcatgtctctgcttgattgctgtcaaatcagacagtttcatctcatgtaccccactgtagaaatagctgtgaaaatgcttctccaaatcggcccaactgttaatcgacccatatggcaaagaagaaaaccaagtgaaagccgatccagacaaagacaaccagaacaacataaccctcaaggcatccatagccgatgcttcaccacactgagataaaaatcggctaacatgttcataagttgatgtgctatcttgccctgagaattttgaaaaatctggaactttgaaccgattaggtagaggaactctctcaaaccattcagggtaaggttgtcagtacaaatttctagcaactttcggcctaagcccaaactgctccttcatgacatccgcaattgtcacgtcccaaaacgaccctaaaatatatcctttaaattatgcccagaataaataaaatccttgtgaaagcctccaaaaattaaaatatgcaaagttaaaagtcaaataaggcttggagaatttttgtatatttcctaaaagcctaaaatgtgtaaataaattttagtggaattttcagagcacaaataataattattaagaaataaacaaagttaaaaaggttttataaaaagaaaaaccctaaaaacccctctcccctctaatgggccggctgagcccatctccctcccctctctctcctctcccccgcggctcattcggcctctccccgcgcgcgcaccgctgacgggcgggcccgcccgccaccctcgctgacgggtggggcccacccgtcatccccgacctcccgccgctcccgccgccccgcccgtgccaagcgccaccgccgccgccgaatctgccgcatcccgccgtccccgcgcgcaattaagtggggggaattattccccgtgatcccctccctctttcctccctatttttccctctctctctctcgcattcaaatggccggatttgctcccgcaaatctcgccggcgccattgatggcggccgcacctcccacgccggtttccttccccgccggccgccctctctcccttccaaccctatttaaaccctccccgcaactctctcgcccgtttccgccacttgccgcaccttctccccgccggaaacgagctcgcgccgtcgccctctctctcctccgtcgccgacgacctccggccggccctctccgctcaccgggaccatctcccgcctcggcatcgccttctccggcttcgccgcaccgccgccgaccccgtccaccacctcgccgagctcgccgaccgccggaacgccgtcgtccccatccacccgagccgcgccgccggctttctccggttcgggcggcttctttgtcatccccgtcgacccggggtgagccgtggaccaccgcctcttttcccccttcccttcccctctctcggccgccgctatcccgtgcctatggccgccgccggcgaccataggggcgcgggcgccgcctccgggcgccccgtgtgcccccccagtggggcccgaccgtcacccgcccgcgccctagggtgcggctcacgcgcggggcccacggccccgcccggtgtgagcccgggtacgcccggtccaccgtggaccgtgatgctgccgcgtgggccccactcccgtggacccggtccgcgcgccctcacacctcggctgacgcaataaaccctttttaaattaaaatttaaatgcagaaattcgtaaatattcatttaaagagcagataaacttcaattggccataacttggccatttgaactcggaattggaccgttcaagtctctaatttttccttaagaagtcaagaacctatttgtgtgctttgttcttgcttgttatatggagtttattagagtaaaagccttttttcctttccgttggtcgtgtagacgctgcagcttcagaagatccgctccacgtggaggttgaagccgatgtttgggaaagcgagcaaggcaagtcacatcatctttgaacatattggatcccagtttgtgaaattattttgatttaaattaatgcattaccgctttatttaaattcccgcgttatcactattttatttagccatgcctatttgcctttgttatgaccttattattattgttattgtgattattaccttgttcaccctagaataaacaaaaccccaactagtgggtactctattcatggtaccactagtatgaatttaggtagatgcttcgctgtttaattaggcaacattaggtggttttataactctagactttgggaatattcatatcacttggacattatggaatggttggattattgtggaattggatgcacaccttcccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtcgatggacatctctaggacaaatgaaggctacacgggctgcggcccggtagtcgagatgtcatggcacagggatggtgtcctgctgctaggggctcagtcctgcctacctgtcctagaggtttcggccgtaggtggggttgggtcggtactcttgtctatggctaggatgggttggaaactatgtcacgtcttccgtccatatgccgtggtggtatgtggcacgtggttgcacgtgaggaagacgtgtcttgtgggtaaagatgtacacctctgatcagagtacaatcaattcgaatagccgagccctcggttatgggcaaggctagcaatttacccaagttagtgttttaaattcttaaaaacctgcttaataactaaaatgtggaacggttggcctgggttggcttgggacgagctgggacccagggtcgggttgcaagttcggtctgaatcatcgtaggccttgggttaaggcaggttcgtgtgggttcacggccttgtttaaaanccacgccatgttctaggatcgtgttttaaaagcagctttaagcaactaagtgtcttttaaaagctgtttagtgcaaacccaaaccccctatattataactcctttgtactcctttgcatttattctgcacttgtgggtgtgtcttgttgagtatggtggttgtacttagtcttgctcaatttttcccaaactcagatgaggagctcctagatgatgaaggctttggtgtctagctcgtgcctgctgtcaagcgcctgtggtcgtcgccctagtcatccgttgtttttcgttgtcttcttgtgtgctggtccttcgttgcccatgtaataattaactatttacgcttccgcttgttaaactctaaattgtatcaacttttggtgttccttgcctcctgggacaaggaataatacacgcacgcaaggaacgcctgttgggttatttccagtcgtgacagcaatcaactcggcccatggttgttgctaaggtgctccttgaggttgctgtggcatgggctcaaattgattgtattgaggaacaaactggggttgagccgatcctgcctgctggtattgaacttgcggtgatggcggctgttactgataattcaaattgcccccctggtaattttgaagatcctgctgaatattgcgcaccaaatgcttgggaataacttgaggtatcaccgtgccatctagttgtacatgatgaaccaaatgctccgggacaacttgatttgcagcatgctgcacaggctgaccaccaggtgtcgcaaacctagccgatgcattcattaagccttgttgctggatccgctggacaacctgctgccttagtggcgtctattgaattggctgcaaaacctgccgtctgtgtggcatatgctgagctggttgcacaacctgttggattgggggtgtttgttgaatcggttgcacaacctgctgccttggcgttgtttgctgaatcggctgctgctgggttggatcaacggtatgttgaggaggtaagaacatagatgcaacctagtcttgtgttagccgattcacgttctgtccgctgtgttgtggttattctctcaccagcaaacggggattaaccaattggcctggtgccgacggagctgcaggaggtgcgggagccgatactggtgccgtcagctgagccgatggtgcattgtgagggattgactggacaactggttgattatcggtgattaatggccgataattcgggaaccctcctcctggtagataaaccggtcctgtagcttgatgctcagccattgaaccatcaaccattgattttaccatgcttgccaaagtattggttaatatgccagattgattgatcaaagcatggtgtacaacatagtcaacctgatcttagaagttgttgaactacaactgtgctgtattgctatcttgattaacacctccaccttgaactccctgagcaccatcaccttgaactccctgtactccttgagagttgtcaccttgatttccttgagaaccatatgtagcacctttatcactcggttgagccgagccatctggagcttgtttcacctctccatccttagaagaaccagtcctaggaacatcagcaactacctttaccttatacttctgcaccaccgttctcttgcgcgtttgcataaatgaacttaagaactggttacgtgcttactgcatcattgcttcaaatccttcttttgatcaggtgtcagcttgtctggagtgatggtcacgatgttgctctcattaacctcggacaggcctaactgctggatcttctctttaacagaaccggggctagccgaggacggtgatgctggtggcttctcctccatggagaaaaactgttgtcgcggttctgacttcttatcaggtccaactaggcgtgccaaaagcgtgttgatgaaaaacacgaggcttgggagatccgctttgttccagtgcaggtccaaaactcgcctccgggtatgctaacgtgccagttgatttgatcctgcaattaacaagaaataaagacaaagaaaccgcggttaaacttataaacgatagacgatcggcaaaaggccgatgatatatcatttatctttgagccgatgtcatatatgtatcgatcggcagtcatgaataaataagaaagaactaaaactactcgatcggctgcagatattaacgatatatactccttatatcgatatatacttaaatcaagtgattgggatagatcgg

SEQ ID NO: 55618 - DNA, 6491 bp, Oryza sativa
aacaaaagcctaatatacttaaatgcaacaagatctcaacataaagggcagatttaacatgttaataaagcacataaaacaaatatagttaaatcaggtaagatcagctgaaactccgatactaccccaatcggcaaccaagaagtaggctagagattgagattctaatcacgactcataagatcaaacaactgatgcagctataagtatgaagggaagaacaatatctagacaatcaagccgctggaagtttcatagagtggtggatatcttatataatctgaatcaacatcgatatttaacctaatcggctgccctctatcgacagatgttagccgattgtaagttaaatagagatattgctagagattatgtaagatatatgataactcgacgaattatataaacaagattagagtatcattgagatggaagcactaatcccgagaacgcaagttgtcataacaagttttacctcttgttgaagatcgaaaccgatgcagctcaaaccaaaagtaagaactcgtcgaaataaaactaaagcaaaaagggtggcgatgcgctgagattgtattgaacgtgtatgttcaatgattacatggggttcagggtctatttatacccgagaatcacaaactatgtccataccggacacgactcttatctctaacatactctaagataccataagtctttgcggcagacttttgcccaaacatatctctaaggaaattacataaaatatcctaattaatagatacaattgccttctcaggactctatccatgcatggcaatcgtcttgaagcatatcaactcaacccgatgtcgcacaccaaatcgtatcgtcggaatcggctgtatcggcttacccagtctgatcggactcagccgattctgatcgtaaccgatttggactccaaccgattcttactgtgtttccgcaatgatcttcactttcgattccgcttcgattcaatcttcttctccgatactaatattaccaaactttaaaaagtagggtcaaattggtagctagatttaaagcggggtcaaataagcaattgccccaaaaataaaaaatgggtgcacccctataagatttaaaatcggcaccaatgggtttctctgcagtagtgagtataaactatgtttagtaatttatatcttaacgatccatcttatcaatttagtatttcatatttttttaagtacaagtttaacgtacacacaacacaatcgtgcaatcgctcacatatctaccaggactcgttttgtgaagattttaaaaaaaatttatagctatttagattgcatgtatgcaattagggccatgtttagatttcaacttttttcaacaaatttctaacttttccgtcacatcgaatttttctacacacaaacttccaactttttcgtcacatcatttcaatttctttaaaattttaattttgacgtggaaatcacaacctaggtgtgtatatgtactttggtgaaatactttctgcaagcacgaaatcctatagacacagctagcatacgaatcataagattgaacagagctgatcgacaaaagaaataaagaacggggaactacgttctgccgcaaaggatgccgtggcagcatcagctttcaacggcaagtttttcccatcccgcggcagacagtcaaaacaacggcgggtcgacaagtcaatgtttttgacacgacgaacaccataaaactttaaaacgtgtttgagagttgacgaaagaaaaaaaaaacatacccagaaaataacacaactattagctatgattaattaaatattacaacaattcttttaaatttaaaatttaaaaatacaactttttaaaatttcttttgtaaaagaaaatatcgtttagtattttggtaagcgtgaggttgaaaaaagtaatttttttctctgtgttgttgctgaacgcaacctaagatagcattaaagaagtactcatgggacaaaactttaacgaagtaaaactgaataaaaggatgcaaagtgcaaaaactaaaaagagtatcagtgactaggatctaatttttcaagctgttttcttgaatttagatatatatataaaaaataacttatctttaattaagaactcaccaggcatgtactagttggttgtcctcatgcttaattaatttggttaatctcatctttaatttggccaaaaacttgcttgctactccatatcgttatcaaccataacgaatgagattaagcaaagcacgagggtcgttgttgaagctgagtacatatttgaccaaattttttaatgtttagtggcacgtacatatatacctacagatacatctctttggcatgcgcacagtgttgtttatagagagagagatgcgttctagcgggatcagcgtaattgttgtcgttcgccacctggcgtggctggtgctaattttgtgctcatggccgcgggttgcagctgctcaggctcaacaagcaccaaaaactgatccagtcgaaggtttgtattgagttgttttgtttttccccatataaatcgcaggagtatagtacacttcggttgatatatggtgtcctctcttgccgcattgacacgagaagagttggaggaaatttgattcattaatcgcctagttttttcatctacatgattagtacttcatgacgagttaaccacacagcggccgccctgaacacgatcctagggagatggggcaagaaggcatcgtgggagtggaacattagcggcgagctctgcagcggtttcgcctctactgaaatcgactgggattactaccccaccatcaacccgttcatcaaatgcgattgcagtttcagcaacaacaccctctgccatattaccaaactgtacgtttgttttcatcagttgtgcaacatgtatctcgatgcggtgcctgaaaaatataagcaaaggaacatgtcagattatcgatacgtctgttttcaccagttgtgcaacatgtatctcgatgcatgcagtgcctgaaaatataagcaaaggaacatgtcagattattgattactagtatttccaattcatagagccatcacatcggtttatcctaaattgggtcctccggctccagtgacctttctttaatttgcatcttatttaggcaaaaccaaatatatcccaattagcacaattctcatatataggtattgcatgtctattatgcagaagggtatataaattgggagtagttggtcaaatacctgcagagctacagaatctcacccacctagagtatttgtatggtatctaagtcttttctccttaatcttgataactaattgttacactacagattaaggttttgccgtaaatataaattatattccatgttctttttgtgaaaacagacagcttatgctttttttctgctaattgacctagtgtttctttatgttgtcttcaggaactttaattataattacttgactggtgccattccatcattcattggaaaattcagttcaatgaaatatttgtaggagttacacatcacattctagatttatgtactatatccctttcatattataagtcgttttcagttttccaaatcaaatttctttagctttaatcaagtttgtaaaaaaatgtagcaatatttttctacataaaacaaagaaactattaaaatgttttcaatgttagatttaataaaactaatttggtgctagaaatattgctatattgttttataaacttgatcaaactttaaagaaatttgattttaaaaaagtcaaaacgacttttaatacgaaatggagagagtaccattcaatggttaatgttttttcttaattctgtttcatcatttgaagggcattagcttcaaattcactgtccggacaacttccaaaggaacttgggaacctcaccaatcttctctcgttgtaagataatctttcccatggcaaataaatcatcaactatttacttggactgcctcaaccaatataatacaacaaatattaatcgcataacttctcaacaataataaattaagtaataaaaaaccataattgcaaaaatatcataaactactaaacaacatgtaacagacaagtcagtgcaattccttttccatgtgttgcatcgtttgatcaggaaaacacgatgccccctttcttctattatatagttgaactaaaaaaatttaaatcactgctgaaatatttcattttcaattaggggcattaacttaaataattttaccggtgtacttcctgaagagctgggcaacatgaccaaacttcagcaattgtaagatgcttcgttagttcctaacatccaatttctacttctaaaagaattaaaatttgaaaagagcagatctgttgttgaccatgatagttacttcaatgttccaaaagcaggtatgttgctagttctggattcagcggtcggtttccttcgacgttttcaaagcttcgcaacctgaagttattgtacagtcaataacagagactcacctagtatgtttatggtgttttcttgctgaatgtcaaatatttttgtgtgcttgtaggagagcatcagacaatggattcatagggaagatacctcattattttggcagcatgactaatttagaagatatgtaagattaattatgtatattaacttgttaacatatcattcgctctatcctaatcagagacaaatgaaattttgcaacataaattttctgcatatatgattttcccattcgaatttgagcaatataatagcaaacatttccactcaacaaaattgcacacatctctatcacactaaatttatccagggggcatgttactacatcgagattttatgaaataaaaaaggaaaaaaaaactgttgatacacatacagcttactttaaccttactttaaataaatggtggcatgtattctttctaaagtatgagctttagtggtttcgaaggaaactcatttgaaggaccaattccagaaaatctgtctaatctgaccagattagaaaacttgtaagtatacttttttgtggtattgatctctcttgaagattgacaatgccaacgctgatgagttatttctgaaaaatacatgtgagcagacggattggagatatagtaagtggggcctcttcattggcatttatcagtaatctgacatctctgtaccaactgtatgtgatgtttttgcttcaaattaagtttacagtgtataggcaaatttgcaagttacaaaagttggatttcgttcttacacaggatattaagaaactgtaagatatcgggtgatctcagagcattagatttttccaagtttcgaacactaatatcgctgtaagtctcccaaccaccggctatggtgtcacatttcctcatgtagtgaaccatatgtactccaagtaatttatactatactgttgtggcacagggacctaagttttaacaatatcacagcccaacttccttaatccatcctacatttgtcgtgaattcctgtaagaaattctttcttgatattaattgagttttttcaagcaccttttaagcagatgagcatgttagatctcacatcttcaattgtgctcaatttaggtttattgggacaatttatgtaaggatgcatgatagtaaaagctcttcacatagagcaatgtatgtcaaaaataataatcagcggagcagtatagcacaaatattttgataatagaatgatgtatcagtatctatatatgatacagttctgcaatgcttaggagattatttttgtacaattctgcagtactggaatcttcccttcctcggctacctagaataatttgcagttctaagtataaaattaccatatttgtgtttgagaggaaaatttagatcattgaatatttattttgtgaaatgattttggtaacaaacagcttttacttgttagtattacacccaagttggtatccacgtacctagaatactaccgtgccaattatgatagtctgcgaagtctgaaatttattaaaattttcgataaaattcactcgcagctctctggtttgacttgtgagcattggtgacatcatcttttggtgagttacgatttgagcgggatgttgatgaccacactataactatacgggacgcagttgtgttgtgccttagcgatcgatatacctctttataggttgttgttcttatcggtgcagatcaaccttatacctgcaagcaaatcaaaaaataagctaaaaaaagataaaaacaatctaaattgcaaatactaattaagctcgcgataaatttaacacccaataaggtggggtgccgaagatgagtgattaagcggtcagccaacatgcacaattacgaggtaaagtagaaataataaacttcaatctatcaaaacccaaaaaaaaaagtaaaattcacaaaactacacgttttgtggtccaagttgtagaaaaccacacacactttgacacttggcacttaagta

SEQ ID NO: 55619 - DNA, 3028 bp, Oryza sativa
acccctcgacgacaccagacgatcccaaggcgatttcctctccgaccaaacttccgacctgcgatgatgtcaacttccgccatcccgtctgccgcgccatcgaccgaatacgcagaggtaagtacccatcggctagattctctcctttatgcagtagattggttcttctttgtcttatcttgttttcttcttctcttttcttgtttgcatctgtagcacttgtccaacctggtcgcaattcccagtttgtcacatgaacatcactactttctcggtccaatcggcaatcccgatcccactaagtttattattgctggaaccaataggatcccttttagattggccaacccaatcctaagtcactggaagaataccttcaagtcttggccttctcttgagaaaacttcccctgagaaaagctggtctgtgtggtataagcgtgtattagccagcaagcaagttcattgggacgaactaggaatcggccatgcccttgctcttacattagcaaattcggctaaggacaaacccttgatggcctctccagcctattgttggtccaacgcccttaatgctttcttggttaatcaagggccgatgactcccactctgcttgacatcaccatgattactggtctagatgtgaccttatcggctaaccccatgagtttgaataccaagaatcaatttgattttaggaccaacagcataggtggttggtctggctatgtagccgcatatatgggcaaaggatctgccaccccccgagagcacactgcctttctcttcatgtggcttgaaaagtttctgttctgtggatcaagctgcggtcctaccaccaactggcagttcttagccgaagcccttgaaagcaagagacaattccctctaggcaaaatccttctcggctatctgtaccaaatgttgagtaatgcatcggctaagatagccacaggctcagtagtgggtgcgggtggaccatggtgattgctacaaacatggcttaatcttgtcgttatgaaggttgtgaatcggccgcctctgatagatgctgaattcccaaggctggagcccaccaccaatgatgacagggaagaagttacccatcgccgatgcctgtcgtatggtgaagctacatcaacaccagccgattctggagcaaagctatcggctcaactgctcaaggactggttctgcagtttctatgaaggcttccaaagagatgctcgagtctggtttccatatgaggactcagtaaactttgatctcccatcggacttcagatttgaagacatcaactctgaaaattccaaaaatccagagaagtcttctcggctgccattagtccatgcatccttcctgttggcattcaccaagggagaaacatacaagtatcttaggagttataccatccaatgagctcggccagacaatttggaatgggatagttgccgatcggcttgttctttgccgataagatccagtgcagaggagaaatctgatcaacattgatgatggatcggctgctcaatatcctaggaccccctttgggtagtattgataacatagagctggcaaggttcaggagcaggaactttgaaagatggtggggtgaatggaagcaacatatattccatcagctagcctctatgtatatgacagatctattcccagatattgttcctcaggtatatcgttactctgtcaattctgttgtaataaaagttagccgatttgtacctttaactaatctcttcgtttattttgcagacaatagaatcttctcctcctcgcaaaagcaacagtggcagagatatagaatatgtcctaggccttctaccaaatggaggtggactagctcctcctgtcattggctatcatgcccccaggaccacaagtctgcttcaagagcaaatgagagaaccacccgatattcgtaagaagagaaaaaccaaggcatcggctattgatccatcggctctggctcccaagaagaagaccaagaagaataaacccaagccagccgatgacctgcctactttagatccatctattgagcaagcctgggatgaagaagagatcgaagaagatgtttgtcacaccctgaagttctcctcccaagccaaaaatttaatttataaatgaccctaagaaaatgccggcgcaaatcaagagaaaaccctaagaaagtaatacaaataataatcgaatctgacatgtggaatttttcttgagttctacatgtcgaaattcactaacaggatttttagtggaattttcagagccctagaaataattttgaccaattaaaattgagcataagcaatatttaaatccctggaaattcctttcttcctttttctttttccttttcccttagtgggccgccggcccacttcccctcctctctccccgcgccttgctgggccggccggaggccacgccccagctcaacccgcgccccctcctctcgcccggggtcaccgacaggtggggcccacctgtcggacccgtctcccacctcgccgccgcgcccgcaaccgccgccgcgcgcacgcctccgcctcctccgggccacgtcggccacgcccgcgcgtgcgccgcgtctcccgcgcccactcccctctccctcccgcccgcgcccgcgcccgagatggccgggattcgaaaatcgaatcccgcctctctctcctcccccactcccccacgttggccggcgattcccgcctctcccggccatgtccggccccctctccccctatttaaactccgccgccaccccctctctctttttccccatttcgccaaactctcccgagctctccatcactcccgcaacgtgcatccacccgccgccgcctttcccgtcactccggccgccgctagccgccgctagactcgccgccgcaccgcgccgtcgccgccgtcgggttcgcgtggccgagatccaccccgtccacccctccttcgtcgaggttcgccgccggagcgccattcccactgtgcgacggtgagagtcgccatgtcc

SEQ ID NO: 55620 - DNA, 788 bp, Oryza sativa
ccctgttatcatcggtaatggaatatcaagtgaaggctcggttcataaaagacttgtctttcaattaatggaatggatcaggagataatgattgctagcccaatttagtaatagtcaggctcgtgaatgatggcagaagttgtaatcgatcattcgatggtttcttgttgatggcagtaatcatgacattatttctgttaatagtaaccatataatactatcagatgtgatcaacaaaagtatcatcaagaaaggtcgcgctcatgacaattaaggaccggttcgcgagctattgttgtgagacattaaccgtaccaaccacaagccagcgtgggcaatggctttatcttttgtatagcatgattcattatggtgtgccagactgagaagtggcgagaagtccgtgggggtcgctggggagtccattgcctctggttttgagggggagattatgatccaggaatggtgcactgtggtgagttgtgttgtgcgaagggtattgtcacgatttcccccttagcagtgccgtggtggtacttcggggcatggcaacatgtgtggaatcgtgtcttctgggtacagtggtacatctctggccagagtaaaactattcgaatagccgtgcccgcggttatgggcgagtctaacaatgtttttcgtgattagtaccacactactcattaatgttaataatatgatgattaatttgactcctggtttggaatggataattcctggtttggaggtttgatctgtacgatcggggttggttgttcagtttggttggg

SEQ ID NO: 55621 - DNA, 8555 bp, Oryza sativa
tttaatgcatattctgcttggaattctattcggtaatttctgggagtgacaggaacggccgggggtggcccgatttcgccggccgacgtggggaggtggaggtggagagagaggtgggattcgaatttcgaatcccggccatctcgggcgcgggcgcgggcgagagggagggggagtgggtgcgggaggcgcggcgcatgcgcggggcgtggccgacgtggcccggaggaggcgggaatcgtgggcgcggcggcggtagcgggcgcggcggcgccggctggaggaaggagacgggcccgacaggtgggccccacctgtcaacgaccctaggggagaggaggcgggcggccggctcggctcagctgggcctcggccttcggccggcccagcgggaaagggggggaaaggctagtgactgcacctgtgttagtcttgcctgatcctaggaaaggttttcaagtgtactgtgatgcatcccgacatggtttgggttgcgttttaatgcaagatgggaaggtggttgcctatgcatctaggcagttacgccctcatgagaataactacccaacgcatgacctagagttggcagcggtagtgcttgcattgaagatttggcgtcattatctttttggtaaccgtacggagatgtatacggatcataagagtttgaagtacattttcactcaacctgatttgaacatgcgacagtgaagatggttagagttgatcaaggattatgatatggaaattcattatcacctaggtaatgtgttaccacgatcggaagaatgtgagcagagttttcaagagttgaagaatcgcttgatatcagctcctattttgattttacctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaaaatttggcgtcattatcttttcggtactcgtactgaggtgtacaccgatcacaagagtttaaagtatatctttactcagccagacctgaacatgagacaaaggagatggttggaattaattaaggattatgacatgggaattcattatcacccaggaaaggctaatgttgtagcagacgctcttagcaggaaaggctattgcaatgctacagaaggacgacagttgccattggaattatgcaaggaatttgaaagattaaatttgggaattgtcagtagagattttattgcagccttagaagcgaagcccactctaattgatcaagttagagaagcgcaaattaatgatcctgatattcaagagatcaagaagaatatgagaagaggaaaagctatcggtttcttggaggatgagcacggaactgtatggttgggtgagagaatctgcgttcctgacaacaaagatttaaaagatgcaattctgaaagaagctcacgatactttatactctattcaccctggtagtatcaaaatgtaccaggatctcaaggaaagattttggtgggcaagtatgaagcgcgaaatcgcagagtacgtagcagtatgtgatgtttgtcagcgagtcaaggcagaacatcagaaacctgccagtttgctgcagcctttgaagattcctgaatggaagcgggaagaaatcggtatggattttatcactggtttacctagaacgtcatcgggtcatgactctatttgggtgatagtcgacagacttaccaaagtggctcatttcattccggtaaagacaacctattccgggagtcggttagcagaattgtatatggcaagaattgtgtgtttgcatggcattcctaaaaagatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgctgaattttcgtacaacaacagttatcaagctagccttcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgagtggctcagtctcgtcataagagttatgccgacaatcgccgcagagatttgagttttgaagaaggagattatgtgtatcttcgtgtcacgcctcttcgaggggttcatcgttttcacaccaaaggaaaattggcaccgcgttttgtgggaccttataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatattgagaaaccaatccgtattttggaaatagatgagagaagaaccagaaatcgagttatccgtttttgcaaagtccaatggagtaatcactcggaagaagaatcaacttgggaaagagaagatgaattgaagtcagctcatccatatctgttcgccagttcttccgaatctcgaggacgagattctgtttaaggggggtaggtttgtcacacccttgaaaatcataaatatataaattgttgttaaattggaattttttagaaataattttaaaagtttttttttataagatctaattttaaaaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcttcttttggctttgggccgaaagtcggcccaaaacctcctctctctctcctcggcccagccggcccagtccgcagccgcagccgcccgcgcgcgagtgcgctgtcgctgacaggtgggtcccacctgtcggagtcgtcgtcttcgtcgcgccgccgccgcccgaaaccctagtttcgcgccgccgccgttcctttccaaatccggtcgatcctttccgtttccggccgaattgatagaggggaaatgatcatcgggatctcctctaccttttctcttttggaaacatcggctaattcgttttggaagttcgtggaatcgagttcgattcggatcggcctctttcctccgaaccccgaagtttccttctcgtcgccggccgccgtgggctttcgtcgccgcctccgagcccctttaaaaggacccccggtgtctcctctacccgccgccaccctcgccttcgcctctcgtcgccggaagagctctagcgccgtgtgccctagcgccgccgtcgccgccgtcgctccagccgtgcgccaccgccgttccagacgtcgtcatcgctcgggaagaccgccgtcgtggtcgccaagtcaccgccgtcctcgtccgccccttcgccgtcgccgaagatcgccggagcaccatcgccgccgtcgacccgaagaccgccgccgtttcttcgtcgtcgccgtcgtcgtccgttggtcttccgccgctcctttggtcaccggtgagttcgccgcgtcgcgctctacccgttggtgtcctccgttcgtgccgaagcgtcgccgttcgccggcgggcttgcgcgtccgagccgccgagccgccgccgccggtggtgacgtcatcgctgacgtcatcgtccccgtctcccgtgagccggtcgtggaccgatcgatctcggccgtccgttttggatggatcgatctcggccgtccgttcgcgtgaaccgccgccgtgcgcccggtccaccgaaaccctagcccgctgacgcaataaatccctttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagtaaggcaagtcacacagatcccaaacaaccctttgagcatgttgatcctattttaagctattgtttctattcaactattgcatttattttcgaatgtcattgggtggaattaacctattctttgttatagcccttttgttcttgaatactttattccttgataccttgggttatttataacttgactagttgggctatgtatattggttcaactagatattagatataattgcttagccctgcttagaaacattagcacattattgggataacttatgactcattacttaatgatggcttaatgatagttcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaaggtgcgctgcggtggattgtgttatgtaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataactggtaataatttgattagctcctggtttggaatggtatattcctggtttggagatagaactgtgcagccgggatggttgttcagaatggttgggcctatacaacagggtatgttgtatagcgttgatttaatattgtttaattattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttcttcagtgaagctgatggtgtggaggattaggtgtagccttggtcaagctgcctgtggtgtggagccgtctgcgccgtttatcttattttccgctgcttagatctttattgattgagttgagaggaactatctacctctgtaatgacattttattcgcttattaattagagtaataaatgtactctattatcaatttgttattgtgtgcctcggctgattcctggacgagggttcacacacatgtaagcgtttggaattttggatagaaattccgggcgtgacataggtaaagcaaatgtggtagcagattctctcagcaggaaaagctactgtaatatgtcagaaggatgacatctaccttgggagttatgctaggaattggaaaggttgaacttgggaatagtcaacaaaggttttgttgccgctttagaagctcaacctacccagtttgatcgagttagataagctcaagtgaatgatcctgatatccaagaaataaaaaagaacatgagaagaggaaaagccatcggatatgtggaagatgagcaaggaattgtgtggctaggagaaagaatttgtgtgcccgacaataaggagttgaaggatactatcatgaaagaagctcatgaaactttgtattccattcaccccgggagcactaagatgtatcaagacctgaagcaacaattctggtgggccagcatgcgacgagaaatagcagaatatgtggctctatgtgatgtatgtcagcgagtcaaggcggaacatcggaagccagccggtctgttgcaaccgttgaagattccagagtggaaatgggaagaaataggaatggactttatcaccggtctacccagaacgtcgtcgggacatgattctatttgggtagtggttgacaggctgactaaagtcgctcacttcatacctgtcaaaacaacctacacgggaaataagctcgcagagttatatatggccagagtggtatgtttacacggtgtacccaagaagatagtgtcagacagaggtagtcagtttacttcgaagttttggcagaaactacaagtggagatgggtactcgtttgaattttagtactgcttatcaccctcaaactgatggtcagacggaaagagtgaatcaaattttagaagacatgttgagagcctgtgttctagattttggtggaagttggtataagaatctgccgtacgcggaattctcttataacaacagttatcaagctagtctacaaatggttccatatgaagcattgtatggccggaagtgttgtacgccgctcctttgggatcaaactggtgagcgtcaagtgtttgggacagatatcttgcgagaagcagaagaaaaagtgaagattatccaagaaaggttgcgagttgcccagtcgcgccagaagagctatgccgacaatcgtcgtagggatttggctttcgaagaaggagattatatatacctacgagttacgccactgcgaggagttcatcgttttcaaaccaaagggaaattggcaccgcgttttgtgggaccttttaagatcgtgagtcgaagaggtgaagtagcttatcagctagagttgcctctgtcaatggcaggaatacatgacgtgttccacgtgtcgcagttaaaaaaatgtttgcgtgtacctatggaggaagcagatcctgagcgtatagagcttcaagaagatttaacttatgttgagaagccagttagaatcttggaagtgagcgagaggaacaccaggaatcgcgtcatacggttctgtaaggttcagtggagcaatcattcagaagaagaagccacttgggagcgagaagatgaattgaagtcagatcatcctcatctttttgccagttcttctaaatctcgaggacgagattctgtttaaggagggtaggtttatcatgccctaaaaatcgcctaaattaataatgcatattttaaatcatttttagaaattattttaaaagcctacaagttaatctctaaaaatctaggaaaattttcaacataaaattgagctagataaaatttcattaaatattttgcttgttcctctattttctagatttttctgggaattatttgagtaagggaagtatttttaataaatgaaacaacatttcacaaattattttaattgaaaaagtgttaaaaaccctcccccaagccgttgggccgatttatccctccctcctcgcgcgagccgcgggcccacgccgagcccagccgagccaccggcctccccctcctcacagccgccgacatgtggggcccacatgtcggggttgtcttcaacctccggccggccgagtccgcccgagccgccgccttccgattggttgaggggttttgatccccttgttgtcctctatctttacccccaaaaatcggagctaatcgcttcgtatcttacctgaatcaaactcgttttcgagtttatccccaaaacctaaacctagtttttcccggtccgattactcgcggttagagtccgatctctccaatctaaggctataaatagcaccctctagtcgccctctttcgtttgccctaactcccgagccttcttgtgccccgtagcgccgccgccacgccgtccaagccgccgccgccgccgtccgacgcccagccgcgccgcgccgtcgcgttcgccatcgccgccgttaggtgcgcacggaggtggggaacctcggccgccccctcgccgccgtcgccggtcacaggagatgtcacgaccggaaataacccaacgggcgttccttacgtgcgtgcattaatccttgtcccaggaggcaaggtacaccaacagttgatacaaatcagagtttaacaagcggaagcgtaaatagttaattattacatgggcagcgacggcccagcacactcaaagacaacgaaaaacagcggaagactagggcgacgaccacaggcgcttgacggcaggcacgagctagacaccaaaacctccatcttccaggaactcttcttctgggcttgggaaaaaattgagc

SEQ ID NO: 55622 - DNA, 8748 bp, Oryza sativa
  unsure (1)..(8748): unsure at all n locations
caaatccgcccgttgaacgcgagaaaaaaagggaaaaatgggggaaagggagagggaatcacggggagtgatttccctcctcttactgcacgcgggggcggcgggatgcggcggaatccgcggcggcggcggcgctagggcacgggcgaggcggcgggagcggcgcgaggtaggggatgacgggtgggccccacccgtcagcgagggtggcgggcgggcccgcccgtcagcggcgcgcgcgcgggggaaggccggatgggccgcgggggagaggagagagagggagagggagggggggaaaaagggactttttagggtttttctttttataaactcattttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggatttttacttattctatgcataatttcgaggatgtattttagagtcgttttgggacgcgacaaacctaccccccttaaacggaatctcgaccccgagattcggaagaactggcgaagagatcgggatgggccgccttcagctcgtcttcacgctcccaggtagcttcttcctcggcgtggttgctccattggaccttgcaaaaacggattacccggttcctggtcctgcgctccatggtgtccaggattttcactggcctctccacgtaggtcaagtcttcgcgaacttcaatttgcgctgagtcggcctgctcggatggcactcggagacatttcttgagttgcgacacatggaacacatcatgcacgttgcccaaggaggcgggcagctccaactggtaagcgacttctccgcgccgagcaatgatacggaaaggacccacataccgaggtgcgagcttcccttttgtctgaaacctgtgtacacctcgcaatggcgtgacccgaagatacacaaagtcacccactgcgaattccaggtcacggcgacggttatctgcataacttttctgccgggactgtgccacttttagattatcccgaatggttctgactttagcttcagcttccctcaggatatcagtcccgaacacttggctttccccaacttggtcccacaatagcggtgtccggcatttgcgcccgtacaacgcttcataaggtgccatttgtatactggcctggtagctgttattgtaggagaactcggcataggggagactcttatcccaggtcttcccaaaatctaggacacatgcgcgaagcatatcttctaggatctgatttacccagctcttcttggagcttcttccaaaagtgagaggtgaattggcttcccctatcagatacgattttcttgggaacgccatgaagactcacgatcctagcgaagtagagttcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgctggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatttggaacgcatacccgatttccattccatagggtcccgtgttcatcctctgtgaaaccagcggctttaccctgtttcatattcttgaggagtccatgcatgtccgggtcgttcttctgagcctcgcggatttgatcgagcaaggtaggtttggcttccaacgcagccaagaatccacgactaactatgccaaggttcagggcttccatctgttgattaagttcgggtggaatgccacggacgttaagagtgttgcaatggctttttcgactcagagcgtcggcgaccacgttggccttaccaggatgatagtgaattcccacatcataatccttgatgagttctaaccatctcctctgccgaagattcagatccgactgggtgaagatgtatttcaaactcttatgatcggtatatatttcacagcgattcccaataagatagtgccgccagatttttagagcatgaaccaccgcggctaactccaaatcatgggtagggtagttgccttcatgaggtcgtagctggcgtgaggcataggccaccacatgaccgtcctgcatgagcacgcaccccaatccttggcgcgaagcgtcacaatacaccatgaaatccttgcgagtatctggcaagactaacactggcgaggaaaccagcttttctttgagagtttgaaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgacggtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtatatcagaatgtcgtcaatgaaaaccacaacaaacttatccaagtattccatgaacactttgttcattaagttcatgaagaaggcaggtgcattggttaaaccgaacgacatcaccgtgaattcatacagtccgtatcgcgtggtgaatgcggtcttcggaatatcttcttcgcggatgcgcaactggtgatatccggaacgaagatcaatcttggagaataccgtggcacctttaagctgatcgaacaggtcatcgatccggggaagagggtacttgtttttgatggtgacttcattgagggctctgtagtcgacgcacctcctcttcgtcttgtccttcttctccacaaaaatcacaggagcgccccagggggaagtactcggacgtatataccccttctctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacatctccgaactctctgacgatggggatttctgacagtcctatctgatgaagttctgaactactgacagaggttgggggtgcaaagaaaacaaccggttgttccggtcctcggtacagagtaacagtgcgtctcgcgcaatccactactccttgaaattgagccaaccaattcattccaaggatcacatccaagttcttggtgtctagcagaatcaggtccgagggaaaaggaatcccctgaatttctatagggacggcaggactataatactttgctgtcataacccctccaggggtggtgatgagcagagggtttctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccctgaatgacatccttcccaccgttgttggagcggggaggcgcttggccttgctggcgcctcggtttcgggcatttatccgcaaagtgcccgggctcgaagcagttgaagcacagacgctgctgaccttgagcgtccctgcagccttgaccagactgcacggctggcgtaggaggacggggcgcacgagtcccttgctgactctgctgctgctgcggctgtgggacgcgcaccacgtattgaggtcgaggcacggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcagaattccctttttttaagagccacgactccggcgggcacatgggttctccggaaagcggcggtgaaacgggcccaagtaataggctgcccctctggctgcgtagcctggaaatggtcccaccatagagatgcgggcccctgcagttggtgggcggcgaagatgactttctcctcatcgctgcactgcacagtgtctagctttttccccacggcatgcaaccaatccaacgcatccacggggttgttggagctagagaaggtgggtgggcggatgcggaggaactcggcgagtttagagtgttgcgggggtggtggtggagcattctgttgtggcggattttggaggtggtggaggaaagcagtcatcatgttggcctgctgggcgaggatttgggtgagaatggcgttggtatctggtggtggtggtggaggcggaggaggaggtggaggtgggctgccatggtggttgcggttgctgccttcaggttggttgccatcaccggcattagcacttctcctggtcgtcaccatctgaaaaccccacacagaaccagcaaacagagagagctgacaattaaggctaaccatccacgactaccataattcttaaatttattactgctattaaattggttcattaaagttcaagttgcttaggcaaataaaataaagacaggctccgacacagttatgccacacaccggcctaaccatgccccacacaactccaacaagaagacaaacgaggaagaacacacgcgcaagcctactaactgctcgtctaccactgcgacgggccagggcggaaggtgagcaacagcgcatcctccgtgctaccaacgccggaggcttccccctcctggggaaccacaggcgcgggctcggcacgaggggtctccacgaagcaggtccacgccagggactgacgaacaagctcgggcctggaggtgctcttgcgggcggtgatcttctggctgcggcagacacggcgacgcttggggcggcagacctctccctgggcgatcttgagctgatgcagctgcgcctccaccgcgtctaggtccttcttgagctgcaggttctcctgacgcagctccaggatcttcaggttgttctcgaccatcccacggcgcaccatctgatggaagtcgatacgagccgcgtcgtacgcctccaccatgcgcgccaggtgcacgatggtagcgtcgtcctccgagctagcatcccggaaggtggcgtagtcgcgggctcctccgcggtgagggtggtagcggtagggcgagtgctgcaactcgtccgggtagcgctggtgaagagtgccgatggcgaggagagcggcgttctggcaagcggcggggaaagaatctccacccgcggtgactgccagcgaagtccgctcgggagagccagcgaggatcactgcagtgacctcccaagcagcgtggggctctgcatcgtcaccctcctgcttcggaagcggcctggcctggtagtccactccatgcggataccccaggaccacgcacatgccccgcagctccaagacgaagccagtcatgtccaaaccacgacgggtgacgctgccggccatctacaaacaaaaacaaaaagaaaaacaacattttaaagatcatattttggcgataaatgaagcagcaagacagagagagactagacagttttcacaaataacaaaggatttttatttcgaaaatactgctaaggcttgggatctaaggctcgtcctagggtcaagggggctctgataccaacttgtcacgaccggaaataacccaacgggcgttccttacgtgcgtgcattaatccttgtcccaggaggcaaggtacaccaacagttgatacaaatcagagtttaacaagcggaagcgtaaatagttaattattacatgggcagcgacggcccagcacactcaaagacaacgaaaaacagcggaagactagggcgacgaccacaggcgcttgacggcaggcacgagctagacaccaaaacctccatcttccaggaactcttcttctgggcttgggaaaaaattgagcaagactgagtacaaccaccgtactcaacaagacacacccacaaatgcagaataaatgcaagggagtacaaaggagttatactataaagggttagggtttgcagtaaacagcatttaaagatatttagttgctcagagctattttgtaaacacgattctagaactgtacaatattatttatcaaggccgtgaacccacacgaacctgccttaacccaaggcctacgatgattcagaccgaactggcaacccgaccctgggtcccagctcgtcccaagccaacccaggccaaccaatccacattttagctgttaagcaggttttaagaattaaaacactaacttgggtacattgctcggctcgcccataaccgagggcgcggctattcgaatagattatactctgatcagaggtgtacaactttacccacaagacacatcttcctcacgtgcaaccacgtgccacatacaaccacggtatacagacggaagacatgacatagtttccaacccatcctagccatagacaagagtaccgacccaatccctcctacggccggaacccccgggacaggtaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataatccaacaaattccatagtgtccgggtgatatgaagattcccacagtctagagttggaaaaccacctaatgttacctaattaaatagcgaagcatctacctaaaattatactagtggtactatgagtagagtgtccactagttggggttttgtttattctagggtgaacaaggtaataataacaataacaataataataaggtcataacaaaggtaaataggcgtggctaaataaaacagtgataacgcgggaatttaaataaagcgataatgcagtaatttaaatcaacataattttacaaactgggattcaatatattcaaagatgatgtgacttgccttgctcgctttcccaaacgtcggcttcaacttccacgaagagcggatcttccgaagctgcagcgtctacacgaccaacgaaaaagaaaaggcttttactctaataaactccatataacaagcagaagcaaagcacaaaaatgggttcttgacttcttaaggaaaaattagagacttgaacggtccaattccgagttcaaatggccaagttatggccatttgaagtttatatgctctttaattgaatatttgcgaatttcttcatttaaattttaatttaaaatcggatttattgcgtcagccgaggggaggggcgcgcggaccgggtccacgggagtggggcccacgcggcagcctcacggtccacggtggaacgggtgcacgcggcttacgccggccggcgccgtgggtcccacgcgtcagccgtacccgaggcgcgggcggctgacggccgggccccacatggcagccgcggggcgcgcccgaaggcggcctcgccggcacagccgacgggaggcggcgcgcccgcgcccctttggtcgccggcggcggccataggcacggcggagcggcggccgagagaggggagggaagggggaaacgaaatgggcggtccacggctcaccccgggtcgacggcgacgacgggaacggcgaccggagcggaaaaaggcggcggcgcggctcgggtcgacgaggacggcggcgttccggcggtcggcgggcgaaacggaggggtggacgaggtcggcgatgttgcggcgaacccgaagaggcgacgccgaaacgggagaaggtccggggcgacgacggcggcagaccggatctcggcggcggcggcggaaagagagggcgacngcgcaagctctattccgaccgggagagagagcggcgagcggcggaaaccgaagaaggaggcacggggatggtttatata

SEQ ID NO: 55623 - DNA, 5938 bp, Oryza sativa
  unsure (1)..(5938): unsure at all n locations
taataatttgtgttcagaaaataccactaaaatttattaacgcattttagacttataggaaatatacataaatcctccaagccaaattcgacttttaactttgcacattttaatggttggaggctttcacatggatttttacttattctatgcataatttcgaggatgtattttagagttgttttgggacgcgacaggagagccgccgccgccgtcgaccgaactgtgccgccgctcaagctcgccgccggccgccatccgtcgtcatccgtcgcgtttgttagtaccggtgagttcgcaatgttgtcctctacgcgtaggtgccctccaatagtccggccgagcctccaagcgccggcgaggtcatcgcccgtgtcaagccggcgaggattacgtcagcatgacgtcataatcttttccttttagtttttctttattagatgcaaatcaattaaacttcggaaattcataactaattcatcgtaactccgattcgagtggttcaagttgctaaatttttctaaaactgagatctacatgttaaaaatatccacatgtactgtttatgctagtttttgtactgttttgttgattttgttagtttgctttagtttccgacgttccggaggagagcgctttcgttgaagaaggttcggaagtgtttgtggaagctcaaggcaagtcacacagatcccaaacaaccctttgagcatgttgaacccgtttaaagctaatgttttatttcaacttatgcattattttcgaatgtcatcgagtggtgagcctttcctagataattaatggccgaagatgactttattttcctataggttataatttgattagcttggaccttatatattggattggttcagctaaatgctataagtatagttgcttagccatgcttagaaacattagctaattaatgggatggatcatatatactacataattatttatgcttatatttaatggtagctcacgatggttaatcatgtaaagttaattaattgataataaaaacctggttaaaggtgggttgtgagcatatgattttgatggttgtgctcatgacaattaaggaccggttcgcgagctactgttgtgaaacatttaccgtgccaatcacaagccagcgtgggcaatggctttatcttttgtatagcatgattcattatggtgtgccagactgtgaagcggcgagaagtccgtgggggtcgctggggagtccattgcctctggttttgagggggagattatgatccaggaacggtgcactgtggtgagttgtgttgtgcgaggggtaatgtcacagttcctttctgaggtaccgtggtggtgctgaggcgcatggtgacatgtgggattgtgtcttgtgggtacagtggtacacctctgatcagagtaaaactattcgaatagccgcgcccgcggttatgggcgagttgggcaatgtttttcgtgattactctcatgctactcattaatggtaattgtgctaattaatgtgactcctggtttggaatggtatattcctggtatggaggtttgatttgtacaaccggggttggttgttcagatgaggttgggcctatgcaacacgggtgttttgtatggtgtttatttaatactgcttaattattcaactgttttactattctcttaaatatttattaaatgttgtttatgcaaatgagctttattatgacatcctttgttatcctgtgcacttccatgtttgctgtgtggcttgttgagtatgtcatatgcttattcttgtaatattcattcatcagaggaggagtacttcagtgaaggtgatgatctggaggactaggcttgatccgggttaagttgcctgtggagtggagtcgccatagctattccgtagtttgctgttatttttccgctgcgtagaatgttattctttgagaggaactatccacctctgtaataaattattatttgcgaatattaaatagctgtgtgttcgtactctattatcaatttgttattgtgtgcctcggctgattcctggacgagggtttaacacacatgtaagcgtttggaattttggatagaaattccgggcgtgacaccgattgagatggattctataaatattggaaaacatcatatcttcaatcatcaactgttatcgtagcaacttctactttgacatcctttatcatcggcttgtactccgatgctccttgagccgattcattagcttcaacattttgctctcgagacacatgcgtcaaagttaccggccgaaatccatccatcaattctcggcacttctcattgtaaaccattaatgtatcattcttgcactcatattctcctgccaattgactgatcaccagcaaggaatcacccataatttcaacagcatcggcttcaacctctttaagcaattgcaatcctttgagaaccgcttcatactcagcctgattgttggtcgcatagggcttaataacgtaggcaaactcgaaacttgccccccgaggagaaattataaccaagccgataccacaaccatgagtgcatactgatccatcaaaaaacaatgtccaaggcataatttcaactgagccgattgagtcatcacgatgatccacaataaaatcggctatagcctgtcccttaatcgcctttggtgattcataccgaagatcaaattcggttaaagcaaatattcactcaaaccgaaagtcattacaacctactcaaacaagccgattgcacaaggacatctgaaagccgtcttatgaatgtcttcttctgccataaagatctgattgttacctgcattgacatccataaaacataatatcttatgccctgaagcagcatcaaccaattgattggcaaccggcattgggtactcgtcctttggggtagctttgtttagatcccgaaaatcaatgcacaccctgactttgccatttttcttgataactggaactatgttggaaacccactcagcatatcggcatggacgaataaaaccggcatcatacaaacgtttaacctcagccttgacagcttcaagcatatcggatttgcatctcctcggcggttgctagtatggtctaacccccggtttgatagggagccgatgttcaacgattgatcggctgagtcctggcatctcataatattcccaagcaaagcaatctctatattcctttaaaagctctatcaacttggttctaaattccggagataaattcttactgatgaacgtcggccttggtctgtcacctggacctatatcaatttcttccaaatcatcagccgacatgaaaccctgtccttgcttgtcatcgagattatctactgtgtccttggtatagacgtttgatgccctcaaaataataatttgggctctccatcttcaattggttgtatatcacaatcggacacttttagaaaatctccatcccaaacttttccagacaggcaatcaataccatccatctcccaaagagctaaatcggcactggcaacgtgccaaaagcgtgttgatgcaaaaacacgaggcctggaagatctacttaacttcagtgcaggtccaaaaatcttgcctttaggttcgtgagcacaccagttgatttgatcctgcaatcaacaagaaataaagacaaagaaaccacggttaaatccataaatgatagccgatcggccagcagccgatgacatatcatttatctttgagccgatgtcatatgtgaatcgatccgcaatcatgaataaataagaaagacttaaatctactcgatcggctgtagatattaacaatatataatctttatgtcgatatatacttaaatcaagtgattgggatagatcggtcgccatgccgaaacagtataaatcacttagatcgaaatatatactaacaatgagattatagatgctcatagcatagccgatcagatagatctagcatgtatcggctaatactccgataccactctatattaagcaagtaaaatatatcaaacagaagcctaatatacctaaatgcaacaagatcttaacataaagggcagatttagcatatcaatcaagcacatgaaatataaggctaaatcaggtaagatcggctgaaaccccgatgctaccctaatcggcaaccaaaagcaagctagaaattgagattctaatcacgacttataaaatcaaactcaactgatgcagctataagtataaaaagaagaacaatattgccagggattatatagaatatatgataactcaacgaattacataaacaagattagggtatcataaaaatagaagcactaatcccgagaatgcaagccgccataacatgttttacctctagttgaagatcgaaaccgatgcagctcaacccgaaagcaagaactcgtcgaaacaaaaacgaaagtaaaagggtggcgatgacccgagattgtattaaacgtgtgttgttgtattacatgagactcggggtctatttatacccgagattgcaaaatatgtctgtgtcagacacgactcttatctctaataaactctaagataccataagtctttatggcagacttttgcccaaacatatctctaaggaaattacatgaaatatcctaattaatagatacaattgccttctcaggactcaatccatgcgtggcaatcctcatgaagcacattaactcaacccgacaacgtgtaccgcgtcacattgtcgacatcggctcaatcggccaacctagtctgactcaaactctgtcgatcctgatcatagccgattcggacttttagccgattctcgctctgtttccgaaacgatgtttatcttggattccgctttgttttatctccatctccgatacttggattactaaatttggttattaataaccgtaaaaccagcggcgtccttctacgtagctattccatcacctatcaaggtacggtaacgtccacgtcgcagtatgttgctagccacccacgcgtcggtctagggcttttgtctcggggtaggggcagtgtacagtctagtggtttcgtcaccgtgcatgncaactctacccctgccgtctggntacagctatctcctgcatgcaaatatactagaaatgctagtcagctgcgggctcctcgggcctccaagacccgtaggactcccactcggatccctatccgaattaagctcatattggatctccatccaatccccttattctggcccattgagcgtgcgaccctgtaggttcacgtacactcggctgtaaccagaaaactcctttacggtccaaatgtcaacagctgccgcgaccgagaaaattgccttttcccgaatgctagtgtattaatccccgtcccaggaaaagccggggtacaccaaacaaacatgatataaaaggcacatctttattatatcgataatatttacattattacaaaggcacttcaggcctgacaatcaaaaataaacagcagcggactagcgggcctacggctccatcttcacaggcgctcaactggggtataagccaagactccacctaagacatcttctccgaagcttctcttactgaaggggggagaaagatagagcaagaataagtacaaccacagtactcagcaagccacactggcaaatgcatgattaatgcaagggggtacaaggggtaataatatcggggttaagttttgcagtaaacagcatttaaaagtcacttagttgcccaaagccattttataaagacgatcctagagctacacagtattagtaatcaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaatttaaaacactaa

SEQ ID NO: 55624 - DNA, 9417 bp, Oryza sativa
ggtgaagggttatgtcacatgtttacgacgggttccaaggccatggaatgcggagtaaagatgtgtcttgtgggtaaagatgtacacctttgatcagagtaaatctattcgaattgctgagccctcggatatgggcaagcctagcaatgtacccaagttagtggtttaattcttaaaatttgcttaacaactaaaatgtggaaaggttggcctgggttggcttgggacaagctgggacccaggtcgggttgccagttcggtctgaatcatcgtaggccttgggttaaggcaggttcgtgtgggttcacggccttgattaataatattgtgtagctcttggatcgtgtttacaaaatagctttgggcaactaagtgacttttaaatgctgtttactgcaaaacctaacccctattattatccccttgtaccccccttgtattagtcatgcatctgccggtgtggcttgctgagtacggtggttgtactcattcttgctcaatctcccccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaattatatcatgtttgtgtggtgtaccccgtcttttcctcggacggggattaatacactagcgttcgggaaaatgcaaattttctcggttgcgacactccagcaccgaaggctcgtgttaatcatgttgcagcttcagaagcccagaatgcacccgatgtggtcttgggtacgtttcctgttaactctatacccgcatctgtgctttttgattccgatgctacacattcctttttgtctaaaagttttgcaagcaatcatgggatggaagttattagtcttgggagacctttactagttaataccccaggcaaccaagtatcttcaatgcagtactgtccttccgttactatagaaatagaagaaataactttcccatcctcactcatcttgctagaatccaaagatctagatgttatcttagggatggattggttatctcgtcacagaggagttatagattgtgccaaccgtaaggtgactttaaccagtagcaatggggaaacagtgtctttcgttgcgtcatcccctaaatctcatggtttgacattaaatcaagttgctttgcaagagatcccaatagtacaagattatccagatgtgttccctgaggatttgccaggtatgccacctgagagagacagagttccggatagacctagtacctggaaccaaaccctatccataagagaccatacagaatggcagctaatgagttagtagaggtaaagagacaggtggatgatttgcttcagaaaggatacattagacccagtacttcgccgtggggagcaccagtcatctttgtggagaagaaagatcatactcagagaatgtgtgtggattatcgagcgttgaatgaggtcactatcaagaataagtatccgctacccaggattgatgacttgttgtcacgcccagaaattcccaaatagaattccaagcagaatgtgcattaaaatccccgtccaggaacggctggggtacacaaacgacaaagttgacatacagatccacatcttacaaacattataaaaagtcttacataaatgcagcggaaaacttaaaggataactggagctaagccttgacttggtctacagcgggaacaccactccacaggcatcctcgacggcatggacgaagcctactcctcggagaaaccactatctgacgcatactcgaattctggggtttgggggaaaatagagcaagactgagtactacccacagtactcagcaagtcataccggaatatgggtatgatgtagggaaatatcaagggatagctataatggttcatttgcataaagcgagcatttataaacataagttgaaagcagttaaacagttgtaataattaattaatattagctatccactgtccaacgctatcccacgttgcaacaggcccaaccatccacctaaactatccaaattcaaaagattacactagggtgagactaatcacggtgaatctggttgaccgcccataaccgcgggctcggctattcgaatagttttactctgatcagaggtgtacaactgtacccacaagacacagccccacgacacgtttccgtgcgccgacatgccaccacgacataccagaaagagtccgtgacaggacccttcgcataaccccctctagccaagcacaccacacctcaggtttcacccccatccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgctgcccacgctggcttgtggtaagtacgataagttcttccagggcatcccgtgaaccggtccttaactgccatgggtgcgaccagcaaaaccatgcacccacagcccaccatgtgatttattttaattagccaacaccaaagcggtggaacgaaaccaacaaaaccattagaaccaacagtctaaacattaattggattttccccgctgtgcactagttgaactaagcatggctaagcaacccctagtccaatctctagtcatgttataaccccaagctgacaaagggacatggtataacaatagcatggctatgacaataggtaaacaccccatagtaacattataaatcaatgcgatatttgaagaaaaacaatagagcatttgcaatataggatcaacatgttcaagtgacaagcatgacttgccttgctctgctgctggaggaacctcggcgactatttcgaagtacaccggagcgtcggaagaaccggaatctagcgacatacaaggctaacattgcaaacaggctataagactactgaaacagggaacaaaaccatttttaatggattctacacatttttcttgattcactgagacttgaaagggcttaaacggagcacggatgaattagttatgaattttagaagattcgctgtgtttattactataacaaaaagtccttaaatcatttattgcgcaataaaccccagggctgtcgtcatcaagggggggcgggcgcggcgctggcaagcggggcccacacggcagcggcgcacgggtggtcggtctaccgtggaccgggaccacgcgggtggtccaccgccggtccacgggatcgacggcccggatcggcccggggccgattggacggtgcggcggcggcctggctcggctcggctcggcacaaagccggccggccggccatggcaagggtggcggcacgcgcacgtccaccggcgacggcaagcggcggcgcgggcggcggcagaggacggcgccctggcggcgacggcgaccgaaggcgacggcgagcgcgggtggcggcggcgcacggggaatcggggaaggaaaggaaaggggacggagtcctcaccggaggggacggcgacgaccggcgacgaggagcgacggaggaaggtcgacacgcggcggacggggaccgggacgacctaaggaacgaaaaggaaaagattagagagggagagaggggccatagaaggcgggaacgccggccgaaggcggcggacatggcgactctcaccgtcgcacagtgggaatggggctccggcggctaacctcgacgaaggaggggtggacgaggtggacctcggccacgcaaacccaacggcggtgacggcgcggtgcggcggcgaccctagcggcggctagaggcggccggagtagcgggagaggtggcggcgggtgggtgcacggtgcgggagcgatggagagctcgggagagaccggcggaaaaaggaaaagtgaagaggaggatgcggggatggattttataggggcggagaggtcgggaactgtcacaccctgaagttctcctcctaagcataaaattgaatttataaatcaccctaagaaaataccggtgcaaatcaagagaaaaccttaataaattaatgcaaataataatcggaattggcatgtggaatttttcttgagttctacatgtcgaaataccctaacaagatttttagtggaattttcagagctctcgaaataattttaaccaattaaaattgagcacatgcaattttaaatcccagggaaaatcttttcctccttttctttttcttttccctccttttcctcttcttgggccgtcggcccagtccaccccgccgccgcgcgcgccctcctccttgtgggccggcccaagccgcccctccctctctccccgggacaccgacaggtgggccccacctgtcggggtcgtccccttcctccggccgcccgccccacgtcgccgacaccgccgaaaccgccgccgcgccaacgtccccgcctcctccgggccacgtcggccacgcccgcgcatgcgccgcgcctcccgcacccactcctcctctctcccgctcgcgcccgcgcccgagatggccaggattcgaattccgaatcctgcctctctctccacctccacctccccgcgttggccggcggaatcccgcccctacccgccacgtccgggattcccctcccctatttaagctccaccgccactccctctctctttttccccatctcgccgaactccctcgtgccccccatcgctcctgcgccgtgcttccatccgccgccgccgctcccgctactccggccgccgctagccgccgctagccgccgataggctcgccgccacaccgcgccgtcgccaccgttgggttcgcgtggccaaggtccaccccgtccgcccctcctccatcgaggtccgtcgctgaagcccacatcccctcgcactccggtgagcaccacctctaccgccgccttcggccatggtttccgttcgccgtggtccacccctctccctctaatctctctctttgcctctcttagggcatctcggagctcgtgcgcccaccgccgttgtcctcccgtggctcgccgtcgccgttcgccgtcatcctcctccacgccggccactctcggtgaggcattccccctcctctattcccctccctctccctcctagccgcgccgggtcgagcccccgccccggtcgtgcgccgccgcctctgcgccgccgcctttgcgccgtcggttgccgtggatcccgtggaccggtgttggaccatccgcgtggtcccggtccacggtagaccgaccacccgtgcgtcgctgacatgcgggccccgcctgtcggcgccacccccccccttttgatgacgtcagccccgggacatattgcgcaataaatgatttaaggactttttgttatagtaataaacacagtgaatcttctaaaattcataactaattcatttgtgctccgtttaagcccattcaagtctcagtaaatcaagaaaaatgtgtagaatccattaaaaatggttttgttctctgtttcagtagtcttatagcctgtttgcattgtttgctttgtatgtcgcttagattccggttcttccgacgctctagtgtacttcgagatagtcgccgaggttcctccagctgcagagcaaggcaagtcatgcctgtcacttgaacatgttgatcctatattgcaaatgctctattgtttttcttcaaatactgcattgttttataatgttactttgggatgtttacctattgttacagccatgctattttgataccatgctcctttgttagcttgggttataacatgaatagactttggactaggaattgcttagccatgcttagttcaactagcacacattggggaaaaatcctattaatgtttagactataggttctaatggcaatgttggattagtgacaccgcttcggtgttggttaattaaaataaatcacatggtgggctgtgggtgcatggttttgttggtcgcacccatggcagttaaggaccggttcgcgggatgccctagaagatcttatcgtacttaccacaagccagcgtgggaaacggctgggcttgtactgtagcttttctctagccgacgcatccaggcaagggtgggcgtgatggagtttggatgggccctgcgacggcctatgcggcttccggattcacctaggcacgagaggggactgcccgctgccttgcgaggagtgggagtgaaacctaaggtgtggtgtgcttggttagagggggttatgcgaagggtcctgtcacggcctctttccggtatgtcgtggtggcatgtcagcacacggaaacgtgtcgtggggctgtgtcttgtgggtacagttgtacacctctaatcagagtaaaactattcgaatagccgtgcccgcggttatgggcggtcaaccagattcaccgtgattagtctcaccctagtttagtctaatgaaattagatagtataggtggatggttgggcctgtcgcaacgtggtatagcgttggacagtggatgaataatatgattaattattacaactgtttaaatctttcaacttctgtttataaatgctcgctttatgcaaatgaaccactctagctctcctttgataattccctgcatcatacccctattccggtatgacttgctgagtacagtgggtagtactcagtcttgctctatttttcccaaccccagagtatgagtatgtgtcaaatggaggtttctccgaggagtaggcttcgtccgtgccgtcgaggatgcctgtggagtggtgttcccgctgcagttctagtcaaggcttagctcctgttgtctttcgtttttccgctgcatttttgtaagacttttatgatgtttgtaagacgtggatctgaatgtcaacattgtcgtttgtgtaccccggccggtcctggacggggattttaatgcacattctgcttggaattatattcgggaatttctgggcgtgacaatgttgatcaggcggtatccgaattgagtgatgccggagaaaaaacaccattggctttacccaagcaaactcctccaactcttgctgcccctgctcacttttcaagggtaaaccactcaccttgattccctcttacaatcatttattcatagccgatcacttataaatcttgcatttgcagaaaaagaagactgctgtgaagaagaaatcggcagcagcaccatccaagccagctccaccagtaatattttcttcatgaaattttcaagtctaatcataacccatgtggactaacacttgtcttttcagcctcctcctcctccttcacctcctatacagcaaatgtcaagtgaccgaactccatcggctataggaagtcataatattgaggaagaggaacaatcagccgctcctgccatcccagtaagtctttcattgtcttaacatcttatatcggctgaatctgtttgatcttcaactgtcttcaaatctctcctttgcatgtattaaccgatctattctcctttgacatcaaggattactttgatgaagaagcagaagaagaaaccacaagtaaggctctagcccctctcgatgaaactgtcaagaaaacacttgaagatatatcccttcggctagagtcatcattagataacctggtggccgactgtagttcgatccgggcacgatttatagaaatccaaccctaatcccacattatctagtgaacaccatcactccagcgatgtacgttgagcaacatcaattcaagctggaaaggcctaagcaacggatagccgatcggcgggagcggaaggacattgaagcaactatccaagccaatcggcagcttgtgcaagaagagtgtcacgtcctgataaattcatcccgaaataaaaatcattctctaaaaggaacaatagaattaattaaaattcgaaaagaaattgtcaaaccttaaaatgcgtacaagaaaaatttgaatgtggcccggagaattttcgttaaattctccttggtctaaaatgagccctcaaattttagttgaattttcagaacaccggaaataattattaagcaacaacaacaattatcaaagtttactaaaaagaaaaactaaaaataatccttcttcctcctttgggccaagtctggcccaaagtctccctctctccctcggcacgctgtcgaagtctctcttccctccctctcgttttcctttcccatctcactctcgggccgcccctccctcctctcctccccggcccactccctcctatcctcctcccgcctgggcctgccctggcccaacccgagccgcagccctcccgcgcacgcgcgccgcacgcgcgctgatcgcgtggaccggtgggtgccacccacccggtcgtcgtcctcctcccgcccgactcctccctctcccatgaaaccctatgcgtttcgtccttcaaatctgcgcgaatcaattcccttctttccaaattgattagggggaatgacccctttccttcctcttcaattccccctaatttcccccttgaatggcgccattagtcacccggaacggccgcgtgtcgcgaccgagaaaattgccttttcccgaacgctagtgtattaatccccgtcccaggaaaagccggggtacaccacacaaacatgatataaaagacacatctttattatatcgataatatttacattattacaaaggcgcttcaggcctgacaataaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagtcacaccggagatgcataattaatgcaagggggtacaaggggataataatatcggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccaggtcgtcccaagccaacccaggccaaccattccacattttagttattaagcaggttttaagaatttaaaacactaacttgggtacattgctaggcttgcccataaccgagggcgcggctattcgaataggttttactctgatcagaggtgtacatctttacccacaagacacatcttcctcacgtgcaaccacgtgccacataccaccacggtatacagaccgaagacgtgacatagtttccaacccatcctaaccatagacaagaataccgaccc

SEQ ID NO: 55625 - DNA, 1081 bp, Oryza sativa
cccgctgcgaatgccgacgacggaggcggcgccgcgagacgacgagccggcgaggatgaacggtgaagacgacgacggacaccggcggtgttcggccgaaggggaagcgatgccaaggacgacgtcgcggctgcgatgccgaaggtggtggaggtgcggccgaccggtgcacgggcgaggagggacgggcggccgaacaactccggtgaggcggatcgaggggttggtggcgacacggcggtgttccggcgaaaccgagttgtggccggggaaggagacgatgccacggcgtcgacgaaggagacggcgacgtcggccgacgctccgacgagggacagcagccggctggagggagtacagtggcaccaatgccactggttgccggcggggacgcgtctccggtggtctccgcgtgaaacggaggcgacgccggtggaggggaagcagctgcgacgctgctggcggcgacggcgcgaccggatgacgctccggcgaggagggagaagcggctggaggcagccggcgcgaaggaaagagaagggcgacggcgggaacgtagctccgggggtctccgcgggaaacggagggcaagccggcgaagaggaggcggctgcgatgctggaggaggcgacggcacggccggccggcgtgctaacgcggcggcaggggcggctgaagacggccggcggcacgggagagaggggacgacggcggggaggtggctagggaccacgggagagctcgggaggagactaaaacggtagaacgcaaagagggggttctattttataggatgggggagggagccgggcatgggagagggcggaacggcgacgagaagcacggccggcggccatggttggtggccgggaaaagcgcggccgttcctgacaattgggggcgccattcaagggggaaattggggggaattgaagaggaatcaatggggattaaaaccccctaatcaattttggaattggccaattgaatcaagcggatttggaggagggagcgagctagggttcgcacgggagagagagaaaccgggcgggaggaaggagacgaccggggggctgcagga

SEQ ID NO: 55626 - DNA, 1572 bp, Oryza sativa
attcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctcctttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctatttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcagttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcc

SEQ ID NO: 55627 - DNA, 7789 bp, Oryza sativa
aggttagggtttttaatattgaatttattaaaatactaaaatatatagtcaagaaagaggatctagaatatatctagatgtgtatgtttatttatctatattctatatttaatgtaattctttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctcttactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcattcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccatgtatgtatatacatgtatgtatatatatacatgtatatatatatgtatatatatatgtatatgtatatatatacatgtatatatatatatgtatatgtatatatacatatatatatatatacatatatatgccataagtgtggctctgataccacacttatgcttcggacaaaaaacactgttcaaaaacactatttattcggctgaatactattcagtttactgtttattcggctgattaatattcaaaaacactattcagtttactgtttaaattactgttcaatactgttcacttcgagagatattttaactttaggatctttgcagggtggcgaatcctatttagacagcctcagaagcttgcttcggatgatgtaaagtcctactcggtactcaccgtatgcctcacctatctatctttttagaagcaacttaaaaagatattccaagtcacacttgttctagctaagagtttatcgtctccccaggcagttccacccgaagggaacacttctctacggataccgattctccagacgcctatgcaagatgcaggctaaaaacgagaacaaaccgaagaggtttctcctatagggtccttagcataaacacttgtctagaacaaacgtgcaggaatacttaaggaaaattacttcatattaaacagataagcttacatacggttttccctttcgggaaacccgaaggtaggtacaagcaagctgttcttaccttacacagcgttattacacaactccttgcttcaatatactatacaacgtaggctaaagtcactactactaagaatggtggaatggagggtgagagcgcgcttggaagctttgctctgaatggtgtcttcgttgttctttactttctttactctagctaattctctatagaaataaagttttttatctcttattttaggccactcacacttcatagagttattatattcttcatttatttcctttaatttattttcgtaatattttatctcactttcttgatctaatttttccataaactctgaaacactatgtcttctattatctattatatttctatcagatgcttctgtttctaagtcatctgtggttctgggtttgtaatttataaatctaatgctggtatttcctttactattttgataacttataaaattttcaggctgactcaaagttttgctttcaattaaatcactaattttccattcttctcctgccctttcttcagaacttatttttaaagggctcatgaaagttattcccttagagtgcatattttcaatcacgtcatttacatttattttgtatttggaggcacttctattagttaatcttcctataaattctatgcttactagcaaatttgttcctttaaattcctcgtatccctttgtttgaaaaccaaaactcattttatctataaattcttttacaggcatcattagatctggggctatatatgttatcaacatattctcattcatgtcaccttctaaaaatcctaatgctgctttatctattgtgtcccaccttttatctaacagagttattaaaactttagctcctaatttctttcttgtcatacctttgattcctattatatacataccttggtgaatatatttataccctgaatactttaatccattttcaaattccttggctacaatttttaactcaactggctttgttaaaacgcttaactctacttctctagatattctgtataacccatttttattctcaaaaaaaattccatgcaatatatttgttgaggtcttattgccctcagagtatctctttgatatctttcgagctgtttgtctacttctgcaatatcttcaagctcatctatgtcttcatttttacctttttgtttatcaatacagcttaaagatttatcgtctctgcttgctattcttctaaacaaactcctagataggtccatttttctgaattaatagcttgagacgaggtaattatgcctgttgaagccaaaactatctcttttcctttactagaatttattatttctaataattctttgatatagtcactgttttgtaatatcttattctgccttatcttataatcctctagctcttttagcactgaatttaatttattactgacaagcaaatattgttcttcagattgctttcgttctttaaacaaatcttcaaaccttcgctctaaatcttcctgctttttatcccaatttatataaaaattatatatcagatcaacaattaaatttaattgactattgttagagtgccaactatggtcttcaatgtgatttaatctacaccttatattcagattatctttggtagtaattatctttccaatattagcttctgaatttgatttctctataatgactggctctgataccacacttatgcttcggacaaaaaaacactgttcaaaaacactatttattcggctgaatacttttcagtttactgtttattcggctgattactattcaaaaacactattcagtttactgtttaaattactgttcaatactgttcacttcgagagatattttaactttaggatctttgcagggtggcgaatcctatttagagagcctcagaagcttgcttcggatgatgtaaagtcctactcggtactcaccgtatgcctcacctatctatctttttagaagcaacttaaaaagatattccaagtcacacttgttctagctaagagtttatcatctccccaggcagttccacccgaagggaacacttctctacggataccgattctccagacgcctatgcaagatgcaggctaaaaacgagaacgaaccgaagaggtttctcctatagggtccttagcataaacacttgtctagaacaaacatgcaggaatacttaaggaaaattacttcatattaaacagataagcttactgattatgaattttctttattccggacatgtctgtggaaacttctgccttattgtcgtcaattgtgtgaactatttcaggacatcttgtgaaatatttgtcatgaataatattctttgtacacccggtgtctactagtgctaatattttataagatactttgggtgtcaattttattttaacagggattcttatacctaatatttctttgaaaggcaatcttactatatatttatttccaaaattagttatggcatctcttagttgaattattttagcagtattactgtcgtttagtgttatcaattgctctttaaattcggtgtttggtatgtccttattttctggtaatgctttaatatcacaattattttttaggttctctaattctacttctagtttatttagtctattttctaacactcgtactctactagataaagtcttttcatctgattctaattctatttcttttctccatttttgtttatttgcttttatacattcagcacaagcttgttttagacatatactacaagtcactctattttcttgactagggtaatatatgcaaaaagcacatttgatattatagtcaccctttcctctaatccaatcatgttcacaatttaattgatccatcatttcaacctttagacctgctaattcgtcaattaaatctaactcttcatcggatgattcatattcttcgttgatagtttcaacttcgtctgtttctatgatagaatatattgattcgtcatcttttatttcatcatcacatactaatatgttttcgtttacgctatctataattagaaccctcccttgttcttcatatttactagaatatctcttttgatctttatttgggcatgttctacttaaatgatctggcgagttgcatataaaacatctgcatgttttgtcataggttttctttggattatatcttcttacatttcttttatgtaagaagggtgctctattatctgatcttcttaagaaataccttttctttgttctaatattattgttgtttctaggcttgtcttctccatatgacaagggtatttgaactattttattgcagaaattgtaatccgagtgtttcatagatctttgggcttggatacccgtgcatatttttcttagttgcttaaacacaa

SEQ ID NO: 55628 - DNA, 727 bp, Oryza sativa
ctttgacatgcttatcttgctctttcctctttatctattctatcttggtttcttggtttttaaaaatttctactgccatatcttcgttcttctttatgcatcttaaattcttctatgtctttcggagttgcttctattgggctagtcttaatgatatattctgggttgattatattaattttacactcaatagcatttttctcccaatatttcataggaatttctcctataatttggatatcttctaatctttgaataattttttctatatcccttttagacttaatatctctataccaatttggtgcaaatgcttgtagtcctatgcactctatattggaatttgatatataatagttgtctatattctcactaagctcatattcattaattctttcttcagactcaagattaggtacttctaagttgtcgagtttgggggagactccaccacgctttcgtacctctgagatatatggaacattattttgatatgggataaaagtaattccttgctcatgtattactgtggtttgtactgattcttgaaggaaccttaagccaattatcatgtcatcattaatcattgacaaatctcttattgtaatctcatctattatatatttagttgcattaatgtaaacctccatattatatacatgtatatatatatgtatatatatatatgtatatatacatatacatatatatacatatatatatacat

SEQ ID NO: 55629 - DNA, 1268 bp, Oryza sativa
gtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtggcttggaatatctttttaagttgcttctaaaaagacagataggtgaggcatacggtgagtaccgagtaggactttatatcatctgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttttgtccgaagcacaagagtggtatcataagtgagtcacaagagtcacaagagtggtatcagagccagtcattatagagaaatcaaattcagaagctaatattggaaaggtaattactaccaaagataatctgaatataaggtgtagattaaatcacattgaagaccatagttagcactctaacaatagtcaattaaatttaattgttgatctgatatataatttttatataaattgggataaaaagcaggaagatttagagcgaaggattgaagatttgtttaaagaacgaaagcaatctgaagaacaatatttgcttgtcagtaataaattaaattcagtgctaaaagagctagaggaatataagacaaggcagaataagatattacaaaacagtgactatatcaaagaattattagaaataataaattctagtaaaggaaaagagatagttttggcttcaacaggcataattacctcgtctcaagctattaattcagaaaaatggacctatctaggagtttgtttagaagaatagcaagcagagacgataaatctttaagttgtattgataaacaaaaaggtaaaaatgaagacatagatgagcttgaagatattgcagaagtagacaaacagctcgaaagatatcaacgagatactttaagggcaataagacctcaacaaatatattgcatgggattttttgagaataaaaatgggttatacagaatatctagagaagtagagttaagcgttttaacaagccagttgagttaaaaattgtagccaaggaatttgaaaatggattaaagtattcagggtataaatatattcaccaa

SEQ ID NO: 55630 - DNA, 1073 bp, Oryza sativa
agagaaaaagatatggagaaggtactgtgaaaaacgaaggagaaagagaaagaccagctagggcagcaggaaaatggccccctgatagagaagaattttcatataactatataccaggtcaatataggcatatgggtacaaagagaagagactttgagaagcctgttaaatttcaaaaccagaggagtgatggtgctatattaaatttagccgcacatgaccctattgattggcctaatattattagtatttggaaaggtttaatagttcaaaaatatatacaaaaccagcacaatataggaagtaaagttgaagatatgataacctacttagaaacatttttaggtgaatctgctaagattctatgggaacaatgggttgaaaagaatcctaataattatgaagaattgaaaagagctggtagcaatccgcataattttgcaaatgttatatctaacattattatagctgaagatccggaattaggttatacaactttgcaaaatgaaaggttaaaagaaatagaaaaattaacgttaacaagttggaaaggcataaaagaattctcccaacattatttatataatgctacaactgctaaacaaggatataacaggggaatagttgaacgttactttaataaattacctgacccactaggaagtatgatatttgaagaatataaaaaggaaactgaaggagctgaaatcaatatctctcaagctataacttttgtgtttaagcaactaagaaaaatatgcacgggtatccaagcccaaagatctatgaaacactcggattacaatttctgcaataaaatagttcaaatacccttgtcatatggagaagacaagcctagaagtaaaaggatttataaacatcaaaatagaaaccataataatattagaacaaagaaaagatatttcttaagaagatcagataatagagcacccttcttacataaaagaaatgtaagaagatataatccaaagaaaacctatgacaaaacatgcagatgttttatatgcaactcgccagatcatttaagtagaacatgcccaaataaagatcaa

SEQ ID NO: 55631 - DNA, 1136 bp, Oryza sativa
  unsure (1)..(1136): unsure at all n locations
nnnnnnnnnnnnnnnnnnnnnnnnnnnnnnnnnnnnnnnnnnnnnnnnnnacacagcgcagaagcagctgaatagatttaggatatcctctacatagccagatttatcaattgattaattcaagaataacatatattcactgggctggggcatcttgagaatattttcccaaaacaaatttctcttgcctaaacaaaaatggacatgtgtggctgaatgctcagcagaacagatcagtccacaggttgatcgatgctgccaaaattcttgccgtcacaattctgtatatgatccattacacaaaggatagccaaaaggcaaaagcaaaggtctacagcaacgaagaaaggaggcctacacatacatgaaagcaacatggataaggactaaaaaagaggggaaaaaaatgggggggtgacatcttgtgtcacccggagcaagcacgcatgcacctggcaacttcttggcaagcattttgcaccatgcatacaggtattggattggatgtccatgtgatgtgaggcagcatgccctccacaagaggtagatcattgcaggccacagggcatggcaaatcatagcaacgtgaccaaagaaacgaaaaggctgtagccacaaatgttgaccttgtaagctgaatcctcgtacggcaagggtgatctttccagtatatacagcataaaagtgcacatatggtgtatttgacatgcgcaaccggtagttgccctcatcatttgacaagaccaggagaaacctcatgcttcaacttaatcattggagatacgattgagcagataagagcatattgtcctttttctaagtatgcgcactgatgcagattcagaacatttggtctctgagctgcacaaatttatatacccatgaatcatgaaactggagcaatctgaagttcctgctgcacaagatttttcttaactgtgccctcagttggtaagattccttacatgggaaaccaaacatccgaactagcgaattgtgcctcagaattcaatgatttaagtggattttcatgttggcaccatatgcaagaaaagattccaagaactcgcacgcttcttttgcttcctttgtgtcatatcactcacggttatgtgtgggttagcgagcaagccttc

SEQ ID NO: 55632 - DNA, 15412 bp, Oryza sativa
ctagaactgtggtcgacatgtgaacatctagactgtatcacttattgaatcagctgaactcatagcatcacaaacaggtagcttgttctcaatactcactcgacaaattgggcatgaccggcacttatcagagcacgctctgcagggccaacaaaaagaactttagaattccacttgcagttaaacagaaacacacccaacatgtagcaacttgcaataatacataaatatatacaccttgcaagcttcagacgacataacatgtgaaacatacatgaatcagtgattgccaaagaagcttactcgcaaagaacataatggcggcatggaagcagaactatgcaaatgtctctctcaaagcatatccgacataggatctgttcctgtatttatatagaaaaaggttcttgttaaaagtaattgaaatcgaaaaagcacatcaactcttttatggatgagatttaacagcctaccactcatgataatgattcaatattaaaagaaaataaactccaaactgcaatactagaaataatattatataggtgcagcacagaaccaaatcaacctagagccttgtgtatcactctatttgaaattggacattgtagaatgctttgtctgagaagtgagaatggaaatgagtagtacattttttagcttatcacactgctgttgactaagcttagccattttggtttgctcccccaaagctaattgaagtctctgtacctgaaagtgcaagtggttaattagcccaatgcaaataaagaaactgttactgtatgtacagtaaaacaacctctttgacaagaactttcttcggcatctcttttaccatctctggtggatagctgcaaaaggtactatacctgcatggataagaccaagtaataaaacaattcagctaccgtggaagcatttgcagtgcgtccaatgtaattggcataccttgttgattcctgagtgattacctatcttagtgcttctaatctaaagcgataagcatagcttgttgaatgatgaatgataagctaccttgttactgaagtacacagtacttttaaatgcaaatgcaaaaaaagttactttttcgtaatgaagaaagacctagcaactctggaaggttaacattaaactgtgttgtatctagaaacttgttttagtttagtagtctttctatattttggagcagttgacgttatgtgggatctcccaaatttgattaatgcggatctacatgacaagttcttctaaactttactcttgccatttttctcttcaatctctgagacaaaaaccatctgtttccccacgatgttatttcctggaatatttgagcccattgccctaccaaacgaagaaagaaacacaaaaccaatatggcaaaatagatgttaacatgatgttgagttggtagtttacttcatgtgtccatatagcattggactcaaacatcttatgttctctagctattcatagtacatcccacgataagatcctttgggcagtccaggagggaactatggtcctcagaagaagcaagtgtgtagcatactacgaactttttttattatttaaaccattttattttaatattttaaaaataaactctttacaattttatttttaaaaatgaaccttttagccacgccagtaatattggcgtggcgtctaaatactgccacgccatccttattggcgtgacagcactagccagcgcggcatgagtgccacatcagcaaagctgccacaccagtgatgttggcgtgactggtgcatgttgcaacgcctacagcattggtgtgacgagactaggcgttggctggcgtgaacccctgatgcattgtttggtctatgcgtaattagttaatgacaagattgcactaatacacaattatacaaagttactatttacatgcacgtataatgtggacggcaagtcccaatatccctgcatgcacaacatatataatacagatatccacactaatctacaaaataacaatgttctatattttcttaatttggtggtttcctatcgccatgaatggaattccgtcgtcatggtagtgtgttcagattgtttgataatcacttttttgagttttggaatggatttggtaatcatctgtactacgctgattcatagttttgtaagtgctatcttgtggagtgaatcacaactaatataattcagttacttataacattaggatcttcatgcaagttgcgatctattttgttaatgcaaacaagagctgcacatctttttatgagacatttttatgagctgcactctcagcaagttgtcccagccaactcaaggttcgtcacaccaacactctaggcgttgcaacatgcaccagccacaccaacatccatggcgtggcagcttgttgatgtcattcatgccacgctggcagcgctatcacacccgcgaagatgtcgtgacagtattcggacgtcacgccagtaaaaactggcatggccaaaaggttcatttataaaaataaaattttagagaatttatttataaaatattaaaataaaatggtttaaataattaaaaaattccatactagcctagagttttatcagcaacatgtggatgagtcccgtggttgggggattgttattcagcagagcacagttagaatgtgctgcaattcatcaccacagcaacttttggctagcctcagtaagctgatagtttccttcctaatcttcaaaatttttggtagactgagtttcaagaacctacactttctagtagtaacaacagcattcaagaaacgacaaaaatgtctgtcaagaaagaatatgggtactgtcatgataagcgtaagcaagatgcaattaggaaaaatttagaagagcctacccagaattatttgcatagcataaatgagcttgctcctctttgctatcttcatcaatagaccaccaagcgatgagcctgcccagcaataaaatcatcaaatgagaattccatgtccagcttttatgtattgtaatagatgtgcaattggcctgagccctgaactactaaagtgatactggatagcaataaaaccttgaaccatgttgcatcatcataaacaattcatcaatctttgatgagaaagaaatatatccgtcagtgatctttttagctcgtaattttgtaacaagcctttcaaagaatatccaaatagcaaacgatacagtagtcacttgaagcaaaagtataggtaagaaaacagctcggagtgggaaaaattttgcgttagatggagtgccctgcaaaggatccagagaaaacaatggtcagttagactaaaagctgtgaactaatgatatatcaacacagaaacaggaaaatggatagcaaagcagggtctgccaaacaattttgaaggaaagaacattatttagtaaattgagttcaacagacctctaggcgcatacacagaagaacttgaaaaattacaataggaattattaatatagggccaccaatgtcctgcagatagcttgtctaaatcagtatcccttttggagtaaaatggaacactgttgttccagtatcagtctctgttcatctaagacaaaaatccaatttattggtataccattggattagaccatctcgtgcagacaagaaagccaaagcactgcgaaatcctgtaaagaaatgtcaagaagaaatcaaaggattattccttggggttacaagcctaattttaaaaggagagaatattacccaaaattaatgaataaatcccaccaccccagagtaactgcatctcctgtagcacaaaatataacctgattatgaaaagcttctacatggaactctgacgcatgagttatgagtaagagtttcgatgttcctactttaggttggttatgcctactcatttctataaacatgttagtcctcaaaaactctatagtgcggaaaacaaaaaacagctaatttcatgcaaaggagaacggcatatattaggccagtgacaaggttcaggaatatctccacgagaacaagcatgcttaccacacaacttaagaagcatgagtgaagtagccgctagtagaaataccatggaaatggcaacccagaagtgctaagaaaaataggaagtcgttagtaatgactacatgcagcttaagtttgtataagattaatctagttctcatctgtaaagagttcaaagcaatgatgtcccttgttactatatcaaagattttattgtagcaagggtctttgtatattttacagatttacagctccatatactcataaactcaattatgcagtatataaatacacaatagcaagtcagatagcacattggtacaactatagatctctttgatggctgttaggtgtgatgctctatgatggctgttccttgtagtaggaaacaataaaacaaacaaaagaccctcattttgctggctttattagagctctaactgaactgtctcgtgtgcgaacttgtaaaactggcaacccgttgaatactctgttaccctttagtgcttttctataaaagtaggctgttaggcctatggtctaaaaaaattgctatgatataatattatatctggtcaatgtgtattgatagggtatcgtatcccctgaattttaaattgcactgaacaacataacagagaatatgcaacttgtcccacatgaaaacaaagaacagagaatatggaataaaattgcatgcaggcgaaggttgcgacttcagggttaaatacagtacataaaacaccaaaataatgcatagttgattggagctccataattggctccagtgcaaccacacaaaactatctattgtataacttctgtaaaacataatttgattagcagtattggagctaaagttctcactttacatggtggaaagttaaagaattgtaagtgcaatgtagtcttataacttacaggaagcctctcccaaattgcttcatctgtcatagtctctccatgtccaggcattagtgcaccacacatcctatatagaatacataatatattgttttaaaaaagaaaaaaatataacgatatttacaaaagtatactctataacgaataaacagttgaacttttctttacagcacagtttatgacaaaataacaaatgtttcttcaaaataagtctgactctgttttcacaaactggcttcaagttgatgtagcatttctacagagtgacaatgtacatgctatatcactaacaatcaaactgttctaaaagaaaagttcatcagattgcattatcacaatatagtacttagctagggagtaggtaatcagaagtcacaaaagttaaaaccctggagaagtacgaggtgaacattagaaattacttgtcaaaactaaaaaagaaataaactgtggtgcataatttcatcattttgcactgtgtactcagtacagttaggcaattcatatgttaaatttaggccaatgaacaccaaccgttctgtaagaactgaatttatgttccccaacaccaattatatcagccatgatatgtctacaagcaacattttgataatccataactccatatggcatatatccaaaaacatatgtaagaacctatgcaaatttgcactgaagcactgtttgattacctgaaattgtcaacaagtgtaatgatttccaaagctaatagtggaaggaatacaagctttaaatcaataaaaggttcatcatgacctgaaaatgatgaaatgaaccatttgcatggcaagtgaataactattgactttaaaaggtagacgaattcacaataagctttggatttgccatcaataccttccagataaacacatagaagcagctcaaaagcaactagcaatggtgtggcaacaatggaatggcaggaagccatctgtgcagtttaataatccgattaaccttctgctagtcaggtatacagttcagaatctatgaaggtatgaaaatgaaaagtaggcagtgaatctacctgacaactttgtggtgatgaaggagcaggtaacgaaaatctacatcgagcaataacagcatggaacaaccatagaggggtgaatagcaccctgcaggtcaagcattctgtcaatcccaacatgcagagaatcaaatgtatcacataacaagtcaatgaagcacgaatgagatgcaattgttattcaggacccaactttagaggaccacttgccacctagttttcctgtaatggccataccagtctctgtagagctatctgtgtgccatactaactggttcatccatatccatgttgcacaatactataagttgtgtagccaatgattcagtcacatacaaagagacacacgcacccaaaaaaaaaaaaagacaaagaacacacaaaggtttctggcaaatcacactcaccagattagtgtccatttctcaaaaacaaaatttactccctttctcaaatagttctcatactaaaatgcatgcagtaaactttgacaactttgggaaacctccaaaaccaagtataaaaaacatagttccaattacgtggggtagctgatgaggactgcattcacctctttgtctcctgatcttacactaacagggtgtggggaatattgaaaggctggataggcattcctcttcagcttcccagtgaactgaacgccgagctgcaagagcgtggtggatgttggcaaggatgtttttccagccgagctacaggaagtcatttgacactctcttcatgttggtttgttggttaatttggaagcagcgtaatgcaagggtgttcaatggccagtcgcgcacagcaggccaattacaagacatcaaagagttcatacccatttggggtgtttaagaatgacaatgaatagtctcttttagttttacatgctgggagtgctggaccctgtttttcgacatcacatcgtcgataaatgtgtaacttgtaactgtttcccacaaccttgatggaattggtcggccttcttcagccgggcccggcaaaaaaaaaaaaaaaaaaaaaacaaacaaacaaaacatagttccataccctgctcaggataatgtgcaacagctaacaacaacaaattaacccaacaggatgttaacaataacctcactcagtggctcagctgaaggactgaatcgcaccaaaaagggcacgacgtgcgctatatgcagattaggattccatcagatacgcacgatgcatctatcgcatccaattatatcctaaaaaaataagaaacgccatcactaaaaagcgcagcgattgcacaaataaccaatagaatataccacacgtccgcacctactcctaactcgcaattccacaacgagccagcacaatccaattattgccaaacgcgaggttgcgagagcatttctagcgggcggggcggggctagatgaagcgaagggagagggtgggggggaacagggggggggggggcggcttttaccaccacgagccgcggaagaggccgtcgagcttgagggcgaggagcgcggtgaagcagagcagcagcgcgtgcgccgccgcctcctgccccgccctccacacccgcccccacgtcaccggcgcgccactgctccccagctccgcccccgcctccggcgcgcccccgccaccgccgctggtggtggcggcggctccccgcggtgctccggcttccattgccatcgtgtgcggagtgcggagggaggagatgtgactggtgtgtgtggtggtggacgtggcctcgccgcggtgatctggaggaagcggagagcgatgtgggggcccgtgggcttccgctcgtgtgcgcgtcagcgtcaagcccacggaggataatatctacctttatctgcacttcacttatcagtttttgcacaaaatcatttgagattcctccattcctaagaaaaagtattgggaaattatatggaccattttcatttgttcctctgtaagtatttacttatttgtattatactgggtatttgtctttattcttatggggtgtgtatttgtctttatgagtattaggtgttggaattaatggataggccttagcccactcgaagattaattctggaaaatcataaaatcccacctcatgggatgacatgcatatggagtttagtactatcttacttattctaggagaggggacctccttaaaagggatgatgcactccttgccacttgaagcacatgtgatggagagaagagggagaacacacgcgcctcgcctcgcttggcagggcaggcggcgcgcgtgcacgacgtacacgtcaaatggtgtggattcattgtatatattttgtatattaggagtatgttactaggtagtgcatctatggctaagaacgacagttccatcactaaatggggtagagcgtcgaatggtgtggattcattgtatatattttgtatattagatgtatgttactaggtagtgcatctatggctaagaacgacagttcgatcactaaatggggtagtgagtgtcaattgtgtcatcatcagaagacactttgatagtgccttttgctttctctgtatcaatcagatactcgcgtactaccacattgtcgtataccctctatttcatattataagactcatagggagagagtagtattaaccaatgcatggtcacatgtctagcactcattcgcggacactgagtatgcataaaatggtgtcacacttggccccataaaatggtgtagaaataagtgaaacgacatatttataaataaaaattaatttgtgaataaaatatttatatacatgttctagcgatctaaaagcaaaggctgaaaaataaacttcaatgaaaaaaccctaacaacaactttaaatttaaaattgaaaatttaaattttaactgataagcataacataagcgaaaaaataagaccgattgcctttttttttaatagaactagagcacctgtgttgcatcctgaaacagcaaaggcacataactttcacattgacaatactcagcaataagacatttaaatttcaggataacaccgtccattcagaaacaatcaaaataatatatatacaactcaagtacaaaaaattgaaattaaggaatagtaactaatctaaagggttcaacacatatattttctgttgggatgtggcagaatttccacagaacggcaagattcatgtctcgtctccattcctttcccgacaatagctaagctaataacaaacttacaagcaaaaggagcacaacaaaataaatcaagctagcatgaggcctcatgatttcaccacaagcaataatgctcgaaattggcaccaattaccccagaaatttactgggccagtatgatctctctacaggatacatcagccattcaattaaaaattggctactcatcgtacaccctacagatcgcgaattttctctactgtacagtatttcttacaaaaggtgacccaggcacaatatgattctctgccaactctcttcaaattatctttgcagaggcttgactttgatcctaatcttagtagttgtcaatgtccgtgtagtatctactggcgtacccacatttgatatcttgggttcaggaattcgcattggagctggtggccttgccgatgaggttccttgcgagtctgaaggtttcgctgtgttcttctgttcggaagaagaaaccccttcaccttccttctgctttttgcctttttctttctccatccttttcttctctttcttaagccgttttttctccagatactcaggatcatctttcttatctcgatgccgctttttgtctttcttgtccttcttcttctccttcgtttccaatccattcatggagtctggggcttgatttccatcatagcttgtggagactacttctagctgactccgtggcttgtctaggacttcctgtccattaacaacgggagagaagtgatccttggggagagcatctagcctggaatcggctgtgcactgtagctccttggatacttcatgcttgtccattagtttgacattgccaatgcttgctgacatccttgattccctatcgtggcaagagttttgttccctatcatggcatgagttttgctcctcgatgttatgattacttacatttactggttctggtgcttcagtcataggtgcatccactgacatagagctacatggacctgcttcattttcatttctaccatgtgaatgatctctgtgatcagcatcatctgctttactggatgatgaagcacgtttaacccttattttgacaacattccttctctcactgcagttagatatattatccgcatcttttgtgggtatagaaataacattccttctctcactgcagttagatatattatccgcatcttttgtgggtataaaaataacattccttctctcactgcagttagatatattatccgcatcttttaagggtccagaggtaggtaagacttcacggacactaggagtgctagtggaaggttcttgaggccttgattgttgaggaactgaggaatcagctttagtgtgctgatcactagatatctccaggacaacttgaggtggagtgacaaccttcggaactccatgcagtgttggagacctgagactcatggcatgttagtatagaagtacaaatgataacatagtgtaacaaaaagttacaataagtaaaaaccaatttcagtgttgcaaggcatgtttgatgacttaatgttttgtgtttgtgataaactgaaattaattggaccattcgttattcgacaacataggattgtttggggacagcaatatccagtcggggcagtgaactgcatgttgaagatgaagcactactgatctcatcttcttttttgtctaaaaaaacaacaagcaacactactgatttttttttcctacaatttgaccaaccgcagaaaggagtcacataaagggacactgacaaacaacgcagatctgctaatgttggcaattccttatacattaggtagttgaggactcgaggtttaatatataaaggcaacaaaacacaggtctacttaagggagaggtttcagtagaagttcaaatcccgcctacattccatgacaatctagagggcccattgtggtactcatacatctcggagatcatcaaaatcctactctacctaattaccgtcgcagccattgacaatgagctgccatataaattactgtatctatgttttatggtgaccattgacatacataataaagctacacagaacaaacatgaacacactaagttaaacatgatatgaacacagaaatgctgcgaatgacatctagaaactggaaacaatagaatgaaatgcctgggttgtaatgttgtattgatgaaaaaaatatgacaaaaaccgctgtagtagtaaagaaaaagtcgttttgttatttgattgtagatagttacacatcttttaaattttatgcatcatatatgctttaagcactagtagaagtacatagaataatcaatagaaatttaatttatatgcttgatacatagaaacagtttacttgatccttttcaggaaggcaaatttatatgctagggtttgcagttataaatgaacatgtgaaaattggaaaatacatataaagcaacttctctaaccttccagcagcaatttgcaatatgcagaacacattatgtcgaagatatacattgttgtaggcctttttgccagcaagcaggcaaaggaggccaactagagttggcaattgtatttgattattatcatgagattcaatattggcttggcatagacgcaagacatgaacagccaactttgtccctcctgcaataactccaacgtcaaaagaaatcaaggtattcaagatatgccagaagtaccatagcaatcttcatcaaacctctcaaagatctttcttcattagcatatttcaagaataataaaagagctgcatcaagtcctttatggtgaaactcgagatcaataagaaccctgccagcttccattcgaactttccatggtttgtccatgttgcgatagggcacaattagttcacagacgcgatcctacagcgacaaaaagttacaccatatgaatgaaatattcagatcagaccaactattagacacatgcaggagcatggtgccaacggaagagttcttacaaggcaaatggaagatgacaccctctgtgcaatacgtgcaagggtgcgaatgcagctgacagtcaaaaccccattgtatccaggcataaagctgcaagttttttctagcagttagtaggactgacagaaatgaaggacagctaagtcaaaagtagtaattggatattttctactaacttatcaaattgcaggagccgatcaatgcgcttgagaagagacgacaatagacctacaccctgcagagaaaatgaacatcattttttgataccattgttttaaaaacaacttgacaacacctaaaaaagaatacccagcaaaaccttaaggacaagaatagtccatataaaccataagaatataattctaatttattaattgcagaataaaaactgtagtctgaaacaacaggtgcagtgctttaaagaccataaggccataattatctactttatatgagttgattattttggtgatgccatggatagaatagaaacctttaatgtacacattttttgcaaaattgaattgataaagcacatatctcaggcacatgcacagcagttagtaaaatccttaaatagtatgttgccattatagtttacatttagcaggtacttccataactccatagctattcatgccatgtactcctactacagtagtataaatatttttttcttgtcaagcaggtaatacacatgtagcatagatgatagctcaagcttccagtcattgaaataggtaattcatcacaacaggtgtccacataacatttttcatactctatcagaagatatacatgcatacaaacctgctggccaaattctaattcacctatcgcctgcaccattgcagatagccagtagacatcagagtatacatttccgttgttatcattatactgaaacaatataaaatgtgcaaatgtattagtcggcacacattcaagtattatatcaatgggtattgatttgtgttcaagaatatcataaatggtgaaaaccaaatacttcctaatatgtctgaataaatataacaaagggttacaacttacaagtaatgaatacaaaattattatattgattcacgtacaagatcctaaatgatgaaaaataaatatttcctattttgacaacgtataacacggagttacaatttaaaaagcagataaaatgcaaaccagagataaatagcaacctttagaagctgaaggataaattcaatggcttcttttgggctgctcttgtctgctgatctaacaagagctactgcatgaggaattgcctaatagaaggaacataagtcaagcaaaatacaaattattatcataagtgcagcactgccataagaaacatcaaaacactattgaacaacacagatcaattttaaatcacttcagcaatgtgtttatgcataatgtaatgctggattgcggattaaaaatgtttagttgactaagtccaggtgtaaggattgaactgtctatttaagtcaggcaagagacagtacacttgcatatatggttatgattaagtgaccacaaacactaactttatttcatttagaacaatacctactggactaatatcaagagttttgaattccatagtatgggacagaggaactggagtaagaaaggtgggaaactagaggaaagaagactatctcaaaatccttgcttgtcgcaactctagacactctctcattacttataccaacctaattttatttaaacgatgaacccaactagcaaggaagcaaactaagtacagtttgagtcccccagatcaagcaggacactagcccatccaaagtggcctacagatgaaaccaaataacttgtatcctacgtaaacttgtcaacaagcaacctggcactacggaaatgtcagcaatactgacataaatggattttcttgtcatgggtaatcacaaatataagtcctacctcaaagcattacctcaagaacaaagtactccggaatatcatggaagtcattcggcctatcagtaaaacaagaatgaagctgtttacacaaacatataaaagagggataatttgtgggcgaaaataagctactgcagaatggatcttgacctgggtaatccaatatctgcatcaaatcggcggcttttatagaacttaaccagatgaagcagtccagttagttctgtgccctaaatgaaagaaaacaacttaaataagtaacacatcagtgcaaaaaagtggtaacattaaaacatctcctctgtgctattgagcagtctaacacagattcatatgctcaaacatcaacttctagtgagaacaaagaaagatacagaaagaagattgtatacacattaagtcagtttgaatcttccatgcatgcctaaaggttatgtaaagctacttcagtattgtcaagtgtgaatcactaactccgatgtgtaagcgcccattcccaggttccagatactatgtttgcaaaaaaaaaaaaggaagaagaagaagagagaccaaaacagcaggagagactcctactgtgctatatatagcaaatttaattggggcaccatggtgctcgggctccaagatcttggtgaccaggcaccatgaaaaatatatatgggggtatgttgcaaaataagtagggctgtatgcctgtatggaagttaaaatgaatgcaaatgcccaaacatcacctacttgttctattctctgttgtattattttattgtttaatttctttctgtttttctacatcttacttcagattcaaactttgcttggatccttgatcttttttaatttcatccttgttcctctactggcaattgcacagacgattctagtgaaaggggaaaggcatatgacttaagtaaaaaaacttcacatcatggattgcctcaggtgaaatttagaataaacgcaaactttcaaccttcctcacaaataaaaatgtataattgagaatatcagtcagctatgtaataaatggaaccttttgatctaaattttctaaattgaatttgaatgcatatacaaatattcagaattacaatattaatgccttggaaaaatagtttaagacaaacaagcttacgcatacctctgatgcagttacagctaaagcatatgctgcttcaactctaactctccaaaatgcctgcagcattattaacaagttactcaatgatattcaacaagatctcaagaaacatgctgaaatacctttgtatcatttaagaaattattgagggcattagtc

SEQ ID NO: 55633 - DNA, 3577 bp, Oryza sativa
tgcatagtcagtcatcaaatcaagctcaggtcaacagttttttacagaacagaaaatggcagaagtagacaagtgtcacaaccccaacggcaaagtcccatctcattccaaatactgtctaaatacccagagcattgagagtgaattgtgaggactttcatagtgcccaaaccgtagtgtcatggtggctcaaaatgtagcaaagagggtactcttctttgggacactacagtgcgaagcggggggctattacactgaatcaggattgacgatcactgatccaatcataaagctatggcttataatgtaatccgaacatatttgaaaaagaaaaaatagaaggaaaagaaaacgaaaacaggagaagggtcagaaagtaacaaaacagcacattattgccaaccagttcatcaacagagagcagccaaccagtacaaaacaatgcgccaaccaaccacatgaagccacaaagggcaacaaagccattgatcacaaccaccacacaatctcctgcagtcgccatcacccatgcaatttccttcatgtcaatctttctcctcctccaacaagtacggagagggcatagaaaagagaagataaatagggagatgaggggagaggacagcccctgtcaatgtgtgtgtggatggggtgggtgaggggtttgcatttctggtgattatgggttaaagcaacaaaaatgtattctccacaactattcaatgaacttgaaaagttagtgtggccaatgacatgatagccatatatgatttgtacataataaatactcaatttaaacagaaatgcccctttctattaagctcatgtggtggactggtggtacgtacccacatctgcacaggctggtgaaaatgtatctcagcgagatactccatttctgggtccactctgatccacagtaaaggtgcatccatactgcaatacccagaaattgcaataagtgaccagtgagaaatggcagggcaaaacaaagctagttacttggaaactgacctcgcacggttatcttgatttgaagcatctatgttttcatcagaaccatcaggctttgagccttttttagttttctgaaagcgctttgctgctactttggaatgacattgtatttccaccacctgcaaagcttcaccagccatgggtacaattggatgatcgtacactccatcagtttcatggacacgtacgctcatcattcctggccatccagtatcaccttctcgagaatcaccattcgtgcgaatatcaggaccaggatcaacttttgtggtgcaaccacgtgaaacagctaattcaaccaagtttctcctcttgctataggagattcccaatctttacaagcagaaggaatacacatatgagtaagtatatggagatagcgtacaggggaaaactcaacacgaacaagcactaagaaggttcatttacctcataactgggcatccagaagattcaacccaccttgggaagaattctttcaggaatggccgttcaagattaccgaccttgtttgcaagatgcctgaactgaataaacgaaatttatagaaagaaactcagttgctaacaaagatgaccacagtggttgcactatacaggactaaactaataatataacagtgtagaaaacatccaaacagataatgttacacatcctgaccattttaccatcacattgagaccaaacattgaaactatagttattagcacttgatagtgattactttcacatatcagtaataatagcaacttttgccaaaaatggagcacaaggtaagtaatttgactatttcgctgtttgactagaggaattagaacagcaaacagatcatctcatcctaactcagaatgtcaccacttgtttttatgaagaatggaatacgttggtccatcaccaactcatcctttaaaagttcatgttcttcgataatataaactatacaatggaagcttttgttgttggtggtggtgagtctgtcaaccctccaccatttcttgagtttgtagtatcatttgcagataactaaaatcatttgcacatgtgacttctaataagatgaatagtgcattgacgtctattggaaaattgtatagtgtatagggcttttcgagtttacaacatatgaatatatgatatgcttctttgaagtccattgcaatggactggtatttggatagtagtgcaaatatatggaatagtgggatgcctccaagaagtaccaactcatccttggaaggtttgattcctcaaaccaaacttcccatgaagcatcagcataaacatttgcagaatataacaaattacttcactcattgtgaaagtttttcttcatgacggaggaaaatggatacaagaaagggctagggactttgtagctaactcaagatgatgaacaagcaggaaagaccagaaaataaccagattgatgcaattagtaaaggcacactgcaaaactgcatagttgaaagccatgtactgatgtacctcttttgtacttagtgttcttgaggcacgagttggagcaactatcatctgcagaatctgaaatcaggaatggttacagcctgtcagcatggctaagtacaagatggccaataggaaaacacgtaacacagagagtacatgtagatagggatagtttactcaaaatgaagaaaatgaataccagaccacattaagaaacttaagaaaaaaatgcataaaaagcattagcatctacagttcagccaatggtgttcaagaatggtcatgtagttcttgcagctgttcatatgtatcatagacatattacttcgcaagaggttagaggtacacattcagaagtaatatcaattgcttgagcaaactgttgcattcatttaatacagcaaattgtaataagtacatataaagaagatgcaattgctaaccttccgaaaagagtctggccccatctgtttctccaacatttgaagaacagatacctgtttaaaagaaaaaaagtgagggagtaatacatttatgtcaactgtaaacttgtaattcaaaaggccaaaaacttactgccttcaaagaacgaattttcccatatgaaccgattgtttgagttccaaataaatcacttgaagctgaaggagagctcaaagcagttgcaccactgacatcaaactcacacacaatgcaattggcctattacaagtacagattgataattaacaagctggaaagacaaaattaagatataaataatgttccaagaaaaataactgtgccagtaaatcccttttaccgcccgacaccaaccgttaagattaaggtgaatgaatgcaagacaagaagcaaacacataatttgccagtgaatttggttggaaggtgaatgacaagttaatatgtgaatcaacaccaaaactgtgtgcaacataactctcgtgcactggtttcaaaagcaaagtaaatatggtcaaatcagcagcaacatcctacacatattatgatatagaaataaaagaaatgacacatagctataccaattacaactgaaagattctttttaagtgttctaattaactaggaacatt

SEQ ID NO: 55634 - DNA, 1119 bp, Oryza sativa
agatatccactgtgcactaactggagtgctcaatttatacacatatgtttttcttggaggatcttccttgcttaagacctgcatgatacaagtacaacaacagcagaatgtgcaagcacaaaggtcagccaacatcaaaaaatgaaacattcatgcagttgatcattgtgaaatggtataatatatctattctaacagtacatagagatatcatcaaagagcattatcatgcttgtcatggactggctagggtaagggtctgaaagaccagtgtggatccactcgccctctaatagcacaggcagggctctgaggcttagggttcagagattcattgcttcattggtaagagtacatggggtccatttatatatagggaggagactagacatctaaggaactaatctctaatattatagaaaccaatccaatctctctatctctaatttattaacatataactgataactcatctctttcctaactagataatctcctactttgtttgattattcctaacctatcctgcctaaccttgccgcatgggcttggcccatggccataacaatggtagaataaggccgacatatgatacttcctcgttgaaggcatttgttttccattaggaggaatttaatagtatatgtttagtttgcatcattaccagtcttgattaagtgcatacctggtaaagcaagtcaccgttactgacagcaactagattcgtgctaactgtgaactctaggtcaaatctggacatggcatgaaacaaagaaaaattgttaaccagcaccagcaaacataaaagcaaaattgagaggcaagaattttcacttacggacagcgctgtgttgcactatcaatgcaaggaaaccagcagtgtgcacgccttatttgattgttactatgtaagatgttgccagtgaagtaaagtccagtttcagccttctccaaaatataatctatgtgaaccagttttgtgttcttcacctataaagattcacagtaaggcaccgcatccaaaaatgtaacaggaagagatactcaacatgaactaaccatacttatttttaccttttcaatctcattatcattttccttgtccttctcatttccatt

SEQ ID NO: 55635 - DNA, 3095 bp, Oryza sativa
tttctttttcattgtccttcttagtttcctcttccttgtcctccttttctttttcattgtccttctcagtttcctcttccttgtcctccttttctttttcattgtccttctcagtttcctcttctttgtccttcttatcagcagaaccgttgcagccattaacagcttgatcatcagatatttgagcaggtttcccaccattttcttcacatttttcaccattttcattttgtttttcaccattttcttcatgtttttcaccattttcttcgtggttttcaccattttcttcgtactgtggctcagttattgccttgcttgatctctctgacgagatgatgagattaggtgcagcttcactatttagagaagagatatatactgagcatgcagcatcagcagcagtcttcgaacatgatactgaagaccaactctgttgatcaccagcatttttccactgaggagaatactcaaactcagcagcttgaccatccactaatatgttcctaatcgtcatgttgtcagcatgcagagcaaaagtatcattttcagcttgaacttttatctcagtgtacctttgagtgaaccaaaaatgtaagctcaatcagctcccagtgttaaaagacataaattttatactatggagactggatagaacaggtgaattacaaagcagaagtcacaactattaggattctttcagctgcatttagttaagaacttacagttaaaatgcacgaaacccatttaacaacttttagaaagagttgactacaagcacagcaatatacaataggaagaagtacactcttcaacccagaactctgaaaccatttagaacgcagcctaagattatttgtaggcaggttaggatatgcaactggttgtgttctaggattgtttccaagttcaaggtgaaaaagaaattaaatcctataagttggcatctaatatgctcactttgaatcagaaaggataataaaagactaatagtccaggtacatttcaccacctcttgataaaactttatcatgtgacaacaagactgggattgatccatcagaatactgtgaaagctcatttactccaagtttacctgttttggatgcaagtacataactgatacatgctccaactatgaaattatgacatttcaatggattattctacggaaacggaagatgttactgtcacaagtcatgatactatatgagaccttagcacgtttatacaccaaatgcaatttagattctccaatatcactttgacaaattgtatgcagttaccagtaagccaaggtgcatctagattagaattataagacacaacatatttacatagtggctggttgtcagtttctgctaatttctgcatggtatttaatcataaatttcttgtatctattgaaccaatgctctagaaaaccatacaacaaattctaacaagcgataaatgcaaatttggtgtgtcttttccatatccactatttcaagatctgattactgatgtcattcgaagaactaagcacaccaatacactcaattattgtgcaagcatttgtcactactgttatattcagtgagctacaaatatttgtctgcatttttgctgatacagaacataaattcagcctcccattctttccaataccacatttggtagcatagatacaattttctttcatttctcaaaatcaactttacaaacagaagttaaaaccttctctcaaaacttattgattaccaaacacatgttgagtctaccaaaaccatgtgctatcaagtaaggaactcccaacttccaagaaattgagagtacatgtacatataaacgtactgcaacagaagccctgcatatttcagtaccacttggcacttgccatttcctcttataaaagcttctaccgtgcaatttccacttaatatagcaaatcatctcatgcattcattgaggctcagcccctggccaacagggttaaactttaacaatgattaaatagcttggcacatgacttttgtgacagcagtggactagttcagcaagctggtcttatacgatttaagattatatcttggccgtctcagcagtattcaactgcatttaggtataagggttcatttggaatgcgtaaattctgttggattcgatgtggataagcaatttgtttcctctcatacgaaccctgctacaagagaggtaatgatcgactatggtcacataagctccttcacaacagtttaaacatctcaattttgagcttagctattggtatcagctacaagcagaagaatacttgtttcactaaagcacatactgcataagtatagctattggtatcagctacaaaagcaggagaatacttgtttcactaaagcacatattgcataagtagcccccacaaagttagagaactgaagtaatatacacacaatgagcaatccgcagtaggcacagcaaatccgcatcaaatacgctgttgagcagtcacattgcactattaccacaagttcactcgctacgccagcagcaactccgaagacaaatcagacaacaagtgagaccagcgaaaaccacaattactcaattccagcaactctcgattcctcgtacaatttagccgaagcaagtcagactccaaaacacgaacccccaaaccctaatccgcacgcctcgaaccatccccccaaaccaaccaaatcaaccacccaacaaaggcagctaaagtgggcacgcattagggcaacgagcatgagcaaagcgggggcgcggcctcacccatagatcagccggttctccatgtcgatggagaggcacagcttctggtggagcacggtggcgccccctcccccgccgccagccccgccgccgtcgggcttctgctcttcgcccttctgcttcctcgccttcgccataccgaaacccctcctcctcctcctcctctagggtttggaagcttctagaaggggaccaaaggcggtcggaagtgaggtggggggcttcagaggtgaggtggtggtgtcgaggcgcgccacgtcatcgcgcggccgtgtggggaaagcgaggggagaagccgcggggggggggggggggggggg

SEQ ID NO: 55636 - DNA, 18293 bp, Oryza sativa
aaccagatacaacgggcccttcaactatcaaaaccggtgcaaacaaagtccctcggcggtttagatggtggttttggctgacgtggcacctacgtggctaatttgactcggtcttcatctaacgtggaattgacgtggcgcttacttcgcaattcgaaccggaaaaataataaaacatgtagggcccacgtgtcactctcacatacaaaataataaaaaatggtgggacccacgtgggccccacatgtcatcttcacacctcccttcttccctcttccctctcccccctctctctcatcttcttccctctccctctcctcatctcctcttctgcggaactacagtaacatgccgttgggggcatttatacccgttggatcaagttttggatgcacgagattaaatgctacagtaacaataaaaataattagtatattttttattgtggctacagtgttgttcactgtagcaacgagatggcactgtagctcccctcacgtttcactgtgcgcctctgccgttttcccctcaacggcagaggatgggaacccctcttctgcaggcgagcgcagcggaggagcgatgacgccgtgtgccacgactggcgctgcctggccacctccctcgacttcctcctcgcccaccaccgccaccagctgccgccccctcgtctttggttgcgcgaggtggaggagcaacaccaccgtcgccgatgccgatgctgctgtggattccatcgacctcagccaccaccttgatgagctagtgcgtgacggggacctcgtcgatgggggatggaccaccggaggagcggtaccacgggcgccgccaccttgatcatgtgttcccactccactaattcctttatcatcacaaacaatcgaatgaagtcaatcgaacgaagagaaaaccagtcatagtactaatcaatccctcaaaataagcgatttagtgtggaactactaactaaagcaaagcatgagcgaacaaaagctactccgcatccttaacttcttagtaccacggatggacagagatgctagttttggcattcctacaagctactacgaccattcatcaatcactcagaccgaaatcagagaaaggggaagaggtgggacctggatggggagggcgtccatgtcagcgcggagcgcgacaatagggggaaggccagagccgacgtcggtgacgatgccgatgccggcgactacgcggcggtgaggccgagctgctccagctcatggcgggcgagggcaccgttgcggtgctctcggaacgcgagctccggatgggcgtggatgtggcaccagaggtggagcgcctctccctccttcccgccggctgacgcgcgctgccgctcctctcccgtcgaccggcccgacgaactcgcgtcagtcgccctctcccgtcggccgctggatgccatctacagaagcaaaagaagaaaaatatagatagagagaagagagtagttaggatgacatgtgggtcccactattttttattattttttgtgtgtaactggcgttggtcccactgattttattattttttcggattgaattgccacgtaaacaccacgtcagtgccacgtgggacgaagacctagtcaatggagtgccacataggcgtcacgtcagccaaaaccggggacagtactgctgagggacttttgcacgggtttgtaagttggggaatgcgttgtactcggttttgtagtgtaggaacgaattttgaactggtgacaaattgagggacctaaagtaaacttattcccaaaaattacggtccggattggatggggaataagtccactttccatccctcacctcatggccgtgtatgaatagcaccctcaaccacaaaaccgggtaaaacccatcccccaactccgaaaaccgttgcaaattaactccccgggcggttttggaggcggttttgtcctacatagaaattgacttgcttacgtggtagttgacttgctgagtcatcaagcgggacccacatgtcagcagtctccacctcatctcttcccctctctctctttcatatcttcctcctctcaccttctatcagcagggcggcgactgcgacgacggcgcacggaggacgagctcgtcggctggacacgccgcacgcgggggagcggcccggctcgagcacgcagaggaagcgggaggcgccggggcatctcctgagagggggtcgtggaggacaaggcatcccctccaaattgccggccgtccacgcgtgtggaggatctcgccggccatcctcgcgcggagagggtctcgtcggccggccacgcatggggaggatctgtcggccagccccgcgcggggaggatctcgccagccgtccttgggctgggaggatctcgccggccgaccgcgcgcgggggaggagctcgccggccgtccgcgcgcagggaaatagctcgccggccgtccgcgcgcgggagaagctcgccgcccgtccgagaaggaagccattggggatgtcgccgagcattgggttgtgctgcagcatgaggacagagaggctccggcacggggacgacggtggcattgcctgcacctgcgcatggcggacaaccgctccgcgtcgcgcgcacgctagaagaactccgctagcttgtttgctgtttgctcgtgctcttcgatgatttcatggtctctgatttgttttgttcgttcccccttcctgtttcgcgtgatcgccggcgtcttctctgaattcggcaaccaccatgtgctacttgtcttgccgttgatcttgctgctcgattctatcgcctcgcctccgcttcttgatattttcctttcccgtttcttgaagggaatcatggtgagggagaaatgagatgaggtggagactgctgacatgtgggtcccacgtgatgactaagcaagtcaattgccacgtaggacaaaaccgcctccaacaccgtccggggagttgatttgcaacggttttcggagttgggggatgagttatatctggttttgcggttgagggatgctattcatacacggccatgagttgagggagggaatgtggacttattcctttggatggtgtcaaatcctagtcctggccaaattatatgggccgaaaatttaggcccatactgatagtggatcgggcttacatccagtaattagaagctctcggccacccacttccccgttcaaacttttggcccatctgaatgaggattatacttcttgttacgcctgtatgaatcctattaaatatcaattattattgatataatcctcattagatgggccaaaagtaatttttagtaaatcgtcatatatcctataattaggccacacctcagacccaaaattggctcaaagtggtccacaagtctactggtgccaaaactgttgcactaaataggtaaatgaattatgaacccacatggccatcttgtactcggccaagtattggcccacttgttgccctaaataggccgaaatgaagctcagttagaggccatgattttctcccggaattaagttcattttgacttccttagccagttgccgaatctgattcgtatccctgaataataatatcggatatctcgaccaccaactattaaaaccaaatgcagtttaactctctcggtggttttggagggtggtttcactgatgtggcgttcacgtggcatcccagtcatcaaatctctactattataaaaattgaaaatatttttgtcggtattttggtacatcatccgtgtatgagtcggtttttaagttcgtttgcttttggaaacacatatccgtacttaggtcggtttttaagatcgttcacttttggtaatacagaaggaatcatataagaaatctattttaaaaaaactcgcatgctaacttgagacgatcggactcctaactgcagctcatgatttttttcaaaaatataaatatccaaacgaacagtgaatttcattttaactaaaccatataacaataataagattaaaatagacttcacccattgtaacgtaaggatattttttctacaaattgaaaaaataaaatgggacccacctgccaccctctctctatgactctctccctccccctttcttcctctttcttcttctcggccacccttctgcaatgcgttcgccgcggccgtcacacaaagcgattaccgcatccctcagatctcgccgcgcccggccgtcgtgccctgcccttgcctcgctggataccggcggcgcggtgggtcggccgcgcgatccgatgaggcggcggccatcgtcgttcaagcgccggttggtggcagcagcgcccgtggtgattccgcctcgtgccctcctcctcacgcttgcctgcctcttcctcctgcttgcgctccggggctcgcccgaccccgaccatgtagtgttcccctccaccgacttgtccagatccgcggccaccaccttccctctcctccgtcaggtgagcgaatcgcatctttatatctcatgcaagaccggcggcatgtgtgtgcactgttggaattaatagatgggctaaggcccattcgaagattaattctttgtaaaatcacaaaagcccacctcatgggatggcatgcatgtggagtttagtaccactttgcttattctaggagagggggacctccttaaaagggaggatgccctcctagccacttgaagcatgtgtggtggagagaagagggggaacaaacgagcgcgctcgctggcctggcatggcatgttttgttttggaaacattccaaaaaattcggtgcgtgaaaacggcgtggagtccggataagttacgcgcgacttatccggttcggttacgcggagtggagatcgtgcgggcaccctgatcaagcgacctatctctatataaaccgagccgccgccttcacgcaaaacacacgaaatccatctagggtttgcctcctcctctgtgttgcgccgtcgctcgtggactactccatcccgctcgccagcgtggaccggcgatcgggagagcaggtctccggaacctctgccttcgacatcctgcaccgggagaaggcggcaataagatttttgggaagcgctttgcgcaactgctccctgttcgtccgtgacggttcgccttcctctccgctcgcgtgctgcgcgccttcgtcgacgctcgcaaccgcgagtagttcctgccgagcaaccggtctttccgccacctcggtacgtgttcgacatgttgcgcatatttgaactgttcatattttactgcttagtttacatgtgtagatctaatgatgcgttaatgctagtatatatctgtaatgtcatgatttatttatggaatatattaaatcattataggcgctgtgattttactatggctggttttgccgatgcactgaggccggataaatttaccggtgtgcactttaagagatggcagatcagggtcactctgtggctgacagctatgaagtactggcaagcctatgggcgttcttaatgctgaccagcagaaagaattcaatgaggccactactctctttgtgggatgcattcttagcgtgcttggcgatcgtctgatcgaggtgtatatgcatatgaccgatgctaaggagttgtgggatgcactgaatactaaattcggtgctactgatgctaacaatgatctgtatatcatggagcagtttcatgactacaagatggctgacaaccgttctgtagtcgaacaggctcatgagatacaaaccatggctaaggaactcgaactccttaagtgtgtcttatccgacaaatttgtggccaggtgcattattgcgaaactacctccatcttggagaggtttcggtactgcactcaaacacaagagacaggaatactccgttgaggggttgatagcatctcttgatgttgaggagaaagctcgggaaaaaaagatgctgcgtctaagggcgatggtgggtagtccactgctaatgttgtgcacaaggcccagaacaagagcaaagggaaatacaaagctcagcagaccaccaacttgaagaagaagaagaacaacaacaatcctaattaggatgagaggacttactttgtgtgtggtcaacctggccatctggccaggaagtgtccacaacgcaaggggatgaaggcacctgcagggcagacctctaagtctgctaatgtgaccattggcaacactggagatggaagcgggtatggtaatttacctactgtttttttagttaatcagtctactaattggtgggttgatacaggggccaatgtacatgtttgtgctgacatctcattgttttcttcttatcaggtcgcacggggttccaccgtcctaatggggaataggtcacatgcttctgttcatggtgttggcacggtagatctgaagtttacttcggaaaagatcgtgcagctgaagaatgtgtagcatgtcccttctatcgacatgaatcttgttagtggctcccgtctgactagagacggatttaagttggtttttgagtctaataaagtagtcgtgtctaaacatggatattttattggtaaaggttatgagtgtggaggcctgtttcgcttttccctttctgatttctgcaataagtctgtgaaccgtatttgtggcagtgtggatgatgaggctaatgtatggcactcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgctgaggagagaaacttggcacctctagaactcctacactcagatctctgtgaaatgaatggggtgttgacgtagggtggaaaacaatgtttcatgacgttgattgatgatgctactagattttgctatgtgtacttgttgaaaacgaaagacgaggctctagactatttcaaaatttataaggcagaagttgaaaatcaacttgacagaaagataaaaagacttaggtctgatcgtggtggagagtttttctcaaacgagtttgacttattctgtgaggaacatgacattatacatgagaggatgcctccctattctcccgagtctaatgggattgctaaaaggaagaaccgcacactaaccgacttggtgaatgccatgttggacaccgcgggattacctaaggcatggtggggggaggcattgttgacctcgaatcatgtgttaaacagagttcctaacagaaataaggacaaaacaccatatgagatatagattgggagaaaaccatcactttcttacttgcgcacatgggggtgcttggcgaaagtcaatataccaataacggagaagcgcaaacttggacctaagactgtggactgtgtctttctgggatatgctcaccacagcattgcctatagatttttaatagttaaatctgaggtacctgacatgcatgttggtataattatggagtctcgtgatgctaccttctttgagagctttttcccaatgaaggatacacatagtagttctagccaaccctctgaaataattcccagttcaatcacaccaccagaacaaactgaacatacacatgaacatgttactgaggaggatgacagtgaagctcctcgaaggagcaaaagacaaaggacggttaagtcttttggtgatgatttcactgtgtacctcgtggatgatactcctaagtcaattttagaagcatacgcatctcctgatgcagactactggaaggaggctgtccgtagtgaaatggattccattatcgctaacgggacttgggaggtgacaaagcgaccctatgggtgtaaacctgtgggggtgcaagtgggtgttcaagaagaagctcaggcctgatggtactattgaaaagtacaaggctcggcttgttgctaagggctatactcagaaagaaggcgaagatttctttgacacttactcacctgttgctagattgaccacaattcgtgtgctactttccctagcagcctcacatggtcttcccgttcatcaaatggacgttaagacaacttttcttaatggagagttggatgaggagatctatatggatcaacctgatgggtatgtagttgaaggtcaatacagcaaagtgtgtaaattgttgaggtctttgtatggtctgaaacaagctcctaagcaatggcatgagaaatttgacaaaacattgacatctgcaggctttgcaatcaatgaggcagataaatgtgtgtactatcgccatggtgggggtgagggagttattttgtgcttgtatgttgatgacatactgatatttgggacaaaccttaaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgatgcttcgcaagaacaagagaattgctaggaatcaactggaatactcccaaatcattggctcgctgatgtacctggctagtgcaactaggcctgatatctcctttgctgcgagcaagttgagccggtttacctctaatccgagagatgatcactggcgtgcgcttgcgcgagtaatgcgctatctgaaagatactatggaattggggcttcactattctgggtatcctgtggtactggagggatatagtgattctaactggatctctgatgtggatgagatcaaagccactagtggatatgtcttcacactgggtggtggtgctgtttcgtggaggtcttgcaaacagactattttgacgaggtcaaccatggaagcagaactgacggcactggatactgctactgttgaggcagaatggctgcgtgatctattaatggatcttcctattgttgaaaaacaggtgccggctatccttatgaactgtgacaatcaaacggtaattgtcaaattgaatagttctaaggataatatgaaatcgtctagacatgtgaaaagacgattgaagtctgtcaggaaattgagaaactccggagttataacgttggattacatccaaacagctagaaacctggcagatcctttcacgaagggactatcacgaaatgtgatagataatgcatcgaaggagatgggtttgagacccatgtgagttatactatggtggtaacccagtctatgtgatcggagatcccgtgaattagaacctgggaagaacaaaccattagtaaactagaggagagtaccaatctataccctctctaagtgaagatgcatgtactcttgtgagctgcaaggcaggttggctatgccttaatgagttctgttggctttaattagcgaagatgctgtcctgcagagcattcttgaaagaactgacctttgtaagcttgactgttggtcgcagtctatgaagattttgggtgaatcttctaggaagcttactaaagacctaggagtatgacttatacgctccacccgaggggtagtctatagacggtctagtaccagataagactctgaatgaaacttgcttgcacaagacttgcaattcaaggcgtagtccattgttcaagttgtgagtaagtgtagcttggagttctaagtggatgttcaaccttgatcggtctccatcgaaccgctggtatataaacagtacattggaaaagacaaatctcagtgggattttgagatttggtgggggattgttggaattaatagatgggctaaggcccattcgaagattaattctttggaaaatcacaaaagcccacctcatgggatggcatgcatgtggagtttagtaccaccttgcttattctaggagagggggacctccttaaaagggaggatgccctcctagccacttgaagcatgtatggtggagagaagagggagaacacacgcgcgcgctcgctcgcctcgccgggccggccgggaccggccgggcaggcggcgcgtgtgcacgacgtactgcagaaaaattcggatttgttttgttttggaaacattccaaaaaatccggtgcgcgacttatccggttcggttacgcggagtggagatcgtgcgggcgccctgatcaagcgacctatctctatataaaccgagttgccgccttcacgcaaaatacacgaaatccatctagagtttgcctcctcctctgtgttgcgccgtcgctcatagactactccatcccgctcgccagcgtgcaccggcgatccaaaaaatccggtgcgcgacttatccggttcggttacgcggagtggagatcgtgcgggcgccctgatcaagcgacctatctctatataaaccgagttgccgccttcacgcaaaatacacgaaatccatctagagtttgcctcctcctctgtgttgcgccgtcgctcatagactactccatcccgctcgccagcgtgcaccggcgatcgggagagcaggtctccggaacctctgccttcgatgtcctgcaccgggagaaggcggcaataaggtttttgggatgcgcttcgcgcgactgcttcctgttcatccgcgacggctcgccttcctctccgctcgcgtgctgcgcgccttcgtcgacgctcgcaaccgcgagtagttcctgccgagcaaccggtctttccgccacctcggtacgtgttcgacatgttgcgcatatttaatctgttcatgttttactgcttagtttacatgtgtagatctaatgatgcgtttatgctagtatacatctgtaatgtcatgatttatttatggaatatattgaatcattatatgcctatattctcaacatgtactactttgcttctcattcgttagctcattggcatttggtttttgagtgatccgattttagttcatgatcatgagtagcgcttgaaatttttggctcctgtatgtgtgtatgtgtagagatcttaccttgatggcgttacggatgcgttcaacatgaccgacgaaatgctgggtgctcactcgtttttaaggcagcttatggaccagatttcccttgcaaaaacctaccttgtcgttgcgaaagaagcaaataacctgcagttttcagcagagcttagttcgcagatacggcgggcgccgcagagctttcttgcgcatgctgcagctcatggtggcacggtaatggagcagaaagtagagaaggcaattgtcagttccgctatgctagtgcagttacaatcatgaagttgataggtcagattcaatccctaggggagaaatcgaaagcagaggtggaaaagagcacgaagtacgggccgtgccagcccggcccatttacgggccgtgtccgaccatgctttctaccatgccgggccgtcgtgccttgggccggcctgataaagcacggcccaagtcccagctctaggcagattgctgcctaggagcaagacgggcgaaggggggagcaagagagggggagaatggagaaaaaggaagacatgcaggcctcacatgtcagtgggcccacaatttttttttaatgattaatgggtcacatgtatattttttaattctaatgccacataagcgacacgtcagtaccacgtggaacaaagatcaggtcaataccaccacgttagcgaaccgtcctccaaaaccatcaagggagtcaaattgtaccggttttaatagttttgggtcaaaatatccgatattatgatttagggatacgaattagattagatcactagttaaggagtcatagtggattttttcgaaaagcgtaatctcaaattgtggcccatggtaaaggccgatatttcggcttacattgcttataaacgggccatatttactctatagttttgggaagggttaagtccactttgacttccttaactagtgcctgaattcatatccctaaaccacaatactggatatcttggatatcttgaccctcaaactattgaaaccagtgcaatttgactcccttggcggttttgtagagcggtggcgcttacgtggcggtgttgacctggttttcgtccgacgtggcggtgatgtggcgtttacgtgacattagaattaaaaaaactatgtgggacccatttgttatttacacaaagaaaattgtgagacccagtaacttgtgaggcccgcatatcatcctttctcctcttcttcctcctccctctctcttccccttctctctctctttctctttttctcattgctcttcccttcggccgtctgcaggtagcggggagcggagcagcggtggcggcctcctcgcacgcgcgcagcagctccgcatacgggataacctcgccgtccccatgtttccacttcaggccctccacatttgccagctgccgtggtcaaagcagacatggagcttccccggcaccgacgccgccgtctcctccgcctcaccatccttccctggcactgccgccgccacctccgcaaccatcgggagtgacgcgtactagcaccgcttgagcttccccggcaccgacgccgccgtggtcgaggtggatgcagaggcaaatggaacggttgtggtggcgacatggaggaagcaggaaaagcggcatctgttctctctctctctgcttgaaccgcgtgggcagaagcaggaggggaggtcggggacatgataagggacggggaggcagtaaaagcggggaacgaggaggtcgtcgaggtggggagtggaagggattggagcgatggtcgagggagcgaaggtgtcggtggtggtgtgcttcatgacggcggcggcggtggcgacggacttctaggtgagtggatgcgccgtagatctgcgttgatgctgatcggtcatgagggcgcgccatcactgcgcctctaggccgctcctccttctcggatggagccccctcgtggattcatctccccagccatcatcgctgctcaacctccgcctctcggtgtaaaggatggtgaagagctcaaagccggagtggaaagcccaagcgtcggcgtccctctccgtgaagacggcgatgatgaggaactggatgacgtgcgaagaagcaggtgtagtacgtcattgacagcctcgccgggtacttcttcagcaacgggccaccgacgctgctccacgtcgttgctcctcatccccgctctccgccaccgagctcgtgggcgcgttggcatggggcagagagagggaggaggaagaagaggagagagatatgtgggccccacatgtcagtgggtcccacaatttctctttgtgtgaatgaaaaatgggtcccacatattttttttattctaatgccatgtacgcgccacattgaacgaagaccaggtcaacaccgccacataagcaccatgtcagcgaaaccgcccttcaaaaccgccgagggagtcaaattgcaccggtttcaatagtttggggggcaaaatatctaggattatggttcagggatatgattcagattcagccaccagttaaagtagtcaaaatggacttattccttttgggaaactatagatgaaaacctacagattttgtaaaactataaatatagcctttatgtaaatgcaaaataccccctcccatacacacacacaaaactatagggagtagctatattttaatataacgctatattattttataaaacagttaaatcgttctcacactatagattacttacacttaaatactgtaattagattgtaaatttcaaaacatatattgtaattacattttatgttttaatatttgaatgtaattttaaatatttgcattatattttttctaatacacaaataaaattatatttaacagtaatttttatctctgtgaaagaggagataggttagatagaagtatacttgagagcaaagtgactgaaaaagtggcatcatatttttaagaacctgaaacagtgttaggagaacggccttatttatacaactccaataagataatacaacgagtttattaagataaaaggattaaaagcaacagtgcgtaatattatttttcaaattatagcttctttcatttcaccaaaaagaaaggtaaacaaaaaaaaatgatctacacggataagaaaaaaaggttacagcctaaatagatttattttatcccgatttctagggagaaggagagtttgtcaaacaacatggtcgtcgcacaatttaacgctttccattatttaatgtcttgttttgttttaattatatggagtcatgtgtgaagcttctcagcacgctaaatattatagcattcgtcatatgtatgactaaggaagtacttttgtttgattgtatagcttattacatactttacactttgccacttgccacttactgcgtggaatttattaattcagctcactcatatatggcttgttatatatgtatgcatgcatgcatctcaatttgaatataggatgtgattgtatgcgttcataagtgtaatttcacgcgttatgtataataaataattaacaaaaattgctatactaatataatatttttttttgagaaatatggtcttccaaaaccctgtcacctcccaatttatatataatcagtggtgaactggtacttaccaccggtatgttttaatgcacatcgtaataagaaaacaattatacgtacagacaatataacaaaggacaatttagctaggagaaattgacatggtagtttgaatgttgtttttatgagaaatgagactattaaatatttatttgtggagtgttactatgcaaaatttctttggagagctctacagtttactactagtttttatagtttatatgctcctcatagtatatctcatattttttagaattgccttgtgggggttgataaaaaatctaccaaacttattcttgttagagcatccgctatatgttgggctatatggttgtgtagaaatgatatggtttttgataaaacaccatctatgttctataatcctatatgcatattcttttcagagtaacatactggcctcggttctgagctcaactactaaagtgtgatgaagaaatcaagtcagtgaaagttatatgtcgtaattttgattcaatagttatgcagttgctcgctaactttggatggagattcacaaatagaattcaataatttttgtgatcttgttatgctgtgtgagtttttattagtttgtgtgtccttttgtttattcaggtgtgagtttttggtgaattggtgtaataattaattggttgtagctctttgagcaaaggtcgggattatattccattataaaaagaaaacatattgtattgtagttgtaaatgtcaaactacagaagagaaatgggggagagagaccccggggggtgacttcacttttttctcggcgaatacgtttatcaccatataattaacgattggtgcatcagctgatttcagattattgactagaaatattaatcatgaatatttctcaagaacacatagcaagtttgagatctttgtatctattcgttagaaaaccagaaacaggcatgtaatggaaggaaatgaggtctttgccccgtgtgttgcagcgggattttaataaaaaaaattatcattaatatgttattattatatcttaattgttgtacgtatttgatactaacatgtggacatttttagccttacactgttctttttttctttcaacaaaaagtgaagagttggttggagtagctaacatttagaccatctagacctacctgtcatttttccccttaaaaaaactaggagttggtagtggggaagtggtatgtagaaccaccaccactactctcttttataagaagcatagtatacacctaccacaaaacaccacatcagtgatgcctccttcgttgcgtcatgcatggaggaaggaaaggggaaagaagagggcatgcacggcggtcggctgcgcatggccagcagtgatgatgggccttgtgagaggagctagctagcggcaacagcaaaccatgtgggaggagaggatcctctcctctaacaagcggtggagtacttgcccgtcagagttgcccgtcagagatgactatcacctctgacagtcggtcacccgtcaaaggtgactggacacaacaatgaccactgttctttgaccaggcctaaacccatcaaaggtaagggtttatggccatcaaaggtgacctgatccggtgtagtgggagtaaaggactagtgatagaggactggcgagaggagcggcggcgagtccgttcatagggaagagtctgtgtcgtcacgtggagctcagccagcggcgggagggaatgacactggcagctgaaatattttgttgatttggtgttcgttctgttggatgaatcgtttttatcttttggatattgaaattattgatccgttggagaattcttagatctgttcttggtagatggatgtgtttcttatggggccgattgcaatctcatcagtgtgggctcgcaatctggcaataatgatccgctggctgattatcgctgagacagaagtgccggttccaaaatcgtcaccgacgttagttttgaaccagcactgatgtccaaacctgtggtaatgatagttggaaaattttaaagtctcaacacataatatagtactacctcttttttaaatatgtataacgtcgttgactttttgtccaacgtttgaccattcatcttattcaaaaaaatttatgtaattatttattttaatataacttgattcatcatcaaatgttctttaagcaagacataaatgttttcatatttgcaaaaaaatttaaataaaataaatggtcaaacgttggttaaaaagtcaaccgcgtcatacattaattaaaatacggagggagtatatagcaattggatagtttctttagcggcacaaaaatcatcacttgcttatgtagagcttatctaatgtgtgattatattctttcaacaaaacggatgcgcatcatttctcggtttattcctacatgtatggataatgcatgtatgagaattaattctacaatatgtatatgtcagcggccgtttgcaacgaatcaggagggaggccggaggtacagttaggagaataggcaaccaagccacctagcatgacaacgtagtaccaagattaatgttttattttaccatgaccaaaattattgttcattactgaattaactacctttaagtactcatttttaaacatcctaatgtggttggtgtggttctccaagtcgttggttatatttctttcattgatgaatctctattacttacgtattgaatctcgtatttaattctatacaataatattgcttaatttatttttcttcccttgaaagtttcataattttgtgatatggaatacatttggccaaactacaactgataatttaattttatttctagtccattattttagtttatgaatcatttcaatttctcttgtggtttgttcttttttattttttaactgggaatcaaactttatttaattggcgtaattgtgttatgtctctactttcatattcatatgtgatttttatccctattttcagggtttatgattttgcccattcttttttttaaaaaaaaacaaagctttagcttgcacctggtatattagtatatatgttaagtcacgttgacggtgataagtctgtggcattcaccattgaatattattgtatgtttacctctacttttggtcatcactcacatgggtctgccccttatacccttaaatctaggcttcttggttcaattgaattaagagatcagcgaactatgttcaaaatagcatcaacaatggccaaagttatctactctttcagaagcaaacaagatggcaatcataaataattcccaatgtggtgctaataaattaaccaaatcttatctagctgttgctactagacatgtatatatatatatatatatatatatatatatatatatatatatatatatatatatatatatatatatatatatatacatatatatatatacatgtatatatatacacacatacatatacatatatatacacatatacatatatatatatatatatatatatatatatatatatatatatatatatatatatatatatatagagtgcataggactacaagcatttgcaccaaattggtatagggatattaagtctaaaagggatatagaaaaaattattcaaagattagaagatatccaa

SEQ ID NO: 55637 - DNA, 1265 bp, Oryza sativa
agtccaaatttagtatttcgaaatgtacatgttgaattcttatgcttttttcctacaatggcgctaaatttgagatgattatctttgatttatcatatcttaatttgtgcattgaatttaattctatacaataatattgcttaatttatttttcttcccttgaaagtttcataattttgtgatatggaatacatttggccaaactacaactgataatttaattttatttctattccattattttagtttatgaatcatttcaatttctcttgtggtttgttcttttttattttttaactgggaatcaaactttatttaattggcgtaattgtgttatgtctctactttcatattcatatgtgatttttatccctattttcagggtttatgattttgcccattctttttttaaaaaaaaacaaagctttagcttgcacctggtatatatgttaggtcacgttgacggtgataagtctgtggcattcaccattgaatattattgtatgtttacctctacttttggtcatcactcacatgggtctgccccttatacccttaaatctaggcttcttggttcaattgaattaagagatcagcgaactatgttcaaaatagcatcaacaatggccaaagttatctactctttcagaagcaaacaagatggcaatcataaataattcccaatgtggtgctaataaattaaccaaatcttatctagctgttgctactagacatgcatatatatatgtatgtatatgtatgtatatatatgtatgtatatatatatatatatacatatgtatatatatatatacatatgtacatatatatatatatatatatatgtacatatatatatatatacatatatatatatatatatatatgtatgtatatatatatgtatgtatatgtatgtatatatatatatgtatgatatatatagtaaatttgtttggtgctccaaggtgcccgggcaccattgttgaaattgagcatatacccaattcaaatgagtatgaaactttttcaattacttaggtattaatattaactaactaactagttcaaaacaaatttgaactgaatttgaacttgtttttgttagattttgattctaggtatatagcatccatacatataattagttaggtatgtaatcatggattatgaaataaagttaaatttgagttgttttgttgataggtataggtatgaatcaaattattataactaggtatatactcacaatttgaaaattttga

SEQ ID NO: 55638 - DNA, 12501 bp, Oryza sativa
cctatatgtatatatatatatatatatatgtgtatatatatgtgtatgtgtatatatgtatgtatgtatatgtatatatatgtatatatatatatatatatatatatgtatatatatatatgtatatgtgtatatatatgtatatgtatatatgtatatatatatatgtatatatatatatatatgtgtatatatatgtgtatgtgtatatatatatgtgtgtgtatatatatatatatgtgtgtgtgtatatatatatatatatgtgtgtatatatatatatatatgtgtgtgtgtgtgtgtgtgtatatatatatatatatatatatatatatatatatatatatatatatatatgtagcattcatgtaagatagcactcttaaaaccatcttctacgagacaaaatcagagtccaatatgcttaaaatcaatatagctagtttgatgacaggatcaaatggcttcatggtctttcaaaagattgtcacctcagctcccaattcatagataagtacactggtactgcctcttggtaccttttaagggtgcatggaaatgtaaaaactataataaaaaattgcaattgtacacagttgttgataacgtcaaactgtgtatagagagagtggtcatattttgacttcactttttttttagcgaaactaatttaaacatcgatcgaccttcgaccatgcataatacgagtcatgtgcaactagcttacatatagtgttatatatatcagctgatttctgagtattgacttgagatattataatagtttatttttacaaaaaaaaatcactaacatgttccagagtatagatctttgtacgtggtatatataatttgtttttttaaaaagaaacacataaaggaagttaattaatgaatatgggcagtagcgtacatatatgtcctacatatatagctggaaattgttggagtcaacacatgcatgatatatatagcaattggatagttttttgagcggtacaaataaaatcatacgtatgtaggagtagaaggctttaatatatgtaacgttctgattcttccaacaaaacgcataagcatcattttttggtttattcctactatatgctatggatactgtataggtatatgcatgtcagctaccgttttgcaacgaatgaggaggtagatatataggtctgacaggagcatagaggcaaaccaggcaaaacctagcatgacaatgtacatggtaccgagattattgttttcttttaaccatgacgaaaattattgttcattattaaactgccattaccccattaatttttttgggactgaactattagtcaatcgtgcagctaggatcaagcatcttaatggttggtggttctccaagttggcaatatttctttcatggatgacagatgataaatctctacgtatctcggttacaatcatgttattcacgcagcatgcgtggatatattttttttcaaaaaaaaaagaacagtcagcttaataagtttcgtagacaaaatagtatgcaatagctgggtagtagtcagtactactatatatattgaactatctactatcaagatgactgctaggcttaatatacttggtatatatataatttaattgtcgcatccctccatttcaatatacatgtacgtgctgaattttaattacaagttgacacatgcatgaacttttcaacactagggcacgtgctcatcattctagttaatcctttaatttcttaggcatagtaatttgtttaaacatccatccttcaattagcaggatttttaaattaataaactgctggttcctgtataggaagaatagtttataataaattgtcctatactcgaatttttttagcccaaattagatattttcttaatgcacccatgctggaatattcgtttaattcagatgcacattacaatgctaaatttcagatttgatttgatttatcatatatttatgccttgaatttaattcatggacattacaatgcgttgaattctcgtggtagtagtagtagtagtagtagtttgggaattgcaattttcgtttaattgtatgtctttgtttcagtttttttcttacaaaatagtgtatatggcatggactggattgttaaacattgttattatttatagatttttaataatatattgttgtgacatgtaactgaattcatacacaataattccaaacagtactttacattcacttttacaggacatcagttatactttcattacagtacatatatccttgttaagaaactcgaataaccaaatttgctatttaaagaacgtgtcggttttgtgaatatgagattcaaattgcgatttgaaatatcgattcatgtttagtgattaataaggccaatagtataaataataatataaaggagggatacataatcatccaccactattagaactctaatagttcactaattaagcgtggaagggtgcacatacgggactcttatacaggtctagggacggcttattgaggataataacaaattatgatttgggaatatgtatgaaaaaaaatatgataccttcaaaattcttatgacaatcctctaattcaaagcgggccttgatggtattgtaatgtgcatactatgcctcggctataatgggatgatttgctactttcagccgcattaaagtttgcaatttttcagtcaccaagaattacacattgtagtgctatataattttgtcactgtacatacgtatatggttttagtctatttttaatctcagtttgcatgtttttacatgtaatttttgtaagttattgtggattgtaaatagtaatttccgttcaaacttttatctaagaaatatggaactttcctccaatatgattgttgtattagatttagctcgttttccaacaatgagagtgttctgcaacagttgacaaaatcttaattaggagaaaattccttccatacctctgaaattttagtcgatcccttctgtacccttgaattttcttcactccctggtatacctttaaattttgatttggatcccttacatactcttatcgtcagttgaccgtttaatatgtgtagaaaagtcaattttacccttcaatatgtgaggaatatgtagaaatatgtggactaaattgttggaagtatagaaatttgttgtgtgactataatattcataagtttgttgtacaaaaaatttaatatattaaaatagtatgtgcagcatttttttaaatgataaacatagttttggaaaacattcctatataatatatacaacagaaaaagatatgttgaactaccataaaaaaatgctacatatactcttttaataagtaaataaatattaatttttatgtcatcatgaaaaaaaactttgccgtgaataatacattgtccaataaaatcatgaatataatagtcttacataacaaaattatacacttccaacaatatagctagtttataatttccatgtttccttcatgtctaagggcaaaatggtccttttcttatgaattaaacattcaactaaccgtcaattaacggaataggtatgaaaggaatcaaatccaacagtagacaaaacttgggggcataaaaaggattggttaaacttttaggggcatagaaggatttttatccttagtccttagatggtgggaaatagaactaatgtaatctaattttattattcaatccaatctaagattgaccatttgcaatccaattggaatacacatgtaaatattcatcgatataaatatagatatgtttattttttgttgtatacatatgctagtagttgttataatcatatggaactaaataatcgaaaagtttcaattgaaaaagcattcaaataaccaccgcagcaggtgacttgctaaaagtgctagccacctatggaaattttggttatcctagatggccggtctaacatggccatgtgcaataaaagtttttttttttgcagatggctcggttaggtacaccgcttggaaaaactattttcctagacgaccgtcctaactaactagcctgtttgtgaaaatcacttatagtaggcggccgagttagactagtcggctatacgaacatcacccccctcccccggtttacagtcaggttgagtgaaaacaacccattttcggacacttgaggacgagccgtgtccagctgcctgagaaaactgatttttgtcaccagtgaaaattgattttgtgataataaacgtgtgctcgtttcttctccacatatgctagcttataggctgctattatatactctctctccatccacaaaagttacacatatttcacatttgagtttttccaaataagttgttcatatttatagtctttatgcattcaagacttaaatgaagagataaattaaatgttttattagaacctaaaaagtcatctaaatactcattggttgcatacttgcattcactccttgattttgtaacattcaaagtgatttaatttctccttggtcttgatgtcaaaagtaatatgcgtaacttttgtgtatggagggagtacttgctttactactcctagctagctagggagtaacagttttagttgcctacaattcaatacaatacaacttcgtctggcgccctcaatcgatctcgctctataaatagcggaccatcctttcttccctacaccacacaccaacacacacaaaccattgcaactgcactacactgcagcacacacaccccgcacccaccaagctaagtaattaatcatcaatggcttccgccgtggtgaagatggccgtcgtctgcctgctcctcctgtccgccggtcatctgatggcctccgccgccgccgcgcgcccggacaccgtcgacgacgcggcggcgctgctgcgcctcaaggaccgcatcgagctgcaggaggaggaggccctggccctcgccgaggagctcgccctcctcgacgacggcgccggcgacgccgtcggagccggctgctcctgcagcaccaccaagtgcaagacgtgcatcgccacctgcgggatcaagtgcttccccaagggaatcaaaggcttccccacctgcttcttcgcctgcgtcttcaccaccagcaagtgcttcgccttcggcgcctaatcgatcaatcgatcacgtcgtcgtctcggctcgtcatcaatcgcgatcgatcggtcgttttcacctaataataatataatcatatgtgtgtgtgcaaagaataacgaattaacctccccaagcttcatgtatgcatacatgcatcgttagtgcatgtgtccctgatcatgggtctctgggggaggatcatgttgtgtcgtgtgtcggctgtgtctcggttatcgtcttatcgatttcgatcatatcggccaattgttgtcgcgctggccacgtatatgtacttgatcgatgaccgagaaactcctaggtcaatctgtgtgttcatatatacatcagtccaataaatcgatcgttaattatattacaaagttttcgcattttaccgatacatgttattatatgtactccctcactgctaaatagcttttgcggtaggcacataatggattttcacagatggacatgtatatgaaccccttattataaccgatcgataacttttatataggaggctgcgcaactacatacataatactttctctgtttcatattataatactttctctgtttcatattataaatcgtttgacttttttcctagttaaactttgctaagtttgattaagtttatagaataatttagtaacatttaaaatatcaaattagtttcattgaatctaacattaaatatattttgataatattttcattttatgttgaaaatacttttttcctataaactttgtcgagtttgaagaagtttaaatagaaaaaagtcaaacgacttataatatgaaacggaggaagtagttgttttgtaggcggcaagttacaccatgcatccacctgtaaaaataatttttggtgctaaagaaaaacctaggtcaaccgctaaattcctcatccaaccctgaaacctggccttgaaaatcatgcatgcaaaactgaccaaaccaaaatagaataaccagctcaatttcacacagattgcaagaaacaaactgtccaacgacatcatctcaatttcatagtaaaaaaccaatcaaatgagctcacctgccaatctgccatagctggttgacgacgagcttgccacagtaattgtcaccgctgccaagtagaatccctcaccgtggttgtcgtccccattgccgagacaacgtgcgccctcgccacggccatcgttgcaatgatttggtggttttgaggcctagctagttgtagctaccgctgagatgaagaccttggcagatccaccacttctaccggcgcatccctaatctgcctatgcagtggcggatctaggccagctagggctcaagccctaggcctgggatccaaagtccatacaaatttcatatatatattttttaaaaaaaatgattgaatttatagaggagaggataggatagcctaggcgtggcttcaagctatttccgccattgtctgcatgggccctctggctataaaaatattttttttctatagtgcctctcacccaacaacaaaatttctttcattatatatcatcaacaactataaaatttgcatcatatgaaaaaacattcaaatacgaacaatgcctcaagtaaccatgttaaattttagttatggcacaatttattttattaggcagtcgtttagttgatggtataattgcacttaatcttgttgcaagctacacttgtgttctatatatgttgtactgtggtcaatcaaacatccccatatacttatttgtttaatgattgctcaaatgttataaatattgataaatgataactatggatatcttatattttggaatagaaggtttacatgccatgttgatgcctagatgagctggtgctcgtactaatctatatgttatctatgtttgtactcaaacgagagtagttatgtccattcagttcttaattaactaatttcttatgcgtgtgattagctagagattgaaccttagctagctcgttcaatctctttgtttatattgccaatgttacacaacatgattattaatcgtcccttttctcaggcccaaataccttacacatgttggcctggcccatgcgagggagctccgcattgaacatttatttacaacagtaaattttactttaggttaccttttattatcactactgacatgcaatctttgccgacggtaaatatcaccgttggtaatcctacaaaactattggaaatgctatgaccgatagtttatggtgggggatcatcggtcgggattgagtgtgtcggggatttgtcaactcgccaacggtgattctatataccgttggcaattacttttccaacggaatattccaaccgtaaacccgtccagatttcatggatttccattaggtcctccgtaacagataccatgattccctacaggatacttcctccgtttcataatgcaagtcattctaacatttctcacgttcatattgatgttaatgaatctagacatatatatctatctagattcattaacatcaatataaatgtgggaaatgctagaatgacttacattgtgaaacggaggaagtaatatattattattattattattattattattattattattattattattattattattattattattattattattattattattattttgttttataccaccctttaacaaattttccactctcaacaagataaatttatcattgttgcattttagaccaccctcaactattttattcatatgcatcaatttgttatatatcaaagcaatagactcaatataattgtgggaattcattgatgagtagaagttggtgtactcaaaatcattcatatgcttgagaagagagtcaggtagtccaaagtgggacaaaggtaagattatccaattcaaaaacattgattaaatggtgatccattggtgataaaaagtggttcaatgtgaaatttactcttgcatatatagccattgcaagacaaaatggatctggaacgaggaaatgaatgttcagtgcacaattaccatctcctgttgtaaggacatggtcaaagataaatgtaggttattgaactcttagataattcccatatatttagggaatattcggtcattccttacaacagtaaagacaaagggtttagccatttaacccaaaatattcgcagtgactaacaacaacataaaattgctcgtaccttgtgaatgccatctcttcaaggaaagataacttcttcaaggtaagagggccctcttcattattatgtcaaacacatcggtaattggtatttcacatgtttggtttatgggataaacgcgcatcttaatgatattgtaatgtgcatactatacatagactatagtatatatatgggatgattttgctactttcaggcgcaagaaaatttcccagtcaccaagaattgcacatggtagtgctatgcaattttgtcgttgtatatggttttagtctatttttaatctaagtttgcatatttttacatgtaatactggtaagttatcgtggattgtaaaattatttcttgtttagataagagtaatttattgttcaaacttttatataagaaattaaggacttcgatttcaattagtaatggtaagagtgatcaccattggattgcaatctaagggataaggggctgtccaggcgctactgactatgatacatggaaagcaacacgaatttcctttcttttgctacttcatccgtccgtaatatgttcatttttagctcattccatttatcataaaataattatttttagagtaattaatcattgcatcagagtttataaaagtagaaaattattgtattgggagtagatagattgagaaatagttgtattgagatttgataaagtaggggtgttctagaattattggttttgtactggtacgtgtgagatgagtaaaaaatgagcttacttgggatggagatagtaaatttaaaaatcaaaccagtgtacatcattcgttccaaacagaatgcaattctaacatttaaattcagtaaaaaaaattatagcacttctgtcatttaatttttccttgttttaagcccaactactttcccacttccaaccactcccttgtttaacaaggggcatccaagtaatttcttctccctactagtttgtcttttgaatgactacagttgcaatttttttatgaagtatgcttcaatatattgaagtatgtgtagtattaaaattacagcatatttaatcttcttatctcttaacccctttagttcctacatatattattctggaatcaagatccggtgcagttgttatagcgactgcaagttaggcagtcacatcccttcacaaccatcggatcaagctgataaaggacagatagctgtgccacgtcataaccaatctgccaacgctacagtacatgctacagggcgctacaggactatatacgcgtgctatagtgttctggccgaatctgagctgtttttctttgatctgacggtcacgcaaggactgctaaagttgcagtccacattacaactgcaggtgatctcgatccattattaagacatgactgccaggttatgcaatttcgttttgcgtatttacggcgggggctagcttggacgaaattgttattaaatttgaaaagatcttgactgggtttgaccaaattctggttgaattaaaaaagttaaaaatttcggacaaaatagttctatgccgggcccgaaatatatatgagtgcacgttcattaagttgtaaattggctctctctccaacgtacatacggaatatatgatacaacttacaggtgcgaagctaaaacaaaatagagagcagtaccacttgcttgctttactctagtttaacgaaatagagagcgataccacttgcttgctttactctagtttagatcaagtttagactgatatgaatgtatgagtttagattgaggagtacatatataatgaaaaaaaaaattcttgaccggatttctgacaccccctctcctacctagctagctccgtccctgtcgacttagagcaagtctaatagtatagccaactactagctccaattcatctatagccaatctagtagctcattcatacaatagttacatactacactattaatacctggtcccacctgtcatacacataatgtgtcttcgagtccgtgctatagctggctacaaatatgtagcccgttgctcttctctcacctcatttatctctttaaaatatgtttacagctggcttatagcctgctattgtacctgctcttaatatttcggccctcaatgtctatgcagtgtcatgtgtgcactctataaatatagcgaaccctacttcctcgtaagccaactagccaagccaatcggtccccacgcttacaagctacaacttcacctcacccctgctgcattctcgcgtcccaagttacaatccatcaatggcggcttccacttccgccgcggttaagatggccgccgccgtcctctgcctgatggtcgccctctccgtcgccgccgggcagctcacgacgacggccgccgccgccacctccacgcgcgtggatgatcacgtcgtcgaggacgacgacgacgcgacgccgacgacgctgcagcagctggagacgcgcctcgccgacgatcaggacctcgccgacctcctcgacggcggcgacggcgccgccaccatctgccccagcaactgccagaagtgcctggtcaagtgcgcgggcacctgcgtcgccgacatcgtcagcccgcccaccttcgtcgcctgcttcctcaagtgcgccgtcgtcaagctctgcttcgccaaggtttgatcatcatcgcgtcggcggccggccggcgatggtcgacggcggcgccggtgccgcttgattgcttgccttgttgtcttgctagctcgtgtctacgtactccctccgtacctatatatttaacaccgttaatttttttaatatatttgacagtttatcttattaaaaaaataaaaaaatatttttttcttattattaaatatgtttttattatatatatagttttacatatttaaaaaaattaaataaaataaacgattaaatatatttaaataaattaacggcgttaaatatttaaaaacggagggagtagtcgaggtcgccatgcgtgcactcctgcatgcatgcatgcgtggtggtggtgtgtggagacgatgatattggtgtcgcgtgtatcatttcagttgccgatcgatttacggctgatggtgtcgttgaccatacaactgtttggtgactgagggaaatatatgtaacgtgtgtccatcggtaaagatgttgttgcacgcacaagctagctagcgtggatttttaattggcaatgcttcgcttgtaaattaagcgtaatgcttctctgaacgtgcaacaatcctacacacgttcacgttaaaaaagattacagtagtggtaagtcaaacatttacaactttaactattaatagccaacaaataaaaaagttcaaacatataaaatggatgttactagatttgtcattaaacaaaaactatcgtaatatacgtaggggtggacgaaaagctcgtggctcattagctcgttcggctcgactcgactcgttgcattttcttaagggactatctatacaacattcgactgaaaattagcctaaaaatctgtcaaatgtaactgtaacataattacaatgtaattttcgtaattacactatatttatactataattacatatgtaattttcataattacactatatttgtactataattacatatgtaacctgcatccgtcatcggccgggttcccgcggcggggagaagagcatcgatggcgtccttgaaggtatccatgaacggcggcggtttgtggtgccgttcggaggcataggggaaattttcggtctgggagaaaaagagggaaaaaaagagaaaagaaagtgagaaagaaaatgtgacattgacatgtgggtcccacgtgctgagtcaaccagttggaccgagtcaaagcgccatgtcagcaaaaccatctctaaaaccgctgaggaagtcaaatttaccggttttaatagttggaggagtcatcctacccggttttctagttaaggggtatgaattagattcggcgtacttttaagggagtcaatgtggactttttcctttacacccataccaagtgaatccaaattgaaaactaatccattagacccattccaatccaacccattggcaggcttaactaggccacaatgaagtccacgttttttctctaaggctcaaaacgctccaaagtccaaagcccataatattccaaccctagtgtccctggat

SEQ ID NO: 55639 - DNA, 3441 bp, Oryza sativa
gcagcccggcacctcgcctccttcgtcggcagccgcatcctcgcgcttccgccctccctccttcctagccttcactccgtcgttgcaccatcttgtgctcccaggtccgagcaccgcagcacggtgttacagcctcgattgttcgtcgatctcgttgctcactgaggacgatgacttcaccacagcccacatgttagcaatcgccgttgccgtcgttcttctgctcaggtgtgcctttgtagtttcagacttccagcacttctcaataaatctcacccgatttattttgctacttctggtggtgtgtgtgcaccatgcagctgttggtcatccaaaccgtttcaccgttgcgctcgccatggaggaggaaagcgaccttcgtcagcatgtgccagcttgcgagctaaacgagctgagtcgagcttacagccgagctgagttgagctggctcgagcttacagccgagctgagtcgagcttacagccgagctgagttgagctggctcgagcttacagccgagctgagctggggtttttagctcgttaggttaacgaaccgagccgggctagctcgttatcctaacgagctagaccgaacccgagctgagccagctcgacatccacccttaaatatgcaactctttttatttaaagcatttcaactttatagatattgttggtcaaaatagtatcccaaaaactatgtcgaattctaaaaatgattatattttgagacggagggagtaactgaaatgaaataatatgtggggctaggggtgtgaggcccacctttcagctacagctactgaacagcggtaaccgcggacaatctccgtcgaacatgaatcgaagtgatgatgattggcgttcttttcttctaaagatgaagatgaagattaaggttttttttacgtaaaacgtattaatgtatgattgattgaattttaattattataaacttaaaaaatcgattaatatgatattttagagtaatttttatatagaaagttttcgtatgaaacgcaccgtttagcggtttaaaaacatgccacgaaaatcttaatcttcattcaatttttattggagaaaagaacagaccttaagtccaacagtgaactacggacgcatgtcctctgcagactgcagttactctgtgcaattcccgtcggtgaacgagactttacggatccgttcccaactcatgctacagatcattctgtgcacccaattccaagagttggcaatgagaataatagctaaggtgatgtttggattcagtgatttaactctagtctgtatatttagtcattaatttagtgtattaaatatagactacttacgaaactaattacataaataaaagctaattcgtgagataaattttttaagcttaattaatccataattagataatgtttactgtagcatcatataggctaatcatgaattaattaggcttaagagattcgtctcgcgaattagttcaagattatggatgggttttattaatagtctatgtttaatatttataattagtgtccaaacatccgatgtgataggcacttaaaagttttaatcccatctaaacaggtcgaagtgcattcctttcttcagtgattttttctggctccaaacggaggattcggagctagagagctccaaaaccacttgtttcatcaagctatttgaaaatgttgctctttcgtgtcaactagttttcttgacaagttgcaacagtgcagtacattcataatgtaactgctgcacagtgcataaatatgttggaagaaactaaaagttaaacttttgtcccagaagggaaaaattgttgcataaatacagtagttacactgtttcagctctgaaaacttagcttttaagaaaaatctactcatctggaaataaagtacatgttggtaaaagaacaaccttatgttccatgaatatattaaaaatgctccattgcaaaattctacggagtacttctcaacagcctacctcatgaaaacaacaatatatgttttacaaagttgaaccctggatccaaaagaaggggtgtaaattctgaacttattcattgtagattttttttttcaaattttcctgaagttcacaaaaatgtaaatgcaagaacgattgtcttttctttttcctttaacattctatctcgcattaattctctatgcacacaacgatcatcgttttcgcttcagcatcctacaataatccaatcgattctatgaactacagcactatcaagtagcaaaaaaataaaaataatattgccatctatgatctatctactctaaaatcttcgaacaatcaccagaagaaaaagaaatcaagagagagagcgaacaaaaaagaaaaaacaatggacaaatgtacagttcagccgctttcatcatctttcttcaattccactcctctctcttcccggtgcaaggggagcccctggctccgcatggtgtgggtgctcgacgtcgtcgtcgtcatggcgttggacgcggccgacgtggtggcgtgcgacgcggtggtggacgtcgacggcgagctggtcccggacgtggacccgacggagaagtgggagccgccgccgccgccgcgcgtgccgtacgacctccgccggtaccgcgacccggggacgcccggccgcgtcggctcctccagcgtgctctgcttcttggacaggatgatcaccacccgcttcatgtccggcctcatccgcgggtcggcctgcacgcacagcagcccgatccgcaccagcagctccacctgctccgtcgccgccgccgacttcaccgccgggtcgagcagctcgatgctcctccccttcttgtacagcctccacgcctgcccacacgaagcaaatccatcgccatgaatgagagatcgaagagaagttgatgagtactccctccgtctgttttaaatttaacgataaatatagtaatatttataatactaaattaattttatcaaattaataattgaatatattttcttaataaatttgtcttaggttaaaaatattactacttttttctataaatttgatcagacttaaaacagattaactttaagagagaaattaagatgatcgatggagaaattaagatgatggatggagaggacgtacgtgatcgaggaggttgtcggcgtcggagtcggggggagggacgaaggaggagttcttgtggccggagacgatctcgaggacgacgacgccgaagctgaagacgtcggccttggcggagagggcgccgtgcatgaggtactcgggggccatgtagccgttggtgccggcgacgcgggtctggacgtgggagcggccgtcgccggcctccgggaagaggcgggccatgccgaagtcggcgatcttggggacccagcggtcgtcgaggaggatgttgctggccttgatgtcgcggtggatgatggg

SEQ ID NO: 55640 - DNA, 7041 bp, Oryza sativa
gcccaccaccacctcgtgccgccgcgcccacgtcagctcctcccgccgccgccgcctctcgccgtcgctgctgctgcccgctgatccaccacgcatccaccaaagccaaaactctcgttattactccatacaaatgcagtagtagtagtacatggaatgcaacgatcatgaaccctttcttggcatgatgccaagattcagaaaccgcagttctcgcaacaacgaagcaaaacagggaaaacatatgggccgttatgggcccaatgcaggacaggacaattaaagatcgggaaaaaggtttactttaggtccctaatataaatcaaattttatttacatccatcaactgatcaaccccaaaactctttctacattctaagatttgttcacgccattacgaatgaaaaattttactcgcagatttactcaaatttattcggagtaaaatttttactcataataatgtaaacgaatcttaaactatccatttttcgatctaatggtagtttttctaagtcttcaatacataaggagatttgcagcacataatttcccctttttctggtacacttccgtcacactattattgctcacgtcgtttgcgcaccgtgagaacacacgtgtgcacgtgcagccttttcagctgttgacccacggatccagccgccaggcagcccgcccaccgtatgcagccctgaaaaaccagcgtccgtttgttcccctctcgcccccagtccgcacggcagcaagtttggcgccacatgcgtgtccacgtactcgtatttcctaccgacgcgctctactgctatcggcttctcacagatattcagacggcgacgcctctgcgtcacccaggaccaaacgaaccactaggagagcagacagcagaggcgtgtttgcgagtactttgggctttggctagttggccccccggtccggccgtgcacacgagtcaagcacgttagagcagatactatagcagactataaacaagctataaagatattttaaaaagataaaggaagatacagtggcatactatataagtcagctataaagatattttaaagaaataaaagaagagagagaagagtagcaggctacatatctacagtcagctgcaacacagactccaagacgtaatatgtgtataacaggtgggactatgtattaatagtatagtaagcaagtattatatgaattgactattatattggctatacataatttagagcaagtttaatagtatagcctactattagctcaaatcatctatagccaatgtaatagctaattcatacactagttaattactatactattaatataaggttccgcatgtcatatacacattacgtcttggagtctgtgctgtagctggctacagatatgtagcccactgctcttctctcttcctttatctctttaaaatatgtttatagttggcttatagcctgcttttatacctgctcttatcctatggctaggtcgctggtagcccggtacacctacttgttgttgtaggtagtactagtagtactactagcttgtggagaccccaaatgacccaactaatcctaataggaaaaccaccaggagggaaaggaaaacgaaagagtaggtgtgtggtgttgggcatgcaacggagaagacttttttgacccagagatgagggttgacttggtcaaaccaatgaacttttaataataataataataactgaagatgatgtgcatgggtgttgagaagctggttcacactgtatgtgcatccaggacccacagggagaattcttatgatttttcatgtgaattaactcaaattatcgtataaattatacaaaattactttgtttcaaaggaggcacaagaatatattttgcagtgtgcaaaatcgtcaaaaccactacggggatatggtgaaaacacacaccgcctttgagaaagaggaagcaatcagacagaagaaagaacaaagcgtgagaagaatgatttggtttctgaattctgaccaatcagtcgaacataatttctcttctgagggccccacggtttgttagtccgtcgaatcttatattccctgaacgaactcactctgaccagaaaggcacaccaccacgcatgatgaaaatcgcccttttagcgaaaaggcaaagcagagcagcatttgcaggatcgatttctcatgcatccatacgcaatcatgtgtgtgtgtgtgtgtctcatctgcagcagcagaatgccgcttctagaaatgcacgagaaatcaaaagcaagaagaaatggataaacgcgacctgaattctcatctcaactaatactagaggtttggtcagagaaagaaattagcgcatgcgaccaaaaccaggcgaatcataacaagatcgctactgcaaccttattataaaagatcaattacttggagcaggagagtttgttacgtgcagtacattctgaggactgaggttagagccggcaccggcagccagctggcttcctaaaatcgcacgcgtgcctaataggaaaacagccgagaagccctgcctttgcaattttgcaaaatagactatttgattaggtgattgaattttgcaaagtactagagactttgattatgtgattgatcagaagccttggccaaagttcatagatgaagtcctgcctttgcgattttgcaaaatagacttttgattatgtgattgaattttgcaaagtagagactttgatcgtgtgattgatcagaagccttggccaaagttcatagatgtggttgctgatgatagatcgatcttggactcggtactgctactagtacgacacggcttctgtgactgctgcgtcttcttccaaaatcccaacagggtagcgatgtggagacgacgcgtcgctgtacttgtcaacgactctggtcatccacaaccatcactgtgccatagttattgaatgtctaatgcaccaagctatccgtggcctatttggtttattactaatgtaataatgcaagttatccccaaattttcataaactatgcttttgttgttgttaagattttggaagtgtgtgagctttagttggctttgcctaacaaaaactttgggaggcgtttggcaaatgggcttggaaaaagaatatattacccatcaaaggatagtttttatcctaaccatacaattcttctcatctcattccatcctaaaccttcactcatttttctatcacagtcccattccttgtaaccaaatggtggtttgctgggaatgctgggttttattcaacaaaccaaatgggttgatggttccttgagtttctatttttctttttggtaagccaaacaaccactaatatccagagagatgcttccaattttaatttgggaggaatttcatttaagagaatttgggaggaatcttgaaacgtacaagaacagttaagcatactagttttgaatgaatggaagagtttttccaggttcctatggaagctactactatctcataaacagggaaaacaaacagttgggaaatgcaagacacaattttttcaagaacgaacaaatgaacatatgccctatcttgtagtaacaaatctgcctcaaattttccatgcctgattaatccgattttatctctaagactccagataatgcaagtatgcaactcaaaactataattgtgccacagtgtgcaaatgcagtgagctagtagtaattgttaagagaagagctttgtcagcaacagcaaagcatctagtagcagccgtattttaatttgttagatagatagatcgatgcatcggtgatgaccacccgctgacgcaagcaatgagctgtcctagcaacaagaaacagtgcacgcgacttttccaagcattgaactgataatccgatccccaaaaaaaaaaaaaaaacgacgcgtccatcggatgattaaactggttccgttcacgcggtgaaaattttgcggaaggcaatggcgaaggaagaagaaattggagtactcacagtggaagtttcggggcggcggcggaggggaggagaagaggatcttgtcgaggctctcgttggggacgtactcgtagacgaggagcttgtcgtcggggccgtgggcgcagtagccgatgaggttgacgacgttgcggtgctggacgcgggagaggagggtggcctcgttgcggaactcgcgggcgccctggcgggacccggcgccgaggcgcttgacggcgacctcccggccgtcggcgaggcggccgcggtagacggggccgaacccgccctgcccgagcttctgccgctcggagaacccccgcgtcgcggcgctcagggcctcgtaccggaacgcgcgctgctccctcgccgcgatcgcctccaggtccgcctcctcctcctcccgccgccgccgctccgcgcccccgccgcggcgggaggacgacgagctgaacggccgtgcgatgcgctccaggagctcgcggggcttcatgccctgctgcccccctgcctcccccgccgtggctctacttgctgctgctgctggcgcgggcgcggcggcggtggtggtgtttggttgggttggggattggtgggtggggtggggttttgggttgccgtggtcgaggagaaatgtttcagagatgtcgccgtcggcgtcggctggggggcgcgtcgcgtggcatcacgggctcacggcactccacggcgaagcgcagcgccggggaggagagaaagtcagggagactgcgcgttgacaaaatgggcacaccggcgtgtatgcggctggaacaggtcgggggtggaggggttgaagacgactcgaaagcaaatggaagaagactccaacccgggagagcttagcaggataaaggctcagtttagggtgtgttcagttcgcgaaaaaaaaatttgagtgtcacgtcagatatttgaccgaatgtcgaaaggggttttcggacacgaatggaaaaattaatttcataactcggccggagttcgtgagacgaaaagttttggtgtgtcacatcggatatacggacacacatttaaagtattaaacatagattgataacaaaacaaattacagattccgcctagaaactgcgatacgaatttattaaacctaattaatccgtcattagcaaatttttactgtaccaccacattatcaaatcatggatcaattaggcttaaaagattcgtctcgcaatttacacacaatctatgtaattagtttttttctatatttaatactccatgcatgtgtccaaactttcgatatgacagggtgaaagtttttttgcatgagaagtaacagggcataagttgtttattttcttttacggacacgtaaaaagaattacacggcaatataatagaagaagagagcagagtttgattacatatacatagaagataagctactaagaaagaaaaaaaaactcttatcgcaagggagggtggagtagggggttccactacactccggcatacgtcgtttagatatttttctaaaacaaacttgtctagttttaatcaaatttgtaggaactatcaaaatagatattataaatgttgttgtattttctataaacttgatcaaatttttaaaatgtttgatttaaaaaagtcaatgagacttatgatatggaacggtgggggcgaattttttttcttttttgcaatacaatctactactacatccgttccgttataagtcgttttgattttttttaaaacttttttttagtttgatcaagttagcaacatctacaatattaaattaatttcattaaatataacagtgaatatattttgatagtttgtttgttttgtgttaaaaaattgttatatttttatatagacttcatcaaacttaaaaaattttgactaagaaaaaaatatttttaatatgaaatggagggagagtattttgtatatagtacaacttgtaccatagaagatttattgtatttttatggcatgttcgaagttagacgatacgtgtttatttaaagactatatacatattcttctaatagattaaaaaaaatttaactagaaataaaaatagttttattacaattctttcttcacctaatggagcaaagtttttattttataaaggctaagggtattatttgagttgttaactatttgtctcttttcttctctctattctacatcaatagatattcctaattagcaatgcaaggctgagtttggttcttcactttcccaactcatctctctcgtttttcacacgcacgcttttcaaactaattaaacgacaaaaattttctatacgaattcatattaatcaaattttcaaaaaaataactaatactaaattaatcatgcgctaatgagttgcgctgttttgcgtgcatggagtgtaagttcccaactcaagaaaccgaacatagcagctgtgttcggtaaaggggagttgcgaacttttcctccgaacatgcaaaacaatatagtccattagagcaagtataataatgataagctataaggctactataagcttaggtggagaagagaggtagtgaaaaattaaggatgttggctctcatacaagaactagcttatcacaagctccaagacaaatgcattaaatgtataagtgagagatagagagataagaagaaaattgtagccaatcgtataactaatctataatatatgttggctttaaaatgaactaatagtaggaagtgagctctattattatcattgctcttagcacgtgattaatttagtattacctaatgtttttaaaaagattatcaatattacttttaaagtaacacatatatatatatatatatatatatacagtttaaccgtttagaaagcgtgcgcgtaaaaaaacgagggatatccctccaaccaaacacaccctaacagaagcactcagccagctcctgtaaataacctcgcaattacagttgtatgtatatttgtactggtactatcttcagtaggaaatctatgcctttaattaactcaataaaaaaactgaaaacgtgaatattaatcgaagtgact

SEQ ID NO: 55641 - DNA, 3467 bp, Oryza sativa
taattcctgcagcccggcgctgctgtacatgtacgttgtctagtaaaaatggagaggagtgaagctcgctgcacctcgcattgtcaggccaggtgtttacgcacgtaaacaacattcacaatggggaaacacaaaaggtgatctgcccatatctataggctctctaccagagatacatgtcagcatatttttttatttggaagagattaaatgaagagagagagcaaagctatctactaacctgaagatagtctattaagaaaaacgaggcaatacattatagagctatagatacctatgtagacatactattgaggtggtttactattaatctaatctattgctaagatgtacatgttttatagagagcaccttactttactataggtgctctaataattaatctccgttcagcttatcagaaactgcgacgaaatggcggccggtgggccggcggctttatgttcctgatatgattagggaaagaaaagacgatttcagaaaaaaaactgagtcgtcaggattgaccccatgttttcctctgcacaaaacacatgtgcctgaaactcttcaattccgtgacagcccacagcacggcaacacttaatctgatgtcaggtggctgacctgtggcacataatgttaagaatctgccctagaatattaaggaacaaagctctaaatgctggtactactttattactacatattaatttcgagtagtagtagtatgtataggaagtataaacaatttctttattctatggcggtaaggcatagttttttttttctcgactcgaaaattcaactttctctttttcatttgcatactttttaaaatattaaacattgtgtttttataaaaagttttttagaaattgtttaaaagaaatcaaataaatctattttttttaatttttatggtaattaatatttaattaatcatgtccaataatttgtttctcattttacgtgagctaaatttatgtctgccaattgagagaacgaaaggagcctaagatatactccctttaaaatatagtagagtatcataatttaaaatcaagagtgcatcgttaagaggctaaggagttgtgtagttcctaagtatactttatcactatttatagtgtcatagttggttaagttgagaaaaatcaaattcttcaccacatcttaatcatcattaggaaattttgccacacttttttcgtcgtctagaatgtcacaacagtggatacaaccaaataactaccaagcaattaaatttatctaaccttaaacgtggtaaattatgataaagtgtaaccgacaaccaaacactttataagcgacgcgtctatcaattgcatacttgagccaaggtttcaaagggatttattaggattcttttaatagaaattcggattcgagatacatatgctagcacacgtaaccatcagccagttaggagggcatttatactaccattagtcaggttagattgataaagatgtgccagaatttattagataaagcagaagagatgatgccttaaaataacggggcttttaactatttgccattattacggatgttgtttaatgatttaccactagcctcatatatcatagacacatgagggctcacatgtcattgatagggtgtggcaaatcgttaattgccatgtcacatgagtgacaaatagttaaatttccctaaaataacatcagggaagacttggaagtttgacctcacatggatcgagcgagcttggtcgttggcaacttggctggatggatgacaattgccatggtcgatgcctgatggcttgcttcagtagcagccaccggttgcctcgcctacaggtttggtgattatattgttcagtgctctcgccatctcttgccatgatgatgatgggacaccatttgatcaatattccttgtttaatcatgcaacccagaaatcttagacagaaaattttattttaagttaatttcattttgggccatgtttcattaccaaccacctttcttttattttttagcaggctccttaatattatcccggtttgtagaacccccttatcttaacatcaactacaggttgagttgaacttaaggaggacttactctttgcgtgcaatcagcacctaaccagaagatgtgaatcatccaagacacattagtatggcgtactcctcctgcttgaatcggagtttgaaaccaaacaaacttctcctcaagaggatagatgggggcgattcaggtgatatcttatgtagatataagtaaagaaagaatggtagatgataatgtgaaagggcgctgcgtttaggcgggtgggccccgaccggctggcccgccccctttctttgcccactggccgcctagctgttattctttgagatttggatagagtcttgcttcgatcctgctcctcaacataagggagtgacggggaaaggggccggaagttttactttggaccaccctttgttaaatcttttcactttggactaataaatttatctttgttgcacaatagagtaccataaaccacatcttttgcacttcaatgacttcgagcaaatcgttaacagtgtgtcggtgaactttcatatctgtacgtatgccatacctttgttgaaggagacactgacatggttagcaaagagagttaggatgatccattatgcaacaaacgtaaatttacctaattcaaagaaaaaagattaagtatagggtgatccaaagtaaaactttgacaataaaacattggtccaaagtataattcactctttcttttttcatgcatgtttatgtttacggaatggactaattattttgcttgtcagcacgacgtcagaaaagggaacaaatgctttcttcagcctctcaacactaaggaaatgtcctggttttcactactccctccataaaaaaaaaacccctggatttctatatccaacgtttgacctcttatttaaaaaaattatgaaaaaaattaaaaagataagccacgcataaagtattaactatattttatcatctaacaacaatgaaaatactaattataaaaaaattttatataagacggacagtcaaatgttggacgcggaaatccagggtttgtcttttttttttttacgtggggagtagaaatcaacagcaggaaaacgtcactgaattcttctgatcaggacagagaggaacgtcatatgacgttcggttcaatgaacatgtttgagtcactacacgtgtctcgatcagagccgtgggatctccatcgggcggtttatctgcgacgagtgtgttttatccacgaaatcacgatccatatcttttgggtgggggcttaaggcgttaagcgtaatactaaattcttaagaggattctcgtgcacaagtttcagactaatgaagtcgatctggaccgtccgatctcgatcggacggcccagagagagccccaagtaacacgggaa

SEQ ID NO: 55642 - DNA, 2515 bp, Oryza sativa
  unsure (1)..(2515): unsure at all n locations
gggacccgtcacggcggcgccgcggcggcggagggtgagcgtcgtgcgggcgaaggtgcgggagatcttcatgccggcgctgagctcgacgatgacggaggggaggatcgtctcctggacggcggcggagggggaccgcgtcgccaagggggaccccgtggtggtggtggagtccgacaaggcggacatggacgtggagaccttctacgacgggatcgtcgccgtcgtcctcgtcccggccggtgagtccgcccccgtcggcgcccccatcgccctcctggcggagtccgaggaggaggtcgccgtcgcgcaggcgcgtgcacaggctctcccgagaggcccgggccaagaaccccctcctccccacgttcccaaggctgcgccgccgccgccgccgccaccaccaccacatgcccctcctggaccgccgccgacgaagggcgtcgccacgccgcacgccaagaagctagcgaagcagcacagggtggacatctccatggtcgtcggcaccgggccacacggccgcgtcaccggagccgacgtcgaggcggccgctggcatcaagccaaagctaaagggcccaaagggcgctccacctccgcctccgcctccacctccatcgccacacagacaccccgctgctcaccctccgcctccgcctcaccaccccgctcctcgccctccgccgccgatggcggcggcaccccggcaaccagcagcgctgccaccggtgcctggcgcgacggtggtgccgttcacgacgatgcaagccgcggtgagcaggaacatgatggagagcctgtcagtgccaacattcagagtcggctacgccgtgtgcactgacaagctcgacgcactatgcgagaaggtgtcatttctatgaatcccctgcaaaattggtgaaattcatagctgctagagttacagtttagttatagtttgactgaaatgaattgagtaggttaaatcgaaaggggtcacaaagacattgttgctggtgaaggccgcggccatggcgctcacgcagcacccggttgtgaatgccagctgcagggatgggaagagcttcagttacaacagtagtatcaacattgctgtggctgtcgcgatcgagggcggccttcttacgcctgtcttggaggatgttgataaggtacatgcttattgcggtagctgcgttctgttaagaaatgtagcattgttgcgaattagcgtctagtgaatgatctaacattttctgaaaaaaactaacattgcagttggatgtataccttcttgcacaaaagtggagaggcctgctcaagaaggcacgcatgaagcagctccaaccagacgaatacagttcaggtacagaatatgttgtattgtgattggcacttggttttttatggaaaccacgcttacctgaagtttgatgatttgtagggacttttacgctgtctaatttgggtatgtttggtgtggatagattcgatgcaatccttccacctggtcaggtaggttttttcattgactgcccagtcagtatgaaattttgacagaattgtatttgagcaatatgagaactaagaacaactgttgtcgatggctcgctcaatgcagggggctattatggctgttggaggatcgagacctactttggtggccaacaaagatggtttctttagcatcaagaacgaaatgctggttagtttgtttttcacactttacggcctgtatgcctcaaagctctgctcatgctcagtgactgaccattgatagtaatttggcatatgcaattatgcattcaactctaaaaatcaatgagtaagatttccttgcaaatatggaactaagtatattttgtcatcttgtaattggatcggcaagtggaataatttatatgcacctgattgaacgtaataagtgcatagtgtagacctgttattttcagcttcatgcttgtgtcattattgttaaaacctagaggtgccaactggatgtttggcttctctgagttggttcctgtaatgagttcataccagtctgttgttctttcagtcaatcactgacttagtttagtttaaaaaaagttttttgtgacttatatctatacttattatctatcgattctgtgtggacagttcccagcagcgtgtcacagcacatcttacctttcaacatttcactggttgcaataaatttttctttcagagatacttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55643 - DNA, 986 bp, Oryza sativa
tatgctttatagggtgtctttctggattccttcttctggattccttcttgagtagtcttctgaaatcttcgtttattcttcttccacgcccaaattattgatattctattatcaatatatatgaaaaacatatttagcttaaagaattctattcatctggctgcccatggccaccaagatccattgttatctggaatagtgtagattcctgatcttgaatagtgatctttgtcggggatgacaagatctttattcattatcttcgttgattatcattggtgctgattgtaccgtgtcaatctctgatggttctgttttctgaaaccactgagccaggcttctgtagtaacttttcttggagcattcatttccaaaatccggtttaattatgcgccctgctcccttgaagtattcataactttggttgtagaatttgctgataaaaatccttgtgatcttgttttggaaaaccagctgatattcataatctgtggtgatagcttcttcaatttctgcagcttcagaaaataatctccaattttcatgattagcaactgttgtatatatttcttcctcttcatccgatagtttgctaagaccgtcttcttgaaaattaaattgtcccttcatgatatatatataatgaattgctggacgaacaggtggtgtgaattttggtggtattgaggagaagataatcctgtatcttccatgtccaaggaagttaattttttctttgcatatttccattttctttttggataatattaacccattttgttccacctttctaaaaaatatttcaagatgagcaatatgttctttgtaagtccttgagaagactaacaggtcatctatgtagactaatatgaattcttggttttcgttaaatatattctgcattttcctttggaaaattgctggtgcattttttaatcctaatggcataacaagccattcataatgtccttgaggacatgtaaatg

SEQ ID NO: 55644 - DNA, 729 bp, Oryza sativa
cagcctgccatgtcgacaacagttagataggctaccccaaatattgtacttatatgattatggtgaataagagcaacgaccggctttggccaacaggatgtagggctattacctgacaattcaggggcccgaacctgtataaaaattctcgtctccgtctcttttacctcagtctcgcgtatatcctagcaccgacgatccccatactatgcaaatatcagaattgcgacatcaaacgtcgacagtgtatgatatcaacccttcattggaggcaagtgaatgtagctgtggtttgttacgtttttaacaagttatttttccaacctccaccttgagactttaataccagcaatctattcctatactaatttggcactttttagaagctctcacgttaattagaaagatctgaccattaatccacccgatggtaatatcatgaccatatattataacgcgtatttaacatgggctttcgtttagaacgaatttattacatacgtgttccaaaagcccatttgatatacaagtgtattgaccaatccatatcgtatctcaccatctctaacttcctacgtacttacacggtcgtttcaattgtttccagtcgcttttcatcatgatcatgcacacgcggccgttaagatgttgccatgttgatcaacaaaatcgatacttcatggacgatgcatcttcctgacgatgattagatcgcgggcatcaaactcg

SEQ ID NO: 55645 - DNA, 8387 bp, Oryza sativa
tgggcgtgcccttgtccccagatttgttgctgtcatcgccctcatcgtcattaagcaccagctttctcttgcgaggacctgtctgcccagccggtttggaggtttgaggttgtgggtctgacctgattgtcggccctccacttccctgaacggtgtgctggcgaggagatcggcgctgagcaattgggggatcagatttcatcaatacgtattcctgaacgagatgcttccacagttagctaactcaacatgaagatgaaattatgttttgaccttgggttgaagatttcagatacatacctgcggaggcggattgaatgcgttgtatggtacaactggcagttgatgtgaatagctgacgacaatagcgttcgagaatatcctgtacatcctctccttcaggatcttaaaatccagagaatctgggtcttcacagtttggatcatgcttgccgtcaaactcaaatgctgtgcgagatctttctttgattggagctaatcggcacttaatgaaatgccgagtgatttgctctccttgcaagccttgttctttgagttttaacatgcgttccatcaactccaaggcttggactgcttcatctccgattggaagagagttccaggtatcttggtacaccggaggaagacaagagtacccgggaagagcaggttcaggattctgaacatagaaccagtttgcatgccaccctttgtttgaagtcttgaagggcatagagaaatacttttggctcagagttcccctcagctggaatcctgcccccccgactacgcacggtttgctcttgtgcggttggggtttgaggaagaagatccggcgaaacagggcaaagtgaggcttgattcccaaaaaggcttcacaaacatggacgaaattggcgatatgcactatggaatttgggtttaggtgatgcaagctgattccatagaagttcaagatcccgcggaaaaatttgaggtcggaagagcgaagccgccgtagaagaaatgcgagaagaccacaatctcatgtgtatcgggggtcggaaaagcctcaccgcacgctggccgccacccgatgatctccttggcagggagaacgccgtgcgccaccatctccttcaggttctcctccgttacgtcggacggcgcccattggccttcgaagttttctttctcttccgccatcgattttccccgaatgcgctgatttgattcgagggatggcttgggagaggtgaggaattgaggcggtggatcacgggaaggattttgatcactttttgaaggtggatttgagtggaatggtgaaccctagtttgccggcgcagctctgtactgtagcaaggagtggggaaaatggcgagagttccggcggggaagacgaagcgtcgtttggatctcgggttttcttgttaagggtatcggaggtgagaatgggcctaggcctgaacagtacctcagcccaatacttttaacagcgtggcccattgtgttccttagggacttaggcattctttgctttggcaatttatgtacacaatagtgttgcccaatgctgataaaatcctttttacgcggtcatataattctttggaattattgcgatgcaaattaaaaggtgcccgacagaaaggcgttatgctgtttttgtaccttttttaggctacaaaagctgtctgggttaacttggaatgacttgtttttatcatagtcatttcctcggtatgttatatgcctgttttcattatggtaaatagtcatagcctaggctattagacttattcattaccatgatttttatgatatttggtgggtaatctttagagtcttatattcggatgcctgtcaagtgtgttcattcgtgaactttttagagtgttaaccactcggattccttttattgtgactaaaaagcagtcggctagaatgcctctttgggtgccgcgtatgcttttgtcatatgatgcatgattgtgctattattttgttctcaactatatgtttagtttgttgactaatcacatagttgggggctatacctaattaggtgcatctattcgatgcaccatattctttatcttttcgccctttacagtcttcgtcttcactactcggcaggccttggcatgaaaagtttgaagcactcggattattgtctttgagcaggctatgatggttgactgcaaaggtctcgggggctactgtggagattatggatatcccatatctacacggcgatgatatttgggctgaatataggataccgaatatagatagaatattttatgtgtatctcgggtttgtttctcaacttgtgcatcaaggaaataccctgagacttagtcggtcacgactgtatttgatctgtatctgtgtattccgttaaggatatagattatcttttgtaacctggactccttcccatatataaggggggtccgggcgcctctaggggcatatgttgattttcccaaatcatacaatcaataatacactcggcggattcatccccggacaggagtagggtgttacttcttttataagaaggcctgaacctgtataaatcctttgtctccaaacccatacacttttccagcttgatagccacccccttttattattgccgaaatctagtttcgacagttaccgagttggcgctcggtcacttgggggagggggaaaaatcaggcgctccccccctcccgacgcgcacgtacccctgctagcgtgtacatctcagagctcgcctagccgctcagtttcttgaagagcctgacgaccttgtgcttgctagtggccccatcgaaggcaagcccagcgctggaccactcgaatgggaaccacaacatcatgatgttgtggaactgcgcgccgctgaggatcggtagcggtgattccacctccgccgctagcccaatgagagagatgactccgtgtaataatgccgcaacgatgcactgacatgtggggcctgtcgtatgccacgtcagcgaacctagggttaaatttggtctatactgctttaggaccttttttacacggtttgtaatagttgaggggtagggatttctggtattgggaattgggaacctcagacagactaagtgtaaagttcagggatgtcaagtgaacttacatgaaaagggatgacgaattgcattgccacgaagcggacgacacggtgcgtgcgattcatcatcctcgctgctccagtgctttgggagtcgcgctccatcctacaacatcggagtgctaatccgtgcgtgttacccgtgcatgcggtgaaagacgcgatacgaacgattcttcaatttttataatatactccctaataatatttacaacacaccaaattagtttcattaaatctataattgaatgtatttttataatatatttatattgggttaaaaattttattacatttttctacaaacttatcaaacttggagcagtttgacattgaccaaagtcaaaagtatataaacatgtaaagataaagattacccgtatatcgacatcgtatcgaaataagatggcataccaaattttggctagaaatatcttcaatttttctactagcagagattggattgccacgttggcgctaagtgtataccatgccatgtaggacccaaacgttccggattgagtccgggggtaattgtctagtatcaataatttgaggtttaaaatgtccggctttatggtttagggggtaattcatactttttccttaaacaaactatgataatatatgcaacctgtttatttaaaaagaacttactttttttaagtagtactagtcaaaatggcatctgaccgtatcaaacataaaaatgcatttttagacgtattaaaataccaattcacgaaaaacaaatacactactctctccggttgataatacttgtcgttttggacaaggacacggtcttcaaaaaataactttgaccattattttctattataatatgtataaaagtgttgacaaatatatgattttattaaagtactttttaagactactctatacatgtagtcatcatatttgaaagccatatattttaaaaatgattcataatcaaagattctaaaacgacaagtattatcagtccggagggagtactattatctccgtttcatattataagccgttttgatttttttagttaaacttatttagctttgactaagtttataaaaaaatatagtaatatttttaaacacaaaataaatatattatcattaaatattgattttagtgaaactaatttgatgttgtagatattgctaaatttttctataaatttaattaaatttaaagaaaagtttaactataaaaaagtgaaagtgacataatatgaaatatgagagagagagagagagtaggtacttttcgtgtatttttatttccacacgggatgttccgtgtgcgagttaattcaactcttcggaagaccaccctccctcccctcacaaatagacacacacatccacgactcccccgtgcgcacgggcccacctgtcaggagacaacacgtgggcccaccccacgccattgaacccttctattggatgcccggaaaatacgtgcgccccaccaactgactcacatctttccccctccccctcgccccccgcaacgcacgttcctttccgaccgatccaccgatcggaaaccacgccctaaccccagcaaaccccaacgcccccctccgccctgccaccctccgccgccgccgccttcgccggcgaccaccccgccgccctccccggggggacccatctcctccgccgtcccctcgccgcctgcaccccggcggtgcctcggcgtcctgctctgccgcctcctcgccggtgagcgccatcctcctccttcctcatccctctcgcgcgttgcgttaagcctcgtcttctctgggtagatctggaagcttttctcttagtttggcttagccttctctggtaataatggcgatttgtttgttttttcccccaaaaataaggggttccatgcccccacacccgcgttaggtgcgccgctcgattaaatgctgtaatttctgcatcctttcttggttggaatgggtgccctaggaagggtaaattttggtcatgccaaatttgatgattctacaccgagagatgcggaatgcgcatgtggattgcacctgtatggctgtatgcgattgaaatgagaggaattgtgcagctctcaaaatgctataggctagaaaaatcataccataccatgcatacatttgttttaagactacgtgattagcgtggaattgagggtggcggatgtacttgcttactctgggtgaaattggtgttgctcaatcgaaattccacatgttggcattatgatatgcatgctacattgttatttacaatgtaagatggagacatggtcgttattgatacatcgggtttgttttgagatcctgggcaccataaaagcttttgctagccaatccatttagcaccagatgacccatgctctttacttacaaaattactatcactgtgggagtcaccgggtaagcatgacctatggccatgggtttggggaagggaaaaaaattgttttgaaatatatttgatgatgggccttacctgtattttgtcaatctcaaactagaaactaacatcttattagcctgtagcattatcttaaagtaatcccctgtagaattctataaaatataacctagtgtgacgctagacatagggcctgttcactttgatgccactttcaaccttaccaaattttggtaaagttgccaaaaaagtggctacatttagtttgctgtcaaattttggtaactatataagaaatcctaccaaaattttggcatagttgccaaaattttggcaatgcccaaatttggtaaggttttttttggcatcaaagtgaacaggcccataatcaatatacgttttcttagaatgctcgtaaactatatgggagaaacagactggtttcaaggcctattagcacatgttatgcagtttctttcgtaaaactggccatatttataattcatttactgaacatattactacaatcattttctgtaataattgttttgtaactccattaaatcttctgtggcagtgtgcataatacatattcggaaaggcaaatatggctacaaaactccgtcaaccgtcaactgatgcagaaaaaacagaggttggagaaatagacacaagggctccttttgaatccgtcaaagctgcagtaagcttatttggggaagttcgattttcatctgacaaatcagctgcaaggaagccaaagcctcctcaggcagaggtaggtacttatattaaacatttttttcatattagattaataatagtacttcaatgtgtgcatgcatatatctttatgaaggttgaacataccgatttgtgtggaatgttatgcgtgcctactattacatggaatacttataagtacagcaatgttgcagaccttgatgttcttaagccttgttgattccagaactgctaacttcaaatcttacgcaacaaaatgctgtgaccttcaagtgtgttatactgatgccaatatgccataatgttgataaccattttcaaatgtctaagtagtttcatgtagcacttatttgaagctaagtaacacagatcttggaacgatgctgtgttcctcgtccagtgaactttgtcccgaaacaaggaacgggaacaacacaagatgacgtaccgaacgtggatggatcacatcctaacataaggaggtatgaggaaggcaaatctgagaggggttgggtttagggatggggaatgcaccagggtcacagccgcaacgggcgagcactgttattgctccctcgctgcttgctgccatcgcacctgagtgcatggaggaacgccaccgctgttgcgctgaggaggacgggggagtgctgctgctgttgtgccgaagggggttgggggagcgttgtcgccactgacctgagggaggacaggaagcaccgctgtagtcgtgctgcggggcttggggaagtgcggttgccgctgtcgcgccgaggggcatgggggagtgccatctccatcgtcgctatcacgctgagtggctgagaacgatgggatggattctttccatcgatgggataagactgtgagtggataagggattcatcttatttcatttttgctcttggactctgaatattatgaacagttctttattgaattgatttctttcatataagccataaaatttcatatatattcatttaagcttattgtatgcataacaatggaatgctcatatttataagcccttggcttctaatttctgatattgttccggactatcatcccggaaactaatggaacgcattccatactttgaacaaacgttttgaagaggtatttcccccttcataccatatttttcaaaatccctgttccgggatctttttatgacttaggtttgaagccacgcctttgttttttttaatgaaatttgtcatatcagcaaactatttcctgcatgttccagtgaataccacaagatacttgttttttatatgctctaactcttttcatttgcatttactttcctgttcattcctatttcttttttgcaagaaataggtgtgttcccactgttagaaatttcaggctgttccccagcctatttgctgtctttaattaaacagattattattaaattaatgcacattctccatttatgagtcttttcacagcagaaatttgatttgcatttctgaaagaatagtagttttgccttctacttttactttgattatttgtcttggtagttgttgtacctggtccacatctgatgaactacactttagaagagagcataattgagtgacttgttggcagaaacagagaaagaattagcgatgattcaccatatgatactactagaagtctaagtttttgtttgtattttttttttggggggggggggggtgtggggactgacatgcattcataccattaaaaaagttcagtcctgtaagctcaagttttgctggatttaattttcaccttcgttttcgactccaaatagtgccactcctggagattggttgtcccatgcttccttccatgtgcctatttgaatattgcatcatagttgccatggccataatcacataaacgcaatgcagaaacattagttccagcttaagacaggagtatcaaatttgttatatggtataagctttgaacgtaaacccagatacaaatctttcactcactgaaaagttaaaacatcaggtactgggttttttctggattggaattgtatcaagataggactaatttgatcaaagtatcaccccagtctcactcctacaagtagtgatgtcc

SEQ ID NO: 55646 - DNA, 9311 bp, Oryza sativa
cctctggagttttgggcatagctccaggttcaaacaacaaccaatgcaggcgactgttgtcgaaaataaactcctttagacatggaaatccactacagcctacagtgagtccatcccccaggcctcgggacaagaatacttcaagatagagaagcttgggtatgcccaaggaggacgaccactttctgatcaatgcttgtaatattccagagacgaagagaggcaagattacaaagggagaccatccgatccgaaaatttagatattccattgccatcaataaaaagctctttgagatctggagcactactgcaacatgaatccatcaatgtatctgaaaactcaggagaacaagtaacatgtaatgatcgaaggctatttttacccaactcattgagagtgaagtaaaaggcttccttgtacctctggaaccttgctacatcacctccaaaatcataaattccaggacaaagtatgcgcagctgccttaatctggttagccaacagagagctcttgtaaacattttatgctgtaccgaatgctattaagatatagcacctccaaagcttgcaaaactccaatttcatctggcaatctcattgggtaattaaaatttaggcgctgtagtttttgcagtctacaaacacttgacggaatgtttatttcgtcgacatctcctgcatgaatagttagtgtttctagttgctgcagccgtccaatatccttgggcagctcggtaacatttacaccaaaaaccttcagatacttcaactgcaaaaggtatgttaggctgttaatatgctagctatccaggttcctacaccgatacagatccaatacccgcagagcatggcatttcttaaattgtggtatttgtttcggtttaggattctcaaagaagagcagcgaacgaacttgtgaacagttgttcgtaatcttcttgactattctattatctgtgccattggatgggaaccaggtcctccgaatcttcttgaaagaactccaatgctgttgttcatccactattgcgacgaaattttgtccagtcgataggcttatgataagatcaagcacaatatcatgaactcggcaatacttggcgctgccatcatactggatactaactggttggatcaagcttctatttataagctcattaaagtagttctctcctacttgctcctgtgtttgattcttcacttcaacgatgaatccttcagctatccatctccatataaggtcttgtctatcaatttaataatcctctggatacatttttttttagataatggaatataatcccggcctttactcaaagagctacagccaatccactggatacatgcttagatacaacggatattttttcgggggataaggaagatcataataactgagcattaatattttcctcactcgagcctctgagtttagtgaagcaccaatagtatcatgcacttgcacccactggtcctctgaatcggatttggttgctagcaagctagctatggagattatagctaatggtaaaccacgacatttcgatatgatggcatgagagatgtcttccaggtgaggcgggcagcaattctcagaattaaaagctctccggtaaaataatctctgtgattcttgctctgctagtggctgcatgctgtgaagatagccttcagatgtggtacggctacacgctttagctacggcagcgtttcttgttgttgttatgattatactgcccaaattattctctgggaaagcacaactgaccaccttccacgcacctatgtcccaaatatcatcaacaacaatgaggtacgtgagtacaattaaatttatgatccggtcatcatactttcgcatcaatgtggatgaatgatcatacataaaagctagttaccactcatgtagctagaatattacaattaagagtgcaaagtgttttattgggtttgttctagttctagatacaaccatatctgtctgtacgtttcggatttgctatatatcttgcgacagaaaattgaagttggaaacttccaaatttgagcatcttttccatccttaaaggcctgtttggttggggagagtttttaggatggattgggaatttagagggatgaggctattaagtgttttattttgttgggagacatgacaattttggtgggatggggatggagaattgagaaagaaactcctttcttttcaatacctgggtagggacaggtaattgggagggaattcctcctttactttttctaagcaaatctcagccatccatttttattaatgacctaatctccaactaaactctctttaaatttccatcaccgctaccaaacaagatattaggattaaaaatcaaattctcatcttaatctcatcatcaattttctcgtgtaaactcccaatccccttccctcgagttaccaaacaagccgtaagaagataacatgaggtacgaggtaccatgaggtatcaatcttatctaaccgttggtttaacaggggtaggatcgtctaatgaaaatgaggtgcccgtgctaatgaccgcccactcggccaatagggagttcgtctgtgccgcccacttcttcggcgcatcgaagcttccccggcgccgccgcatcgagcctgttttcccgccacggcgccatcgcatcgaccccggcgcggctgccgccgcaacaaggccgccgtggccaccgtggcatcgaggccaccgcgggcgccgccacatccagcccgccgccccgccgtgggcgctgccgcatccagcctcatcgagacagccgcggccctcgtctcatcgagggcgctgtgcctgccgccgtcccgagccggcggcgtccgctgtcgcatcgagccggccgcgcctcccgtcgcatacaggccgccgcctgcagccgcatccagtcgcacagtgccgcatccgcagccccatataccgctgacagtactaattttgaggaccagccgcaggtaatttgatttgtgctgcatctgataatgtgtggtagattaggaagctctagtttttatgattgacagcaatgcttgaagtaatcaaggtggtcctttttttgggcaggttcattgcgccgtgtaaaatggaagcagttggtagcagtattgaggaggaagagtatgctctactattatgggcatgaaatttcctagtgagtatcatggttttcaattctacaatcagtatgctagagagagaggatttaggaaggaggtatatatggacagttctaacagaactagggagccacgggcattatctcgctgtggttgcaaagctcaatttgagataaaacatgatgaggaaaaaggaaattggtatgtcgttaggtttgaatcgaatcataaccatccgttgtgtaaagctgatcaagtgccatttttgcgctcacatcgtagaataactcctgcagcacaggctaagatggtggaattgagagatgttggtttgcatcagcatcaagtgatggatataatggagagagaccatggtggttatgaggctactggttttacttccagggacatgtacaatttttttgtgaagctgaagaagaaacatattaaaggtggagatgctgaccatgctattaatattgagtattgctgttcctgtaatgagatggttttataacctcgttggtttgatttggttcctgtaaggagatgcttagataacctctttggaaaccttgtttttcctgtaagagtgccttgatgaccttgatgattcctataagaggagtaccttgatgaccttgatgattttgttctttcatttactgtgatgatgtggtgtgagcagaaattattacagtgcgcacgcaagtagctctgtttgtttgcaaacacatatcagcaagtaccttgatgaccttgatgattcctgtaagagtaataccttgatgactttgatgattttgttctttcatttactgtgatgatgtggtgtgagtaggaattattacagtgcgcacgcaagtagctctgttaaattgcaaacacagatcatcaagtacctctgtattagttatgcaactgaacatgcctgtcatcactaactttgcttttcggtatgtaaaaggatctgtttgagcatgtaaaagttatgcagtccataatgactgtctgaagtgagcataacattccattgttgtgatcatctttgcaaaattctcaggtccatcacaaaatgcacacaaacaggtggcgcatagtaatagacacacatacaggggcatcagttttgcaatccagtgcactagaattgactgatagatattttacatcggattaacatagcatacattacacatggtgcactataatggactgataagtcttaactgataacctaggcaaagtgcatagcatccattacatatggtgcagctagaacaaacagcataatactacatatggcaggaaacaacttaatactagatttcgcctaataccacattaggggggagggggcacatagatgttgttcatccttcacagttgttgaggagctcaaggctaagagtaagctcagcatcgttctcactgaacatgaagacacaaacatcacatagctcgaataatttgtctccaaccaacttattccatccagttgtgaaggttgcttgcttatctttcgatttcattagtctcatcgggtaggaaacagttgatccgaccacagtcacaagcaaatcttcaattggaaggtgttcgtttatgtactgctcgctaaatggtatggagaaggcctgaaaaataaatacatgacagttacactcaggacaagtacggctgaagaaatgcaaaagcggtggaattaaaaggtcaaacacaccatttttccctttttcagattagtcttatgtatctcatacacatacagtgaaatcttaggcaaattgcttgctgcaatgcaggcaagttggtactgcatcttgtgtgttaaaacaatgtatctggatcaaaatgtattgaaatttttctttcaaaatatgtctttcaagctattctgtatgatttctgtttccctaatttcaatccaactgtaagatttttgtttccctaatttcaatccatcatcacccatccaaaatatactgcccaaacattgaataaaaaccacaaattgcaacgaataacacaaaccttttcgatcggtctccatcctctctctgcatgttctgccacacaagtcgggattttggactatttgccatcctcctgaatggcgtattcccaaatgccatcttcccaaataactttgatgatttgccatccgggtccactgatttgtttctattttaccactattcacctcaaactcagcaaattgagtagaaaatgacctcactacccctcccatttctcctttcccttcttccttcttgctctcaggcattagtgatgtggcggagcagtcttcggcgtcttctgcggcggtggcatcgctcatgctgctgctaccctacaagaggttcaacagcccatacatcacacaaaatcgagcctgacaccacccgtcctgtgccgatgatcgatctcgccagtggagtggcacccgcgcacatggatagacacccagagaaacttctggaacacagctgccattagtgccaaccggatgcgcatccctgtccaccacgagtcgagccaaagaaataatgtcggctatgaagcgactcgacaaacttgatggctggtggtgcattaactgaacaggtcagtaattgaagccggtgagcatgatctccccaaggtagcacatgaataggacgtctacgggacagctttcctacgctgacgtcggcgtcgttgtccttctgatggccgtggcagctccattcatcggtgaacctttctgacacgcatgtcatgttgtactcggaggtaatgagcgggatgttggcgaggttgaatgccttggaatgagggaattggcaatgcacaggatgccacgagaaggccagtcagctgaacacgccggtgttgcgtatggaaggaagaagaaagaaggaagtggatagatatgaggggcaatcaactcattttctactcaatttgctgagttggtggtgaaaagtggcaaattagaaacaaaacagtagaccgaatggtaaatcgtcaaagtcatttgggaagatggcatttgggaatacgccattcaagaggatggcaaatagtccaaaatccccaccaagtccgaatcgctgccgcaaacatcgccgacctcacgacgaatggccgctacaaccatcgccgagttctccggcgaatggcatcctgccaatgccccgccgtcgcatcgaggctgcctcgcaccaaggccgccgtgcccgtcgtcacagcaaggccgccgcgcccgtcgtcgcatcaaggccgccgcgcccgccgtcgccccaaggccgcctcgcccgctgtcgccccaaggccgccttgcttgccgtcgccgatgaaactccgatagccggccttccgccgttcaactcgaccaatccgccttgccgttcaacaccgctgtacggttccctcgccgatttagggttaagctttccccctcacacgataacagatgacgcacgcgaaattacaaagttaccctcccacccacggtaccgcgtcaaacaaaggagcggtaccatgaggtaccgacgaatcctgtccattagatgaagccagatcaacggtcatgatttggtactgcatagcctcaaggacagtaaaaaagctctccaaatttaatttgtgctgtcagataggcgttaagattcacgattcacgtgtgggggaggaaatgaaaatgtatccgcgcatgggatgaggatcgactcatcaaccgaagctagtggttgtgctagatcgtgattttatttgtaatatattagacctatttctgtatttgaagagaaaaaaaactatgtttgaaatctctattcgctgttatgttccacaaaaattagaaaacataaaaatttgtgtaacttttatctttcaggaatcctcgaagatgactgatgaggttctgctcatcttcagatacatctccattgctcccaagtcctttaagcatatcaaccaagaccttccttatattaggggtacgtgaaatagacacaaaagttatacacttaaaatccccttgtattgtcttgtacaattcattagctagagttgtctttccaagaccacccaaccaacaatcgaaaccactttgcgttgttctgatgaccaatctttgtgcatgatccacttaacgatcttctcccttggaccatcaatccctacgagcctctccacctcctcatacaatgccagcagacggggatcaatttccaccatacttggctcggagatgaaatcatcgatctgataccgcttgcgacgttggtcctcctccataacccgattcttcagttcttggatacactctgtgatctggtgttttccccatagcttctttatcttgcttcctatcttgcgaacaaagttggcattggcatcgccacaactcaacttgtggatgaagaggtcgatgcaatcctcaatatcataagctagctcgagcatgttgttcctccactccatggtcggcccatcaagcttgtcctccttgttcgatagatgctcaagcaagacactgatgctgctgagctcattcctcaaaaagatgatatccttcttcacacttttgagcagcttgtactctccctcgatcaaggaggaaagcttggttagaaggggattcagcaccccaactgaagcactcacgattgctcctgccatctctagctccgttcctctcccacacacacagtagcagctatctcaattgctgttatgctaatgagagactaatccaaccatttgactttaaggtgtagtcttcacctgtgcacagtggttgtcgcaccatttgattcctttcaagtttaataggctattgattatttcctcatgatccacaccctgacaagtgacagggttcttaattaactgactacagagctcgagtctcgcacatgaccacgtgatctaacatgcttcacatgcctctgcctcatcttttgttgaaaaaaacacaacccagtcaaaaaaacaaatggcaaacctgggtgaattttagtatgatattaattccgtcatggcagtactatttgtgaaacatgagaggattctttgtggtaaatctgcagctgtatgcccaatcaataaggaaacatttctttctgtcatcaactcggcgggcctagagctctcgccgacaaagttataggctagattagcgttgtgacctctactcgtgagaatcaaatagaatgtatagggttattggactgaatcaatttaaaaatcccattatttttctttctgtcagcacccttacacctgccatacgctatatacataaatacatatgaaatcaatataaatacatgtgaaatcaatatgttgatttaatctatataatgaacatttgtcaaaggtaagtctttcggaaaatatggtgaacagaatgttggcacttggagccggtcagaccgagcagtgggcgccgatcagaccggaggtgtccgagcggtctaaccgggtagcatgacggtctgaccagcagactccaggagggaatcggtttcgggttgttttcgtggaatttctagattgcttcatgtttatgactactagattgtttttattcatatgtgatactatgtgtgctgatatgagtcaagtcggtgcggacttgtatacggatatggagttttttagttgttcgtgcgcaggtgttgcttgaggccatgggagtatagctagtgatggatcgggactagacttgggagaagttgaggtccagatggtcaaggatatacgtgggatgcttaggctagaaaacaatgcacgtgtaggtgaaggttttcatatgacatacacgtggtgttgtatgcgtatggaaagagaagccaaatttagattggagttcaagtttgaaaagattagggtttacagttgtatggggatgttgtttccctagtttggtgggtttcttatgttatgagtcctattttgtaacaccctgaaattaaaataaaaatatcatgattgaaattgggccgaatcaaattgggcaagtcctaccagtgcagcccacctcccctaactagtaccctagggaggggcgactcccaccttcccactcgacgccgccacacctttctcttggcacccatggaactcatgtattcttttctcccctgttaaccctactccatggatctcctaga

SEQ ID NO: 55647 - DNA, 839 bp, Oryza sativa
agatcgaaatcatcatcaacaaatcaatcggcatagccttgtcttcaaatcgagtccgattgccatctcgtcggctgatgcctcaatatctctcggttggatttggacaagtctcagaggaatacgagccctgcatgtacagcacgcacatgcacacaagtgctgtatgcacggctgtgcacgtggaggccaacactcagagcaccgatacatacgatgaccgaccgaggacatcccgacgtgacacatgcacgtcatccgaggtaattagtgagattgattttttaaattgatctactaattttgtagatacatccggcatatatgtacaaagatatttttcaggaacaactgagcactcgagtaggttgtggtcaagtacaccgtattatcgagaacgatctcgacaaatgcaaagtcgtcgcgcccccaacccaccaacgaagagcaacgacctatctcatagcaccggtcatgcctggactactcgaggaaaggttgttaacggataattcctcgcgaacgccgtcggcttgatcaccagacatgattgcgaacggacatccggatatgctacaagttgggtgtgtgagtcatgctggctatatgagacgcacataataaaccaactctagcacttccattggtgttggagagataactctacacgttcgctggtcctcgaaccagtacgtagcaatctctctcaccgcaactttcattagtgttcgagagataactctacacgttcgctggtcctcgaaccagtgcgtagcaatctctcgcaccgcaacctccattggtgttcgagatataactctacacgttcgctggtcctc

SEQ ID NO: 55648 - DNA, 993 bp, Oryza sativa
ttctcccactatttctacttctagtggtcgagttgcgactaccacctggtcctctactccaacaaagttgacatcagatacacaatatcaccaagggttttacccagagatcccttgccacgataacacctagcgttgaaacctatcctactgtccctttacgccgtcttgacaaggcctccgaggaacctaagggaacttcggctggggacgcccagagccgataaggccttgtcggatcctgtagaaacaaaagaccatgtaagatctggtcgtgtaagagttctcgccgtgcgtattaaccaaaccgtgtaatcggaaattgagttttccaacttcacggctgggagctaggatcagtgcttattcaactgaggcaggtcaaaggtccaagagccttatcatccgagaacgattctccgacgacaaggctgggggctagggagagtgtatgactctacaaactgactggtcggagtcggtaagagagaagacgctcatatacaaaacactggaaaattctattcgacattgacgaaggctccatgtctcaatggttgtacaccaagatcgactaaggcgagtatgacaaatgtcgacaaagctccgtcgcaaattctgtgccttctcgatcactcgagaacggttggtggatctcgacaaggaatacggaatggagagatggtgtacccgccgagataaatttcttgacttcaatccaaattctcgattacagcaagacgggagacttagtcgtacgctctgtactttcttggttgacgtcggagattgactcagactaaccctttaggtgtccgcacgaggctgataaaggaagtctaacattatctctaaactcaccgagaacggtcacgtaagctcgataacagttcctccaaagtctgcggttgagaatatgaactcgttcatttgcatcgaagtcgggggctactgtcagggttatggataccacatacctaatagtagttgact

SEQ ID NO: 55649 - DNA, 4732 bp, Oryza sativa
tgcgtttgttgtgtctgttccaatcattttggatcaatactaggcaataaacttctactttaaattgttatctatctttacaacaactatatttcaaatttcttagtgtatgtttatcccacgaagctccataaagaaatcgccatttacgttaatttgggtatattgtctttgcttaaccacatcacacaattaccggctcacatattaattttgtaacccatagggaatacataaaagctttgattggtcagagagggtgaggatgtgagagttttcacatctactttgctacttgctgtactaacaatggcagaaagaaggtacactgatcacacattttataaaaaagaactgatctcgaggtgtatcttgaatgggtaaatcaaatggagattgaacatgactaccaatgcttttgtgaagagtagttgcaacaagctactattgaatttcaaaaatatgcatgtacttggtggaaacgatttcctcataagtgctttaccaagtcttaggaagatttgtagaaagtgatgagaaaagaatttatcccaagagagtatgcgctaatttcacttcgccatttgaagcatggtcaagcaaggtagtaaatctactcaagcttattatggcaagttgtgttcttccatgtgtcgagcaaatattattgatgagataaatgcaattgagtatttcaagacatatatcaatcctagaattgttgccgcaattgatgaaaaatatgtaagaagtgtgtgaggtttcttaagctatgccatcaacaaagaaaaaatatgtccttatgcgcaataaatcaaagatgttatagaattcctcctaaaggattcagtagccatagcatgaaagaatttagtattctccccaccaaattttgcccacctaatagtacatattttctgccaatatgtttgcttatacatcaagtaggtcatcagtttgcttctgataaagactatgtattttcaccccaagacagtaagatctccgagctcttctatactgtctataaaatgaatggttgcattacaattcttgatcaattcttgcaaccttgaaagatttttgctctattttttaaggtcttttctcaatgccttaagcttagcagtaatattcctagcaggatcaaggggactgccatgattatcccaaattgtttgcaccaagtcaaaaaggccctcatgctccacccagtaactctcaaatctaaaggtatgtgctttaggtatatttatcacaatatgcaccacacaagggatatgatccgaaaaactattcttgacaatggctttaccattgtgttagggtaggaaagagtccaattcatgggagagttcaatagatacaacaaaggttgatgttgcatgtaacttcaggtgtaagccatacctttaattggaagttcaaaaaacccaaagagctaatgacctcattaaaaggaaaaatatcattcatgtcagctctaggtctatttctgttcagaacagaacaataaaagatgatctaagtctccaagaagaagttgtacaatcttgtcacattggtaaaataatgtgattcagccaaagcaatgcgagcaacctcttgagcttgatgattagtttattttgagtaaatttcactttaggttacattttattactattttttcattttggactaccctttaaaattatttattgaaagatcttgtttttttaaaaaaaagtattaaaagagttgaataatttagtaatttcttgtccaccacatgcatcaagcaaaaacaagcccagatccatgcatcttctccttgacgatggtgtcaaaacactccaccatttccggcgtcatgtggattttccagtctccggccttccctttccggaagtatgacgcattcgggaaggcgaacgatgcctctcccatcttattcacctccaagctcttcaggttctcgaagctgcacagcctcacaatatctgtcaccagtccagcttcttcctcggtcgatgagaacggctggccaagaaagtcggcgagcttcctgacgatgtttgccggatctcgcagaaggtcctcatagaccagaaacaggaccttctctgggttcgccttgcaagcattccagtagccaataatgtgatcccagatagcgccggtcaagaacttgccatcgcaggcagcctcgaacacttcttgaaatgaaagatcaggctctataattctgaagaagtgccaggctgagaccaggatatccttcggctccctgcaatttgctaatttgttagcaattttagaagagtaaaacccaacgaaaaatatgagaatcatgagacagaggttcgaattgtcaatgataatctggtgcctggtatcagtactgatatatcatccaataaaaaattgtttgccagcagcgaagcttgaatgttgaaatgctaaaagggcatgtttgatcgggccaatagcgttatttttttttttttgaaaatttgctaaagctaaagtaaatttagtgtaaaattttgatgacatgggaaggcatagcccctatcgcctcccctctgtctccgtcattgttgtttgcactatgccggtcatcaatcatccatgttgaactggctagaagcatgcccagatcgatacaaaagaaccagatataagagaaatattctgaaagagggtaccaactagatataagaaatttacctgcaaatataaacaaccttgcagccaggttcatctgcaatggacttgggtagagcagcgtgctgcatgtgggtggacatgagcctcggcgacggcagctcatcaatcttaccaccccatccttcagagatcgccccctccatgaacgggacgcagtcgtgcgggttaagacggaggagcggatgccggtcactggcaggggagtaggcgccgcgcgccaagacggcgaaggcgagcgccttgagccaggtggtgccgcacttaccggggctcgcgaggacgacgtcgccatggcggcgcggcacgaagctccgctggatggccatgatccctggaagggtgtactccatcagccacatgccctggtagtgccgcaggcgcagcttgggatagctcgggaggctggacacgacgccggcatactcctcctccggtgaggatcgctgtgccattgcgtctccgatgacgtccttgaacggcacggggccaatggcgccatgttgtggcttgctgggggctgccattctgcctgcatcaactggcaagggaatggaccaataaatatagaggagacgatggagagtaccaaacaagatactgaagatagacttatcaacttgacattggcattgatcggtttctgaaaatcttatgcacccatgtcaaatgtcggatgacacagctagcttaattaggctgtgtttggaaaatgtggttaggaactaatcccctgtgcacgtaaaatagagcaatcgttagcatatgattaattaagtattagcttgaaaaacttgaaaaaaaaaattagtacgattttttcaaacaactttcatataaaattctttttttttttgcaaaagaacacaccatttagctatttaggaaacgagggagtagtagttgagaaacctagattaccaaactcagccatatagtgaccacctctgtcacaaaattaatcaattactactatagtttaaagttagtctcaaaataaatcccttttacattttttatcctctcaactatcctcaattcagcaattaactgttttatctcttcaaagctactcacccaccaatactacttcttattaacaatgggcagggtaatatttttttttaccactagagttttcatcggatacaagactagctatgatttattatggacagagggagtagttaggacattttggctgtgttctttctagtgagttcccaacatcaactgcaccatgtggcttgctggggctgccatactgcctacatcaactgacacgggaatggaccaataaatacagtcccataatataagggattttaacttttttgtttacactgtttgaccattcgtcttattcgaaaagtttatgcaaatataaaaaacgaaaagttatgcttaaaatactttgaataataaagtaagtcacaaataaatgaaataaataataatccaaaattttttgaataagataaatggtcaaacagtgtaagagaaagtcaaaatctcttatattagtggatgaagggagtagtagtagagaaaacggagagtaccaaattaaagatagacttatcaacatgacattggcattaattgatcggtttccaaaaatcttgtgcggccatgacagatgacagctaacttagccactgccaccgtcagaaacacgggtggaaaaaccatctttcgtcggtccggcaaaattcacaatagtcccggatccaaaaagaatcgggactaaagattgtttttagtcccggttataaaaattttgatctaccaaccaggactaaagacgatctttagtcctggtttatcccttgtcagatgtatgtcagggggtcgaggatctttagtcccggttggtgtcaataaccgggactaaagatcaccactttagtcacggttggtactaccaaccgggactaaagataaagatgatctttagtcccggttggtactaacaaccgggactacaattaaacacgttgtatataatccctatcccttatcc

SEQ ID NO: 55650 - DNA, 12823 bp, Oryza sativa
atctcaggagctccagttttcatgtggaagttgtcatcaatatcgtgaatttcttcaataaaaaaagtgacttcacaaacaatttcataggaaaaccatttgtggaaatagacctatttcataagcacattatctctttgaatttgtatttcgcaggcagcctcagccatcttcataaaagcgtctagaaatttaatcgtatgctcccataaaaaaatcattttcaaggatgaacttggacaagcatatgttcaaaagtttatccctagaagcatatataaaaactatatattttgtatgtataaatggtgtctatatctatatttatatatacactaaaataaaaaacgggaggttcactttttattagagtaaattgcataggcgctaaatttgtacacctatgttgtctacataccaaaactctcgaaatgcatatttatattcagaaatttatcccggacgtcatcatagatctcctctgaacttatcccagacttgtatgtcccaatgagggtcgggcccatatgtcagctgtggagattatggataccccatatctatatgacagttataatttagtcggatatacggtaccaaatatagatagaatatctttacgaggactcgggttagtttctaacttgtatgtcaaagaaatacccgagatcttagtcggttacgattgtattttacctgtaatcgcatattccgttagggatatggactgtattttgtaatatggatcccttcccctatataaggaggggtccgggttcctctcgggacgatttttttccctagatcatacaatcaataatctactcggcggaatcatccccggacaggagtagggtattacttcttgaataagaaggcctgaacctgtataaaattccttgtctccaaacctatccacttttctagcttgatagctaccccttttagtattgccgaaatcttgtttcgacagttggcgcaccaggtgtcacgcccggaatttctatccaaaattccaaacgcttacatgtgtgtgaaccctcgtccaggaatcagccgaggcacacaataacaaattgataatagagtacaattattactcaaactattaagcatataaaatatcattacagaggtagatagttcctctcaatcaataaagatctaagcagcggaaaaaaataagataaacggcgcagacggctccactccacaggcagcttgaccaaggctacacctaatcctccacaccatcagcttcactgtagaactcttcctctgatgaatgattgcaaggtgagtatatgacatactcagcaagccacgcagcaaatatgcaagtgcacaggataacaaaggatggcatagtggggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccaattatagcatcatttaccatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggctggcacggttaatgtttcacaaccgaaactcgtgaaccggtcttaattgtcatgagcacgaccatcaaaaccatgtgctcacaacccaccattatcaggttttagttggcacattaattaattaactaatcacgattgaccatcgtgaactatcattaagccatcattaaataatagtgagtcataagttatcccaaaagtgagctaatgtttctaagcagggctaagcaattatatctaatatctagttgaaccaatatataaagctcaactagtcaagttataattacccaaggtatcaagaaataaagtaaacaagaacaaaaggggctataacaaagaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttaaagattaaatcggattaaaacacttatatcgatttaaattgaattatgacgcaataatgaattatttttgaaaaggaaaagaaggtttattgcgtcagcgggctagggtttcggtggaccgggcgcacgggcggcggttcacgcgaacggacggccgagatcgaaccaatccaagatggacggccgagatcgatcgggtccacggcggctcacggcggacgaccccgatgacgtcagcggtgacgtcaccgacagccgcggcggctcggcggagcggacggctcgggcggcgcacgctcgccggcgaacggcggcactccggcacaaacggaggacaccagcacgtagaggacgacgcggcgaacacaccggtgaccaaaacggcggcggaagaacaacggacgacgacggcgacgaggaggaaacggcggaaaccttcgggttgacgacggcgacgaagctccggcgatctccggcgacggcgaaggggcggacgaggacggcgacgcgacggcgaacacgacggcggccttcccgagcgacggcgacggctgaagcgacggcggcgcacggctggagcgacggcgacgacggcggcgctagggcacacggtgctagagcttttccggcgacgagaggcgaaggcgaaggtggcggcgggtagaggagaccacggggagccttttaaagggactcggaggtggcggcgaaggcccacggcgacggcaacggcgaaggaaagctcggcttggagagagagagagcccgatctgattcgaactcgaatcccttgatttccaaaccgatttagccgatgattccaaaggagaaaaggtagaggagatcccgaggatcatttcccctctattgattcggccggagaaggaaagggacggccgaatttggaaaggaacggcggcggcggctcggcggcggcgcgctagggtttcggcccgaggaagacgacgggcctgacaggtgggacccacctgtcagcgaccgaacgcacgcgcgcggcgcgggcggctgcggactaggccggactgggccgaggagagagagaaggcggattttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattattttctagaaattccatttaaacaacaatttatataatttgaatttttagggtgtgacaccaggtaggggcagcgtcaagtttttgccgacaaagtgcgatgggttccgtctccggcgtcgacgacctcgccttccctcctgggcaggcgttccggttcagcagcctcaacttcatcacgaacgaattcggcaagatctctctccttgactcggattcgaaccagtcggggagagatcaagtccccacgccgttcggtattctgaactcggccgagaactacttcaagatcatctctcccaagtcggctttaaaccactcggacgagatccaatctactcctcagcgaccagatcaagatgacgggtcctatccctcaatcctgatgagacttcctaatgatttggccgctgtcttcacagccaagacatctcccactcaaagatctaggcgagctccggcttcggccccgatccaatctagatccagagaggttggcgttatactccaacctcttgggacagtcttgacggaagagttggacggctaccttagctcccctggcgtaagttctcgaccaaccgaaatcctcgactacgacgacttcggctaccaccacgaccacgacgacttcgacgatagctataaggatagctacacgcctctctttttcggcgtattcatggctgacaacgaaacggaggaacagcaccgagctcgagaagtggaggaagagcgcgcacgacaagaaactgaacgtcgccgacaggaggaagaacgacaacgacaagagcgagaacgactacagcgtgagcaacaagatcgcgagcgagttgcaaaggaggctgaagatcgacggtagcgcgccttggaatccgggcgacgagcgagagagctcatcgggcaacaagacgtcgatggaacaacggtttttcgcaccccccagcagaacgcggttgcagcaatcactctcctcgacaccctccccaaggaagacgcactcaatcaagttgatcatgttgtcaacatcttgaaccagacgaagaccatgatcgctgcttcggttctagccaactccgcaagcactcgcacgccgactggtagccgggttccccatctccgatctcatgattatcatcagccaagcctcagcatcatcggtacaggatccgtcgcaggagcagggaccacgacgaatgatattttcactcgcctcccgaacgtcacggggaacgccgagtcgaacggcttcgctctccacctcgccaacgccccgtcgatctttgcgacacgatcaactagcgccatgcagcacgaggtcaccgtcattcaccagatcgctacgacgacgacgtggatggagtagctgccttcactaatgacctgcgtcgagtggattggccagccggcttcaagccgactggaatcgagaagtatgacggcaccactaatccggagtcttggctcactgtctacggactcacaatccgcgcagcaggaggagacagcaaggccatggcaaactatctacctgtggccctagcggattccgcccgatcctggctccatggactaccccgtggcacgatcggatcatgggcggaacttcgtgatcacttcatcgccaacttccaaggcacctttgaacgccccggcacacagtttgatctctacaacgtcattcagaagtctggagaatcccttcgagattacatccgacgcttctccgagcaacgcaacaagatctccgacatcaccgacgacgtcatcatcgccgcctttactaaaagcattcgccacgaggacctagtcggcaagttcggacgcaaacctcccaagacggttaagcagatgtttgaaaaagccaacgagtatgccaaagccgaagatgctattaccgcgtccaaacagtcgggcaccacttggaaaccgaagaaagacacgccggctgcaggagggagtggaagtaacaaccacaaggatcgcaagcgtaagcccggagaacttgtggcaacagcctctccatcttcccgacaacgttcccgcgtcaacaccttcgacaagataataaactcccaatgtccgcatcatcccaactccaaccatgcggccaaagattgcttcgtctacaagcaatttgcggaacaatatgccaagaacgcgcgtaagccttcagacagagatcaaggcacatcaaagaagaaagatgacgaagacgatgccccgactggttttcaggactctcgcaaagaactcaatcacatcttcggcggacccctggcttatgaatctaagagaaagcagaagctaacagaacgggagatcaatgcggtttagcctaacacaccccaataccttcggtggtcagagatagcaatcaagttcgactgctcggatcatcccgaccgagtggtccacccggggcggtaccccctggtactagacccagtggttcgcaatgtcaagctccgaagaactctcatcgatggtggtagcgcactcaacatccttttcgctaagaccctggacgatatgcagattcctcacatggaattaaagccgagtaatgcacccttccacggtgttatcccaggattgtcagctacaccactcggccagatcactcttccggttacctttggcacttgggagaattttcgcaccgaaaatgtttgtttcgaagtcgcttatttcgagacagcgtaccatgctatactcggatgaccggctctagccaaattcatggccgtcccacactacacctacatgatgattgtcacgaccggaaataacccaacgggcgttccttacgtgcgtgcattattccttgtcccaggaggcaaggtacaccaaaagttgatacaattcagagtttaacaagcggaagcgtaattaattaatttattacatgggcggcgaagacccagcacacaagaagacaaacgaaaaatagcggaagactagggcgacgaccacaggcgcttgacgacaggcacgagctagacaccaaagccttcatcttccaggggctcctcttctgggtttgggcaaaattgagcaagactgagtacaaccaccgtactcaacaagacacacccacaagtgcagaataaatgcaagggagtacaagggggttaaaatataaagggttagggtttgcagtaaacagcattaaaagacagttagttgctcaaagctattttgtaaacacgatcctagagctatacaatattattaatcaaggccgtgaacccacacgaacctgccttaacccaaggcctacgatgattcagaccgaactggcaacccgaccctaggtcccagctcgtcccaagccaacccaggccaaccattctacattttggttgttaagcaggttttaagaattaaaaatactaacttgggtacattgctcggcttgcccataaccgagggcgcggctattcgaatagattatactctgatcagaggtgtacatctttacccacaagacacatcttcctcatatgtaaccacatgccacataccaccacggtatacggacggaagacgtgacatagtttccaacccatcctagccatagataagagtaccgacccaaccccacctacggccggaacctccgggacaggtaggcaggactgagcccctagcagcaggacaccggccctgtgccatgacatctcgactactgagccgcagctcgtgtagccttcatttgttctagagatgtccatcgacccccgacttcgtccatctccatccgtgtacttttgtttataaccagactgagccacaaactaagccttacccactagacatgtggaagtacggtagtgctttgcaacagaggcctgaagaccggtccttatatggccgaggtgctactatcaaaaccatgcaccccgagcccagcctaaaaccattttgagggttttgaatagagggggaggtgtgaatccaattccacaataatccatccattccatagtgtccaggtgatgagaatattcccaaagtctagagttgtaaaaccacctaatgttgcctaattaactagcgaagcatctacctaaaatcatactagtggtaccatgagtagataacaataataatatcaataacaataataataaggtcataacaaaggtaaataggtatggctaaataaaacagtgataacgcgggaatttaagtaaagcgataatgcaatattttaaatcaaaataattttataaactgggattcaatatgctcaaggatgatgtgacttgccttgctcgctttcccaaacgtcggcttcaacctccacgaagagcggatcttccgaagctgcagcgtctacacgaccaacggaaaagaaatggcttttactctaataaactccatataaccagcaggaacaaagcacaaaaatgggttattgacttcataaggaaaaattagagacttgaacggtccaattccgagttcaaatggccaagttatggccatttgaagtttatatgctctttaaatgaatatttgcgaatttcttcatttaaattttaatttaaaaagggtttattgcgtcagcccagggggaggggcgcgcggactgggtccacgggagtggggcccacgcggcagcctcacggtccacggtggaccgggcgcacccggctcgcaccggccggcgccgtgggccccacacgtcagccgcacacgagggcgcgggcggctgacggctgggccccacgcggcagccactcggcgcgcacgagggcggccacgccggcgcggtcggcgggaggtggcacgcccgcgccccgatggtcgccgccggcgaccaccggcgcggcggagcggcggccgagagaggggagggaagggggaaaggaggcgacggtccacggctcaccccggggcgacggcggcgacggagggggcagtcggagtggagggaggcggcggcgcggctcgggtcgacggggtcgacggcgttccggcggtcggcgaccgaaacggagagctggacgaggtcggcgaggatgcggcgaagccgaaggaggcggcgccgaggtgggaggcggtccggggcgacgacggcggcggaccggagctcggcggcgacggcggagagacaaagcgatgtcgcgggctcgaatccggcgaggaggaagggcggcgagaggcggaaacggacggaggaggtgcggggagggtttaaattgggttggaagggggagagagcggccggaggggaaggaacccggtgcgggaggtccggccgccatcaatggcgctggcgagatttgaacgcgagagagagagggaaaaatatggggaaagggagaggggatcacggggagtaattccccccactttattgcacgtggggacggcgggaggcggcgggattcgcggctgcggcggcactagggcgcgggggaggcggcgggagcggcgggaggaaggggatgacgggtgggccccacccgtcagcgagggtggcgggcgggcccgcccgtcagcggcgcgctcgcggggagagggcggatgggccgcggggagaggagagagagagagagagcgggggggagagatgggccgggccggcccaagggagggaagggggactttttagggtttttctttttataaaacctttttaactttgtttatttcttaacaattattatttgtgctctgaaaattccactaaaatttagttacgtattttaggcttctaggaaatatacaaaaatcctctaagcattatttgacttttaactttgcacattttatttgttggagactttcacatggattttaattattctaggcataatttagaggatatattttagggtcgttttaggacgtgacaatgatgaagatgcctgctcctcgaggagtcatatcactatggagcgacatcaagcaagccgtcacatgtgacaaagaaagttgcgagatggcccaaacccgcgagatcacccttgctcgtgaagagatccgactgactacgactatggcaagtgaaggagaagtgcctgcgaccaagctgtcaaagaccaaagaaggcaacgacaaaactaagaagattccactagatccctccgatcctaccaaaactgttgtaataggagctgagttagattgtaaataggaaagcgcgctcattacctttcttcagaataataaagatatttttgcgtggaaatcatccgatatgcctggtattcctagagaggtgattgagcactccttatatgtcaaggaagatgccaaacctatcaaacaacgactccgccattttgcacaagataggaaagatgcgatcaaagaggaattaaccaagctgttagcagcaggcttcatcaaagaggtcctccatcccgactggctggctaatccagtcctagttcggaagaagatcgggcagtggcgcatgtgtgtcgattacaccaacctcaacaagtcttgccctaaagatcctttcgggttacctcgcattgaccaggtggttgactcaacggccggctgtgagttactcagtttcttggactgctactcggggtatcatcagatctgactgaaagaatccgactgcttgaaaacctcgtttattacgccctttggggcctactgctacatcaccatgccctttggattgaagaacgcaggagcaacctatcaacgcatgattcaaatatatttttcaactcagatcggccgcaatgttgaagcttacgttgatgatgtagttgtcaagaccaagcagaaggatgacttgattgcagatttagaagaaacttttgcaagcatccatgttttcaggatgaaactaaaccctgaaaagtgcatcttcggagtaacgtcagggaagttgctcggatttatggtatctcaaagaggcatacaggccaacccggagaaaatcaacgccatcctcaacatgaaaccgccgagctcccagaaagatgtccaaaatctgactggttgcatggcggcgctcagccggttcgtctcacgactcggcgagcgggggatgccctttttcaagctgctgaagaaaaccgacaatttctagtggggacccgaagcacaaaaagccttagaagacttcaagaaacttctcactactccacaagttttggcctcgccacatccacaagagccgctactgttatatgtgtcggcgacctcccaggttgtgagcacggtcctagttgtcgagcgtgaagaggaaggccatattcaacaagttcaacgaccaatttatttcgttagcgaggttttggcctactccaagacaagatatcctcaggttcaaaagttattgtatggtgtcttaattaccgtcaggaaattatctcactactttcaaagtcactcggtcatggtggtcacatcgtttccactcggggatatacttcataaccacgaagcaaacggacggattgcgaagtgggccttagaattgatgtctttggacatatctttcaagccacgaacttcgatcaagtcacaagctttagctgattttctcgccgagtggaccgagtgccaagaagacatgccagaggaaaagatggaatattggactatgcattttgatgggtcgaagaggcttacaggcactggagctggggttgttctaatttccccgaccggagaaagattgagctacgtattgtggatacatttttctgcgtcccataacatggcggaatatgaggcgctgctccatcgattaaggattgcaatctctctaggcattcgccgactaatcatccgtggagattctcagttggttattaatcaagtcatgaaagagtggtcttgtctaaatgataatatgaccgcttatcgacaagaggtacgtaagttggaagataaattcgatggacttgagctcacccatgtcctcggacataataatgaagcagcaaacagactgtccaattttggttcaaaacgggaagcagccccttcagatgtgttcgtcgaacatctttacgaaccgaccgtgcccagaaaagaaacaattgaagccatggatactcaaggcgtaagcatgattgaagccgactggagagaacctctcataagatttttgactaaacaagaactccctcaagacaaaaatgaagccgagcagatttccaggcgcagcagactctacgtcatgcacgagaccgagttgtacaagaaatgtccttcaggaattttgcagcgctgtgtatctttggaagagggaagacaattgctgaaagatattcattcaggcatctgtggtaatcatgctgctgcatgaaccattgttggcaaagcctatcggcagggtttcttctggcccacagctgtttccgacgccgacaaaattgtgcgaacatgtgagggttgtcaattctttgcccgacaagctcatttaccagctcaggagttgcaaaccatcctgctgtcttagctgttcgcagtttgggggcttgatatggtcggtccatttaaaaagcagtcggtggttacactcatctctttgaaatattgaacaccttcgtcaattttgtgcttaggcatttcgtttgtatctttcctctttgactgctaacttcaagtttttccttgaagttttcagtcggggggctactataataataatggaacatgatttttatcaattcaatttgcttacttgatttatcattgccatgcttgattttttggcttacacaatgaggactgaaagttttttaagaacttttgcgagttttagactcaataaggtttgacaaaagcttttaagaaatcagaggctaactttgaaatatctagcacagcataaattcatcagtattgtacaaattgatcttccatcatcatcagagggctgcagga

SEQ ID NO: 55651 - DNA, 6945 bp, Oryza sativa
ctgcagcccctttagccccgtttttattgcaaccgggactattgtggaatttggctgaccgacgaaagatggtttctccaccagtgctatcttcagtcgttccccctcctacaacggatcgagatcctcgcaccgctataaacaagatcgatataaatcaggtgatgtgaaaaaaaagagcattgaaaatcaaagatgatgaaaaaaaaacacggcaaaagcaattgggagaataaattgaacacaaagttctttgtgtcagggttatggataccacataccatgtcttatacggaaacaatcttcggatataggaggagttccggataaggaaggatgaatagagttctacatggaaacgacaagtactactcggattgtatccataatggtttccctagttctacttggataaggggacacctatgggtataaatacaaggccccctaggaggagaggggacacggaacaatagatcaagacacaagatcaacatacaagccaacatgcgccaagacaagacgccgaatatcgacttcagagataagtatgactagtcccctacggtgtctacggatattgtcaggagagacatagtgctgtctttgatctcgcaggatgcggattcgaggaggaatgctaccctattgtcgactacgagtcaacacttcagaccatcaagtcgacaacagttagataggctaccccaaatattatactggtgtgattatggtgaataagagtaacaaccggcttcggccaacagtagggtcattacttgacaatgcaggagcccgaacgtgtataaaaatccctatctccatctcttttattacaatctcgcatatatcctagtaccaacgatctccatactatgcaaatactataatcgcgacatcaaacgtagacactttgcatattgcttgacttcattatatcagctttctataccggggatcaaaattgcagcataaaacgagggaaggacaaacaatgaaataaaaagcaacacatttccaatacttccaactatctgctccctttggcaacaaaagaaaatccattactacgtgcctctgcccggtgacggcgagggaacggaccaaaaggaataagttcatcggaggtcccttaactttacaccaaattcgattttcgtccttaacctaaaaaccagatacaattggtccctgaactatcaaaaccggtgcaaatgaggtccctcagcagtttggaaggtggttttggttgacgtggtgggcacatggttggtttgactaggtctttcgtctcacgtgacattgacgtagtgtttacatggtaatttaaccctggaaaagaataaaaactgtcagcccacatgtcagctacacaccaaataatttaaaattggtggctcccacgtggaccgcacatttcatcctcactcctcgctccttccctcttccggctgcaagcagacggcgacctcggccgccgtcaaggacgcggactctggtgttgacctcggccgttggcaagcaggcggccacaccggcgacctccgtggccagcaaggaaacggccacacctgcgacctccgcggctggcaaggcggtggccaatgcgccggctgggcacacgagagctcagctcacggaggagcatcaccagcaatcctgctagcccttgcctgttcatgttgcctccggccacggtgcttgctagacggtggcatcgccgctgccaaaccgaacgttgcagtggtggtttcgtgtgctgtcgtcaaactttcagaaccgcttgcagtatatagatgaaattgattgatgaccatctctcaacaatctcgagacctcacaggatccaaaattggaatgttcgttacttcattatattttttaacacagtaatatcataagcacacgcaatcaaaagtggttttttttttctcgtgattcatgaaaagaaaccaaggctcggttcttcagtttctgaacttgaagcgatagtgctacaggttactaggggctcagcgacggaactcaagtgcaaccggagtgtcgcatggaggacttctctgcagtggcatgttcaggttcgtgtggtaagatgcagtggcgccgttgcccggcatagtggccggaccatcggatggacagcaaaacgccgccagcgcgccgccatgaagcaccagagtgcggcggcgtccatgtggccgcacatccaccagagtgcgctccggacgtcggcggcagtggcgaagctgtcgggggtgccggagggggccaacacccccctatccgacactccccctcccctggtgctttacgtaacaaggctaggtaggcagcaaacgtgagcccattagcatgttaattacccattatcactaaacatggtctagaaaattaattaacgagaaagatattagagagacaacacagattaaggtcttgtcttcatcgcttcagctttgcatgatgtgcgcacctctccatcctcccacgtaccgatggttgtggcctactggggagttatttctctgatctctctcccaatacaacaatacctaaatatttgaccgttttctatccctgacctagagattgtagtctaacttagtactcaatttgtgaagatgaaaaatcacaatgattgtatggcaaaacatataatacgttgttttattgtcgacattggttatttagtcttatggcttgtttcatccccaccacacccccctaaccttaaatcctagcttcgccactggtcggcgggcggggactccgtgcactcagcctccgcgagtccgcgacagccgcggacagcgccgcctcggcctcggcgaggaacgcggggacggcagcctcgcgggcatcgagcgccgcgagggattcggaggtggaggcatccgcggcggctagggcatcgtccagcgacgcggagattcacgggatcttcctctggtgccccggccgcgggcgaggccgacacagccacagccgcagccagaacacgacgccgtcgaagctctgtgacgtcgacagagccgccaccggacctgtccggatcagggtcgaggtcgcgcgtgcgggctagcagtgtcgccagcgatatccatgcgtggatcgaccgggagaacgtggcgcacctcgttgttgtgctgcggtccgatggagacgatgcggatgcgggtgccgcgagccgcggtgatgtctgtcttggggaagaaagggaataggggcggcggccgccgacgttaggcccatgggggcgggagtggagggagcagaggggagagagatgggagatggggagagagaggaggaagaagaggaggggattgagaatgacaggtggggcccacatgagcccaaccatttttttattattatatgtatgatgctcacatgtgggtcccatgattttattatttttccatgttgaattgcaccgtaagcaccatgttagatgaagatagaatcaaattagccacgtaggccgtcagctaaaaccgctgttcaaaccaccatgggacctgtattggatcggttttaacagttgagggacccgttgtatctgattcctggttgaagcacaaatcggactccatgacaagttaaaggatctcatatgaacttattccggaccaaaatgaccaaagtgaggtacagattggtttgtgggctggatatagctagtagtactactatggcccccgttcttttatctctaactagattttttatcaagattttcaacaaatataggtaacctacagaggggctggaaaaagaagaagactaaaatgcatttgatttatgggtcttctgaacttttacatgcacgtgttatataacccaatcgttaacagggctcgtgttttcctaaattataatgaaaataatgatcgtacctgatcgataaataacaactcacttaggcaacgtcgagggagacaaattaaaagcagaacaatcatgttttttctaaaaaaatacgagccgcacaagacaacgcgagtttaatgtattgatataacaagcgaaaaatacaagtctatagtcctgaaaaactatagtcagggaaaaaaacaaccacaccgcacgtctacaacacccgctgcaagagtgaaataggagattcatgttaaattctaagcaactcgatcacgttgatgtgctctatttcttttaaaaagaatgtaaaaatatgtatttccaagctaattagtagcaaaggccatcctaaccatcggttgattgctagaagggctgattgagtattgtacttaatctgtaccgtctgataataaataaatattagcaaattttgctactatagatatcacgaatttatatttagttttaagacatcataaaaatagatatttgagaaaataaaaataccactatcaaactatgattatttactactttcgttgcttttgcgacttcgtgtttttaactaattaaatttcagacgaattttgctatttgacaaattttggtttactcagttaaactatttaaatcctcacaaattttggttaaccgagtaaaagtttggttgcaactatttaaactatttaaatttgtgttgagttaaacttctctaactttggttgactttataaaaaaattaaattcataacaccaaattaatttaattagattcatcataaaatatgtcttagtagtgtatttatttattattatacatatttgtgtatttttacataaagtcagaagattagcttaggaataaaaaaagaatggttattattgaacctatgatattaattgaggccaggcgactatgccaatagctagctctcatataaatcttcacataaatactacatctactatctatcacacaaaaaatagagattgagatatcgcattgtatgggagcttgcaggtgcaccaagaggtgtgctgattttcaattttgttactcaaccaataccaccacagcagcaaggccaaataaccatgcaccatcacagcgtaccctatcattgtcgttgcgtaaacgaactgaagagattcttcatactcaagaatcagttgcaccgttttatcgtccgactatgctaaatcaggttgttgtcacttcatggataagagaggcatcttggtggttcctcttagggtccacttgtaaaaatagtgatttacagggcgttcaacttttacgatgcggttcctatatagctcaatttttacaagcgttgtttttaataccagcacatgtgaagactgtttttaatacctcccattgtatttttacatgcatgtgcattcttgtggaccgaaaattattttaagtagtgggaggcaatacatgaagctacattatcatgcaggtataaacataatgttttaacgcgaagcgagtgtagctcaacttatttagttccttgtgatgaaactgcctcacctaagttgaagtcatataattaacttgggtcctggaatttacaactaattaattttttttaatgctataggtggtgtacctcatgatagcgaggcaacttcatcaatttcaagatgtgccagcctagcctttcggaaggaatggactatacgcgtgtgtgcgtttataagagtgagttttcacgtgttatgagctcatacatttgtatcgtgtttcataagaaaaatgttttagttaactttaattttggtacggcgaaaaacctaacaattaaatccaataacaaggcatggggtaccatccagttcaattcaatggagatatatagcggaccataaccattcaaccattctttccattagttcaatgaacacgcatgtgtagttgcccaaattaagctagaaaacaatagggtcaacaccacctgattattgttcatttaattcggcctgctcattaaagtagaaggtacaactgtacgtgcttaagatatttgttttggtacaacatatagtatcatgccagccctatttagcacgtgtctataagaggacatcatttcaaaatttgccattaaagcataccatctaaaatctttaaaagaatactccccgtccaagttagctcatcctccgagcaaaggacaccaaaatattcatcattctcaaattaattcttattggttaaggtgctctatcgcttcgtgtcctgtagattgctcatgttttaaatattactatatatcattgcaccaacagaaattaatcttgattggttgtatgcaacatacttaatgatgcatattttactttttacataaatatacaaagagatatcactggtggagaaagtctttttactcccggttggtaaccccctatagtcccagttttccaataaagagtacgaatccgggactaaagatcgctatctttaatcccggttcaaatacctaggactaaagatcgatctttagtgccggttgatgttaccaaccgggaaaaaagagaggaatctttagtccctgttgataacaccaaccgggactaaagagagagtagcgtttttttttcttttgctagatttaatctctatattttctcccgaatctagtgccatgtatatccctaaatcaatccccaaatccacaattcaaagtaacatcctaagttacttataaacataaatcaaatacatcacaaatcctaaaaaaatacacttaaatcaaatacatcacaaatcctaaaaaatacacacaaattaaatacatcacatattatacatcttataaccatgcaatgaatcacaaaattacacatctcaatcaatcacaaattatcaaaaaaaaagaaaagaaaagaggccggccggtagtcgagagggcacggccgccggcgggtgcgcccccatcggcggcacctccggctgcccgccgggagcgccgccgccggccaccgtcgggcgcggccccgccacccgccaacccggcaccgcccgccatggtcgccgccgggcgc

SEQ ID NO: 55652 - DNA, 9546 bp, Oryza sativa
gagcaacaccaaccgggactataaagatgatctttagtcccggttgatgtcaccgatcgggactaaagatcctcggccccctgacagactactgacacggaatgaaccgggagtaaatatgatttttagtcccggttggtgtagatcataaaatagctgtggtgtttttttttgcaaccgggactattatggattttggccgaccgaccaaagatggtttctccaccagtgtatactggttagatgattatttgggaataacttaataacctagagaatgatcaaaacaggatgaagagagtatagttgaagatcctaagagggtagttattttagaacacagctaacatagttttattgcaaaagcgatatttggccttagggtccagatgcataccaaccattgtccctctcatcgaaataatgatggtcaccgtgctttgttgaaacttgaaacctgaattgattgcattatcataaaagataccgtctgctatttccatcacaatcttatcttgtagataatattccgtatggaaataagggcaggtcgaaacttttttctaaaatggcacaattggcaaacttccagtaaaaagaaacattaaatttagggataatttcgttcttacccctactttcatgtctaatattaattttgcccatattttttaggttttcgtttttaccttactttttttaaacgaatcaatcgtttacttttgttccgttaattcttgctaacggtgttaaatgtgagggataaaaagataagtaaacccttaaatatttttccgtacttttgacataatcaaaatacagacctattgatgccattttatagcagtaattttatttgtcaaaattttgtaaaagtttgccaaaatttgggtcaaatttgaaagtttgtatgaaagtaccggaaaatatctaagggtataattgtcctttttaccccacatttaacaccgttagcaaaaattaacggaacaggggcaaactgcttattcgtttcaaaaaagtgagggcaaaaaataaaaaccctaaaaaaaacaggagcaaaatcaatactggacatagaagtaggggcaagaacaaaattgccccttaaatttaacattaaagtcactacgggtgaggaaaatcaatgaaaaatgagtaaattttacaaaactatagttgcattagtcaaattatcacaaaactacatatttaacattaaatttcttatagaattacatatttaagatggaatatcgcaaaactacatatttagtaataaagttatcacaaaactatagattttatatcaatttgatctcaaaatttggacatttataactcaaacataatattattgccaatgatttaaactcaaatttgtagttttgtgataatattattattaaatttataattttctgctacttggcctttaacatgtagttttgggataaatttattgttaaatctgtagttttgttatacattacttttaaatctatagttctgtgattatttggcctatgtatatgttgttctgtgaaatttactcatgaaaaattaaagtgacataaataaaaattgacttcctcctcacaataaagtagatatatcgttccatcaagatgatccggctgatgcagatcagataatcgtatgtaaaattctccctccgtcccaaaatataagcatatttggactttgacatggtcttcgtgatgctactttgaccaataatatttataaaagtaatatgttttaaataaaaagagttgtaaattatgatagtttgtttagtgataaatctagcaatatcaattttacatgattgatcttttttatttttttgctattaatagttaaagttataaatatttgacttgtcactatgccaaaagtgcttatatcgtgggacggagggagtatgttagatctttctagtaaaaaaggaatagttgtatttctatatatctactagaaaaagtgcccgtgcgttgcatcgggtgaagactattttaatcttattattgttatatggtttagttaagatgaaattcactatgttaaatttgcttggatatatagggtgtgtttagttcacgccaaaattggaagtttggttgaaattggaacgatgtgacggaaaagttggaagtttgtgtgtgtagaaaagttttgatgtaatggaaaagttagaagtttgaagaaaaaatttggaactaaacacggccatattttgttagaaaatcatgagctgcaattaggagtccgatcgtctcaaattagcatgcgagtttttttaaaagagatctcttgtgtattttaaaacgcacattttaaaacccacctctacgtacccaagtactgacaaaaacatttttaatttttatatttttttgaataaaagtagtcgaaccttttgtaaagagtcggacattttttgaagtagattacggacgaaaaatcttttttagggagtcgaaccttttttagggacttttttttaggtagaagttttttttttctttttttttctcgtcttttttttctccaccagggagtcggacgcccttttatttttctttttgttttgggatagatttttttctcttcttttttttctctcctttttcttttccaccggaggagtcggacttttttttccttttttgccgattgaagttttttctctgttcttttttttctcaccggacggacgacggaaattttgttttattttttaagtagtatatatataagtagaagtagaagtagatatagagatatatagacacaatctgtacatttttgcaggtggggtacaaccatgcaacaagaagtttctttatccctccatcaattattcaattacatttgctattattcgcccatatactttgtgtaacgggcactcaccggctcaccactgctaaaacgatttagggagtgtttgaggagaaggggatcgaggagattgggaagatacgcaaaacgaggtaagccattagctcatgattaattgagtattaactattttaaattttaaaaatggattaatatgattttttaaagcaacttttctatagaaattttttacaaaaaacgcaccgtttagtagtttgggaagcgtgcgcgcggaaaaccaaacaaactctctctctttctccacccaacgaacgcagccttattcaggatccaggcgttcatattcacagggcgtcccaaatttctaggccacacagacactgctttttcaaaattgtctgtcctttctcaaggtcttatactgccaaaaaatcctatttcaacacgtggttatttaagaaaaccaaccatgcataagcagagaaaaaggataatatgccactccattcggtgggtttcgatgaaatgccacctaatgtaaaggatgaaataccactcactgagttattttcgggatattttgccactgaaaaattttaagaccaaaatacattggagagagaaagagagaggtgaggggagcaccggggaacatcgagacggcggcgtctgtgctcgtcagcggccggtggtgagggcgtggggacgaacgactatgggggagggggacggtggtgccgcgagcagcgggtgacgccgaagaaggtgagcggtgagcgcatgcgcgggtggcgccagaagcgacgagcatggagcgcgcgcacgggcggcgccgaaggcggcaagctacaagcgcgtgggtgggtagtgctggagagccctccgcatcgtcgccgcctcctcctccctctcatcggcgccaccctcctcctcccccagtcaccacccttctccaccatcgccaccgccgtctccccatcagcgccgtcgtcttcctcctcccatcagtgtcaacgtcttcctctccccgtccgcccgtcgcagccaacgccccacgcccaccgccgggaagcatgagtaccgtcgatctcaaccttccccgctcctccctcttccaatttatccacatccaagggtattttggtcttaaaatcttccaaagtgacaaaatatcctgaaagtaacctattaaagtggcattttatcctttgtattgtagggggtggcattttgtcaaaacccgattcggagtggcatgttgtcctttttctctgcataagcataaaggcaactaaggaggtttttctaacgaactgcacgtggaaactcacttctcatttctctcccctcctctctctaaagacatataaaaatgatttttaccggcgttatataacgaactaacattgaaaacataaataatactattttttttaaaaaaaagtcataactttaatatatcaagaacgaatgatgacaaattttgtatcaaaaccggaactctcgactagatatacaacattttacttgaaagttttctcaattgagatcacacgttttacttgaaagttttctcagttgacatcatattaggggcccaaatgttcattaaaatgtttttcttgttctgaaaataggttgatttttacgcaaggttctctttataatctgcctgcaataaatagttagtgcatgcagtttgttgatattttatttaatatggcatgtgagaatcactattagattttcacggacgagacctcttggaagctccaagcagactgtaatggcgttcgcatgcaaaaataaatagggtggatcaaggccagcttacggaaagtcattttcgcatattggcattttaagaggcccgcaggtgaaaatgagttttgcagtcagatgtaaagtttcgaatgcaaagtgtgtttgtcaaaatcaccttcctcccctattttttttctccgcctcctctatgtccccactcatttctctcccctcctctctctctcacttctcccccttgtcccgtctagcctctttccctcccactcctggcaacagcgagcggggccgcaacagtgtcgacaagagcgggggcgagctcgggcgacggtggtggccacaagaggagcggatccaacggctactccccctcctgcgtggatctcaccgcctctctgccctccacgtgtgcagatccaccgaggagacgggcagatcctacggcttcaagcgataatgatgacgaaggcggcagcggtggcggtttcgagcgacgatgatactactacgaaaaccatcttttgtggcagtcattttgggttttcgctgacggtatttagcgccgccacaaaaaaaaaggccaatgaaaacatagcatcttcgttggcggctctaaaccgctaaagaaaataacttttcgcttgcggacggctaaagacaaccgctagtgacaatcatttttgcttgcggctgtcgtatgtgggccgctagcaaaaatagtcttcgctgacggctaccttatgtgctccgccagctaaaatagtttttgctagcggcttcttacgcgatccaccagtaaaaatgattttctataaaaaaaagtaatccccaaaatctcttttcgccaaaaaaaataaataaatcagattttcgcagcatgtacatattcaaatccacatccaaatttttgagtatatattcaaatccacatccagagttcattagattcaataatgggtgaatagccaattcagtccttcaacttttgctcaggggtcgaattagtccttcatgttttataatatccaaacaagacctaaagattatcatgcggcttaatatagtccttagaccaacttaaaacgccacgtggatatgccacgtcatttgtgcatataagataacatttaaatgtccattttaacctttaattttctatcaaataaagaaaagaaaaacaagaagaagcaatcataaaacaaagaaaaatgtcaattatttttatctatcaatgctacatatttttgccaatggtcaaaagctttttttgccaatggtcaaaagcttttttttgtgtgttttctcaatagtttttcattatttcgtatgaacagataagggtgtaaaggacatttaaatatttaatttgcatgcatagatgatgtggcatgtacacatggcatgtttagagggtcaaaagactatattgaatcacacagtaaactcaaggtacttgtttgcacaatacgaaatgtcagggactagattgatccttaagcaaaagtttaaggatcatattgggtattcacctttcaataatcatacgagtgaacacgggcttacaaacatttagaacatgaaaaaaaaaactgacaaaaaaatcgagcaagccccgcagcaagcaccaagccgtcgctgaccaggtcgtcgtctcaccgaccgagcagcaagcaccaagccgtcacgccccgcagcaccgagccgtcgccacacccgtgggagggggagggggaggagctcgtcgcgccccgcagcaatgagtcgtcgccgcgaccgttgcagcaccaagccacgtgggagggggaggacgaggaggaggaggagctcgccgcgccccctgtcgccgtcgagccccccgacggctcctcccatcgtcgtcgccatgcccccacctcccgtcgcagtcgctgcgcgtcccgttgccgtcgagcccctcgatggctcctcctgttgccgtcgccgcacccccccgacgaccgcctcccgtcgcagctgtgcgcccacctcccgttgccttcgccaccacacacagctgccggagccgccgccaccacccgagaaccccgccgtcgccgcctgggaggaggagaggatgtggatctggaggggaggaggagaggagggtgcagggatttggaggagaggaagtggatctggatctggagagggagaagtggagatatttttattatgcggtggtgggtggataagggtatgcctgtatgggcgcgcagtgatttgtttatgtgcgaatttttttaagagcgccagcggaaatcaattttcacctgtggttgcttaagtgagccgccagtaaaaagaattggatcttcgctatcgggctatataacctaaccgccagcgaaaattatccatctttgctggcggcgcatctaagtgaccgccagcaaaaatgaacatatcttcgctggcggccggtataacgtggacgccagcgaaaatccattttcgctggcggtcagtgccccccaccccctcattacgatattgctggtggttttggtattttttcgccacgcataaaaaatcgtttttctagtatatgcgactggaagggaggaaccaacaacggtgatgtttgcagtggattcaagcatgacggtcgtgacagattctagggtttctggaatttggattttgatattcatattttttattattttgccttttttgttttgcaaatggacggcttaagggcccacttccaaaagttgtattttcgaaagcggttgcactacctgcatgccaaaatattcatttcatagggtacaggtgggaagcccagccgcttctgaaaatcgattttgaccgcacgtaaaaatcgactatgcagtagtagtaaatattttcttaaatattgtataagatcgctaatacaaacaatagggtcaacactatatgattatatattgttcatttaatgattgggcctgcttcttaaagtagaaggtataactgtacttgatcaataataatatatttatttgctaagtgccatacatcatgtctatctgtttcttttagcttaggattattataatccagattattgggagtaagctgaaagaaaaagacaacttattgatgtagcttattataatctgataagcttatttagctgagctttttacagattattgggtgaaaaattacccaccatgccaccccactccctctttagacttacaaacccaataatctaggctctaataatctaggaaagaaacaactaaccgcttattttactacagattattttactacagattataacaatctagcttacagtaatctgactcaataatctagattataataatctcaaactgaaagaaacaggcccggcccgtgtttctaaatttaccattaaatgttattatgaatagattaaaagaaaaaaaatgaatatcctataggcgtatcattgcattactttcagtaaaataggtttggagttattaattgatttacttcattagcacaaaactaacaacatcaatatttagcctaagggtccaacgatatcgatgcatatcctctttggagagggacaatataatggtctaaagatggtgacgatgctcggttgaatcctgtatttcatgcattaacataaaagattcactgagcaatcccacactcaacttttcatccataatattctccacagatataaaggcatatcgaaacattttctggtaaacttctaaagaaaatctgaagcactgcaaaaatgcatttaactgatgattgaaataactcatagaatgcattgttttacttttattttttttcatatgcaatacataatagacaagttgtaatgaaaaaggtgtagacatggtttcatctacatgaaacttgttttattttttacttcattaatttttttatcatatctctactattataaaaattgaatatgtttttgccgatattttttttaagttcgtttgctttgggaaatacatattcatattcggatcggtttttaagatcgttcacttttggtaatacagaagcaatcatataagaaatctatttaaaaaaactcgcatgctagcttgagacgatcggactcctaaccgtagctcatgattttctaaaattatatatatgcaagcgaactacagagtgaatttcatcttaactaaaccgtatagcaataataaaattaaaatagacttcacccgttgcaacgcacgggcattttttctagtctatctatctattattatatactaaaagtccattaaacttcctacaaacgctcctaaaccgccacgtgcccccctacaaacgctcctacgccgccacgtggcactctaataaattagaagaattaagcaaagcatctagccgttggtttttcatttaatctggtggacccactatttttaaccgttagatatagcataaaaaaatatcaattagatttattattatctttaaaaatccacacatgccccgtacgtgtacgtgcatgtatgttacatattttgtatgtgggccccactcccccttttcttttttctttttcactaacacatgaagaaaaaacaaaattcatattccaggccatatgattcggagtatgtacttgcatgtagggccccacgtcccacttttcttgtcttgtattatacgcacgtgagataaaaaccacgttaataattccaacccatagttgtacaaatataagttattttgagttgtattgtattatacgcacgtcatcgaaatattcataaaatatctaaataaatgaataatatacattatataatctatgagatatactaaaagtccattaaacttcctagaaatactctcaagccaccacttggtgctcctacaaatgcttctaggccacca

SEQ ID NO: 55653 - DNA, 1112 bp, Oryza sativa
tcctgcagccctttctgatttttggttcaggacgactggaggttttcttcttcaaattagttggcttcggaggtcttccagttgctcctttatctctgagctttccggtatcatcgccttcgtcgtcacttggaactagcttcctcttgcgagaatctgactggccgactggatcagaagcatttggttgggtttcagaccgaattcttggtcctccacttccctgaccagtttggcggcgaggtgattggtgctgggcgattggaggatctgacttcaacaaagcaaattcctgggcgtaatatccttcattgttaatggattcaacaaaaagacaagaccatattttgtgaaaggttgaagtgtttgattacataccggtggaggaggattgaaggcattgaatggcacgactggcagcaagtgcgaatagctgacgacgatagcatttgagaagatcttgtacatcctttccttcatgaccttaaagtcaagagagtctgaatcttaacgatttggatcatgtttgccgtcaaactcaaaagctgtgcgggatctttctttgattggagctaaccggctttttatgaagtgccgagtgatttgttctccctgcaaaccctgctcctttagctttatcatgcgctccatcagttccactgcttgcgcagcttcatctcccattggcagtgagttccaagtatcccgataaactgaaggaagacaggagtactcggggagagcaggctcagggttttgaacataaaaccattgcgtgccagcctttatttgaggtcttgaagggcatgaagaagtatttttggcttagtgttcccctgagttggaaaccagcgcccccaacaacacatggtttgcccttgtttggctgaggcttaaggaaaaagatacggcggaacaaggcgaaatgtggcctaatacctaaaaaggcttcgcaggcatgaataaaattggcgatgtgaactatggagttcgggttcagatgatgcaggctgattccatagaaattcagaattccccgaaaaaatcttgaggttggaagggagaaaccgccatagaagaaatgagcaaataccacgatttcatgcgtatca

SEQ ID NO: 55654 - DNA, 4230 bp, Oryza sativa
aatatcttatgtgtatcctgggtttgtttcctaacttgtatatcaaggaaacaccttgaaacttagtcggtcacgactgtatttaatctgtatctgtgtattccgttagggatataggttatcttttgtaacccggactccttcccatatataaggggggtctgggcgcctctaggggcagaggttgatcttctccaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggttgcgtcaagcttttctccgatcagtgcaatgggttccgtctccggcatcgacgacctcgtcttccctcccgggcagacgtttcggttcggcagcctcgacttcatcaccaacaacttcggcaagatttctctcctcgactcggaatcagaccagtcgggagagaaccggatttcggtcctgtttggattcccgaacgcggctgaaagctacctcaagaccatcttaaccgagtcggcttcaaaccactcggccgagatcgcatcttcttcaacgacaccagatcaagatgatggggcttacccaccagtcctgatgaagctccccgacgatttagcggccgtcttcaccacgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcctaccgtcgactcacgtcctactgacatcgtggagtacgacgaatttagttctcgctacaacgacttcgacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcggatcgcgaaggaggctgaggatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcgatccgaccacgtcgtcaacatcttgaaccagacgaagaccatgattgcggcttcggtcccagttaactccgaaagcgtccacacgccgactggcagccgagtcccccacttccgatctcatgactactgtcatccaagcctcagcatcaccggcgccggatccaaccgcaggagcaggggacacgacgagcggtctgttcactcacctcccgaccttcatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcatcgacatctgcgtcgagtggattggccagccggcttcaagccgactggaatagagaagtacgacggtaccactaatccagaatcgtggcttaccgtctacggtctcgcaatccgcgcagcaggaggagacaacaaagccatggcgaattatttaccagtggctttagcagattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccggcgattttctgaacaatgcaacaagatctccgacatcaccgacgacgttatcatcgccgcattcaccaaagggattcgccacgaagaattggtcggcaagttcgggcgtaagccccccaggacagtcaagcttatgtttgaaaaagccaacgagtacgccaaagctgaagacgccgtcaccgcatcaaagcagtcgggtcccagttggaagcaaaacaagggtacgccggctacgggaggcggtggaagtaacaatcataaggaccgcaagcgtaagcctgcggaacttgttgcagccgccagtcactcttctcgacagcgttcgcgcgtcaacacgttcgacaagatcatgaactcccaatgcccgcatcatcctaactccaaccacgtggccaaagattgtttcgtctacaagcaattcgcggatcaatacaccaagactgcacggaagaactctgacgaagaacaaagcacgtcaaggaagaaagacgacggcgacaccccggcaggctttcaagatcaccgcaaggagctcaaccatatcttcggcggccccctggcttatgagtctaaacggaagcagaagttgactgaacgggagatcaatgctgttcagcccgacacgccccaatatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccctggatgatatgcagatccctcgctccgagttaaaaccaagcaatgcgccttttcacggagtgattccaggattatccgcatctccactcggccagatcaccctcccggtcacttttggcacgcgggaaaactttcgcacagagaatatcagctttgaagtcgccgatttcgagacagcataccatgccatactcggacgcccggcgctagccaagttcatggccgtcccgcactacacttacatgatgatgaagatgcctggtccccgaggagtcctatccctacggagcgacatcaagcaagccgtcacatgcgacaaggagagttgcgacatggcccaaactcgcgagatggcgtctgcccgagaggatatccgactggctgcagccacggcgagcgaaggagaaatacctgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaaatcttgccctaaagatccttttgggttgcctcgcattgaccaggtagtcgactcgaccgccggctgtgagcttctcagttttttggattgttactcggggtatcatcagatccgactgaaggaatccgactgcttgaagacctcattcatcacgccttttggggcatactgctacgtcaccatgccgttcggactaaaaaacgcaggagcaacttatcaacgcatgattcagagatgcttctcaacacagatcggccgcaacgttgaagcctatgtggatgatgtagtcgtcaagaccaagcaaaaggatgatttgatctcggatctagaagaaaccttcgcgagcatccgcgctttcaggatgaaattaaaccctgaaaaatacatcttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcacgacttggcgagcgg

SEQ ID NO: 55655 - DNA, 830 bp, Oryza sativa
ccgctaagaagaagtaccatcaccacttggggtcaggcggctatagcgtcgcgatgccgaagtgggaggagatggaggcaagcttgcttgagaggggtatcaaaccggccactgctaaatggccagatcgatcgaagttctggtactatgctcacggtggaacgctcaacccagttgatggctccctggtcttcagcgatcagatacgcgaggctgcgcgtcgactaacggacgcagtggaagcctcttctcagggcacgttccgacctgacagcgagaaggacgagctgtcactcgccctgcagactccagagcatccaggacgaacacgagggaaaggggtgattccttggaagattgggttcagggaggacatccacacgtacaggattcggatgaggagcaagagagataccgaggcgaagattgtagatcttgagtacagggtatcgagctacgagctcagcatgcaagaggaggtggcaaggaaggttgatgaacgcatggccgcacatcggtcccatgatccccagccgaccattcctcctgcaatggtgagcccttcaggaaatcgtagcagctgcgcctcaacggggcaggtaggatcacagagcatggacgccatgcaaacccaggacgaaaccacctgccccgttgatgacatcactcagcggataccatgtgagctgcatattcccttaaagaacttatcaataaaggtaagctcgtagtttatagattttagatttgtccattctgcaagttgctgcttatatatgttgattactaataaacaacctctcaccacgtgaaggtggcgtcgggcatgg

SEQ ID NO: 55656 - DNA, 2018 bp, Oryza sativa
tatctacgaactataccagctggacgccctcgacgtctctattatgagttgctggattttgtaagtatcgttcagttagatttcttattacgtttcctttaattaattaggtccttgtatataagtagactatatataatatatacttccttttatcgttgtagaatggagattcaaagggcccgacggtggggggttttcgatactggattcatcgaccctcagaaagtaaacgtcgcaatgctcgaccagtatccgcaagccacagaggaaaatctcatccatctcctgaaggcgcagcattacaagacgttcatactgttgccgtacaacacagagttagtttaattttactgtcttcctataccaaatttcattcccatacgaacatgctaagtgtttcatatgtaatgcatcccacgcacattgcagattccactaggtgctgttactcttcgacctggaggcctgcaccgtcaacatatatgactcaatggataaaaaagagtctacgtttgacaaggttttcgaacttatagacaggtattgtcataagttcctatgttaattaagaatcttgttataattaattgctactaagaatcatagctttaaactccatgtagggcttggtatcggttccgtcatttggtccgcggcaaatggagagaaagacttatgcggaagttcaattttcctgtgagtacacatgctctacatttatattgaatctccaattcaaatacatacaagtgtatattaattagatgtctcgccgtttgtcatttatttatagtgcgcaaagcaaaagcatggaactaacttgtgtggctactacgtgtgcgagtattgccactgccttgcaaaccaaatcatcaccacaagagagctcgatgtacgtacaaataaattcaaattttcattacgtatcgatttgttgtttaattactaattaatttcatacattcatatagtttattcgcatgagggataacctgatcacacacaaggaatttatcgcggcggttcaagaacaactcatgggattcatcaacaaacaaatccttgatcccaagggtgaattctactacgacggaaatacaattcataggtccttagcttctgagataacgactactactacgtcgaaatcgtagctagctaggacatcataatggattgtaattaatacatgtctatttttctatatgcatgtgtacacattttctttaatgtaaatatatattttggtcatatatatatatgcaaaaaaaatgttaagtgctttcacatatatatatatatatatatatatatatatatatatatatatatatattatatgcatatatatatatatataatatattatatgcatatatatgtattgaaacatatatatgcatggtatatataaaccatgcagcaacagggccatgcaaaaaaaaaaggtcagctcaatctttagtcccgattgatggctcagccggccacgtggctgagccatctttagtcccggttattttacccgggactaaagatagcgatctttagtcccggattgatagtcctggtttagaaaccgggactaaaggggggttacaaaccgggactacaaacgctttctccaccagtgtagagatcctaccttttaccataaactccctttaaatagcaagttttacggttaggtcctttgccccatctctaccgtttatttttaatccgatggctttgaatcaagtggtgacacgtggcaaatttttagaagggctaaccagatttatagggcgccatgtggctcaataggaagccagaagctataccctgaattcagttttagagattggagttttatatatgtaattatacaagccaagcaacaaccttgccatatgaagtagagtgaaagaagagttggtgtatgttataatttgttaattattaatttttaatttcgaaattaaattaacgaagagccatattgagaaacctaactaatgatgccttcgcttgaa

SEQ ID NO: 55657 - DNA, 856 bp, Oryza sativa
tttgggggtttattgggcgttcctttgtccccagattggttgctgtcatcgccttcgtcgtcattaagtaccagctttctcttgcgagaacctgtctgcccagccggtttggaggtttgaggttgcgggtctgacctgattgtcggtcctccacttccctgaatggtgtgctggcgaggagatcggcgctgagcaattgggggatcagatttcatcaatacgtgctcctgaatgagatgtttccacggttaattaattcgacatggagacaagattatgttttgatcatgggttgccgatttctgatacgtacctgcgaggtggattgaatgcgttgtatggtacaactggcagttggtgtgagtagctgacgacaatggcgttcgagaatatcttgtacatcctctccttcatgatcttaaagtccagagaatctgggtcttcacggtttggatcatgtttgccgtcaaactcaaatgctgtgcgggatctctctttgattggagctaatcggcacttaatgaaatgccgagtgatttgttctccctgtaagccttgctctttgagcttcagcatgcgttccatcagttctaaggcctgggcagcttcatctcccatgggaagagagttccaggtatcttggtatactgggggaagacaggagcactcaggaagagcgggctcgggattttgaatataaaaccagttggcgtgccatcctttgtttgaagtcttgaaaggcatagagaaatacttctggctcagagtgccccttagttgaaatccagccccaccaactacgcatggtttgtttttgttcggttgaggcttaaggaaaaagattccgcggaacaga

SEQ ID NO: 55658 - DNA, 3311 bp, Oryza sativa
taagagtggcttatgaatattaagaaaagcaatggaaaaagacacatgtttgagactttttagcttataagtccaaaacgtacttaagtatgttagtacttattaatttaaattttcttaattaattaaggtaattaaaaaattgagatacataagtatggatcatggtgcttattaattgctaattttgaactttttaaattaatgaaatagaaaatatcagttcaagacattaataaaataaaactacagcaaccgaagacaattaggacaggacatgtattttttattttttttcaattaggagtaaaaaaatattattacttccttagacttacaaagaaaaatttatgttttactttcaacaaattttaacaaacatgtattttacatataactaatattttttaatattaataattgtagcacatgcaatgcacaggttgacgcttctaaggcatgtgatgctataaatactcccaggtcaccagtaacactctataataaattatagaaaattttaattagataatatatatttaaaaggtaatctgttcctcccaatctacggggtatacaatggaaaatttgtaaatgttcaccaaaaaagccaaaagtacacaagtaaactattgggaaaaaatatacagcttattactgttcaccaaaaaaaggaaaaaaacatattgatgataaaaagataaatcccaaaaaacttacgcatgtaagtactacaatgaaaaaatcaacgatctgaaaataggattttctataattttgagataaatatatattactccaaaacacacaattcaactagaggaccttgtccatctttttttaattcatctaattgccgtattccttcaattaaatgaattattaacgactaataataattatattgtaatgctaaatacatgacaacatatggaaccaacatataataattaatgatatgataatttttcaaataattgtataacatattttgtgatgtcaaatatcacctgacaaatatacaatactactttaaatctacttgtctaaaaaataaaacaatagaatttagttgtgtttttccaagtaaatttgatttaattttagtttgtgtgggattaagattctctacattttcaaaactatttggtatttccagctaatgatcctgctataatattaccccttaatctatcacgagtatattggtcaataggtatgttttttctataccaaatagttttggcaacaaattaactactcatgatatacttttcttagagttgaagatgttaggcataattgttgatgtatgtcatgtacctcactaatgtgattataagtgtacttgaacaaattagttattgcacatattttctaaagaaaataaatctaccttcttttcaaatgatgaagaagattataaataattgcttatagatattacttagatatgatataatataaagctaataggttaatgattataaaagcaagttatgccaaaaaaacaatttctgaagaaatcgaggtatatattctccggttaatatttcgcttttagtgtctcaaatttagcatacgacgcatgctcgcgcattcgcgcgggctaccttcctagttattatatacttaaaagtccactgaacttcctacaaacgctcttaagccgacatgtgtcctcctacgaacgctcctatgccgccacatggcattctaataaataaaaaaattcattaaatccggtggacccattatttaaaactattagatctatctttgagaaaaatccaccgctaaaactgggccccactaagtacctgtacgtggatggatgtatatatgtaatgtacgtgttatgaaacaacagggtgatctcatccatataaaaggatggatcgcaaccgaaggcaaccgtgcctcttccctaggcgcttcttggcaacagatgcaatggttcccaaccatcgtgtctccggttgccaccccttctccatctataaattgtaccgcattgatcaataaagaaatctgctcattcattccctctacattcttgtgttcaattctctctctcgctcaatcaattctattcacaatacgttatcagcactttcgctctcgcgaaggagttcgcgaagtttaagaaggaagaacatcactttttgatctacaggaaaagcgaatagaaaaacaacggaaggtacgatgcctacctttcattggatcatggatgccgttctcggcctccctcgccatcagcgcgcacgccagcttcgctatcttcttcgtcgatcgatgaggaggacgcgttggggatcccgcggaggcagggctagggttgtggccgccgccactaccctcgccgccgtgtgactgcaactccagttgtggttcccccgcctgtccttgtcgcacctcctcctccgcctccggttgccgaagcacctcgccggatccttgtgcagggggtacagtactgtgcccaccatggatggacggcggtggtgacactgcctggcaagccgtgtgatctctcactggagatggagtcgctgccggccccgttcgtcgccgctccatcaccaccaaccgctccttcctcacctctatcaacgtcgcagccgacgccaagctttcgacgctcccccactcccgtgccaccaggatttggtcgtaccggaaccatggcggcgcgcacgggggagccgcctctctttacaccgtctccaactcgtggccacgtcggagccgccgctgcacgccgtcccggcctccgccatacattcattgccgttccccatggctccccgagccgcatggtacccaatggcatggggggggaacggtgttagggtctggccggtctccaactccgatgaggagtcgggaccgtcggcctaaagccggccggcatgccgccggccgacgagagggacgcggcggcggcggatagtggacggtggcggtgggaggtggcggtggaagcaaggcggcagcggaaatggagggggtagcggcggcgctatcactgaaggtggagacggcggtggaatcggcggcggtggcgtcggcagcgcccccgcggcggcgtcggcggcgcccccagcggtggaataggcggcgcacctcaacggcgtcaacggcgcacctcggcggcgtcggtggtgcctcacggcggcgtcgatagcggcgaactggcggcggtcagcgacgaaatgacggcggtgggcggcggcgtgtgcagcgaaaagggcggcggcggcggcggtgaaattgtgggggcagttagggttaaccctaacaccccc

SEQ ID NO: 55659 - DNA, 3515 bp, Oryza sativa
ccacccaatttaccatttaatttttagtttttcatttactttcagcagtaattacattttagtccctatgttttatgtaatttagtggaaacagttcatcagttcttcacattattatgtaatggccctatagaccacttatgttatgtgttaattaacataggtgtttattcaaataccctgtttcactaaatttttttgttgtcttaataacatgccttttgcatattatttcaagacacgctctactttctcgctttattaatttacaaaattctataaattttgtattttgatttagcaaattctcttaattatgtacaacataattaatggaggatttaatgcatgttccacttcacactttgactcggaaattaatcacatgtcaatggagccctatactttggtcatatcgaccataacttaggcagcgagtatcttgcccatcatcaagtggtctacattttgagatgtttacccgatggagtcctacaaattggccgcactagtcataacctaggcagcgagcacctcgcccatctcacagaggtctacatctcacgatgattacccacatgtgttattttccgagaatatgttttgaaaaatgagattatttgaattttggttgagcacaaggtagtggagtcctattcaccagaatatatttgcctggagaccgtgttttaggtagcaagtataacttgcccactattaagagatctactccactgtttaattacttggagattatccacattgtgccacctaatttcgaattctaacttgaattgtcaagtttattaccggcatcttttcgaaacattacaaaatatgaagtcttacatttcgcattgagattacaaccttaatatcatgtttttattaatttacctctgtaaattgataatgttaaccatgattgtagggacatggcaacaaaagagttcaacgaactcgtcctcgatgggactaactattccatctgggcttccgatatcaaaatcaattttgcctctcgagggattttaagtacaattgaggaacctaatgatggggacctgccaattgagcacaggaagctcaatacagccctttttgttttgaggctctacattcacaaggatctcaaacatgaatacatgttagagacgagccctcacaccctttggaaagctctaaaagagcgttatgatcagcaaaaggaactcatttggcctgaggctaattatgagtggattcatttacgcctacaggactttaaaactgtggcagaatacaaccatgctgttcataacatttgctccaggttgaagttttgcgaacaagagccaacagaggcagagaagatagagaaaactctatcaactatgcttccagaggacaagatactgactcaacagtatcgcgctaacaatttccaaaaacattctctgcttatacatacattgactcaggcagaaagacaccatgagctttctttaaagaatgcccaacagcaccccccgggctctgctccactgcctgaagtgcacttcaatgtacagaataatgctgagaataagaaaggattcaagggaaattcttccaataatcctaagaatctgactggaaagcgcaaacgcaacaacaacaggcgcaaattcaagggtcgaaagaaaggaaaagggaaggataaggcaccacaacctcgtagcaatgttaacaagcattgcaacaggtgtggatctgacactcatgtcgctaaagactgccgcatcccgaaatatcttgttctattgtaccaaaaatcccttaaggacaaaaaaatcttctgagaacccaagatttgaagcccacttcaatcttacacatgaagagtgccctgaggttgcaagttctcactaggctcctgttgaaccggagagcaacctcaatgttctcccagaagatgtcgctccactctctgcgatggacgatatgttcatcgaatactgctcaacagacccacttagagatttactgtaatctcagtgcgtcccacttagagataaagctgctttaatctcagtgtgtttgagacattatattgatatcctatagtttgtcaaaacaatattggttgtaataagtagataagtactaacttccttatattataaggttataagacttgctagtcattagagtatgtactattaacctatgtaaacgtcatactatgtatttgatgttttcattattatatgtatgtatatattgtggataaagaattcttcactaagcaattcttctttcactatagatgtctaaggatatcactccgattggagaggaattatgtcttgtggacagtggtaccacaaactctatacttagggagatcaaatagtttcaaactctcaaaaagagagaaagcaaagttttgactatcgctgggtgcgatactgtaatagttggctcgggacaagcaactattacactcccaatgggtacacaaattacaatcgaggatgctttattgtatcctgattcaacccgtaccctactaagttatagagatatccgtcaaaatgggtttaacatagaaacccatatggataatcgagaagaattacttctcttaaccaatcaaaacggatatggcaaacgcatttgcgagaaaattccatctctcacatcgggattgtactatacatacattaagcccattgcacatgttgcgtacaaagtaatttttcaaaatgttgatgcattccacatttggcatgatcgacttgggaacctcgatatcgggatgatgagaaaaattattggcaactttattggtcatcatttgatcactgataaatttctcaaatcctctgatttcgtatgcactgcatgtgctactgggaaactgattttgagaccatcttatctcaaaattagagccgaaccacttaaattccttgaacgcattcaaggagatatctgtggccctattgtgccaagatctggaccgttcaggtactttatggttttgattgacgcatctactagatggtctcatatgtgtcttctatcgacacgaaaccatgcctttgccaaactaatgtctcaaattataaggctgaaagcaaattaccttgaacataggattcaatcaatccgtatggacaacgctgccgaatttacatctcatgctttcaatgattattgtatggcattgggaattcaggttcagcactctgttccatatgtccacacacaaaatggttttgctgaatcattgatcaaaagaattaagcttattgcccgaccattattgatgaattgcaaattaccttcgtcgtgttggggttatgcggttctgcacgctgctgaccatgtccaactacgactaactgcatatcatgaaacttccccaatgcagttagtacgtggaaatcctccaagtacttcccatttgcgtaagttcggatgtgctgtatacataccgatctcaccaccacagcgtactgctatgggcccacacaggaaagtggggatct

SEQ ID NO: 55660 - DNA, 733 bp, Oryza sativa
tttctaaatacatttctggtattgaaatactttccgagtatatgagtaccaactttacattatgttcatgttatactgaatatactgctagcttatctgggagatgctttggttcgggtatagtgtttgcttatgcaattactctatgtcatgacgatgatattagagtagtatctggtagtttagacgtggtgtctagattacaggatatcattatttggggttatatattgcggatgagaggtgggtcgctgatggtgacagctcaatacgggtattcctccgcgcctatatataattctaagttaatttcctggggagggtattcctccgtatttagccccggttggatggtcatgacgggctatcataaggaactcggcagtcaggggtggcttctcgaagtaccaggagggcatcggatagagggtattagctagtatatcagttaactagaatgtatgtatatatgtatattagaagttaggaatagattttctttctcttttctttccacctagcttagattatttattatgaggatgagtagtaatgcttgtgtgtcactctactcttggattatcttaacccctgcttagaatatgattatcacaagtaatatataaattactagttgagttctctctacatgatcttcccacgggataaaataaatacgatacccttggaatactctcaggtgaaatgctacaatggtatatccgtgcgcttg

SEQ ID NO: 55661 - DNA, 10873 bp, Oryza sativa
agggtgaatgtctcgagcattattgtccacagcatctctttctccgaatctgggacaaagttctcatgatctccgagtgcccttgttctgcgctagtacaccgtactaacaggcatgttatcccgcacaacccaaccgctgtgtcgtacgtagttcttggctgcttccgccggggcactaggtcggccgtcttcgtccacttccgttatgatgtgccgaccctcaagcttcttcacggcacctcgttgcccgcgtgccctcttctgtcctgcggagggttgacttccactagcctcctcctccaggttcccctccacatccctctccacgtgcccctcctggttcccctccgcatccctctccacgttcccttcctcgttcaagtactggtttggatcctcgttcccctcttcttcgttccagtactggctgcttccctccgcgattgtatcgtacaatatctgttcctcatcgcgatcagccatctgttcatacaagaaatagttgctaagtctataggtcatttttgctttaacaatcttatatgctaacaatcatatatgctaagtcatatatgctaagtctaactgtcgtatatgctaagtctaattacaaatctaataatcttatattaaaactataataatcttatactaaaactcaaataatattgtattaaaactgtaatagtcaactatgctaagtctaagtgacgtatattaggaccctagtcaataattatatactaagtctaattacaaatctaataatcttatattaaaactcaaataatcttatactaaaactcaaatagtcatatatgctaagtctaactatcgtatattagaaccctacacaatcttatatgctaagtctaattacaaatctaataatcttatattaaaactataataatcttatattaaaactcaaatagtcatatatgctaagtttaactgtcgtatattagaaccctacacaatcttatatgctaagtctaattacaaatctaataatcttatattaaaactcaaataatcttatactaaaactcaaatagtcatatatgctaagtctaactgtcgtatattagaaccctacacaatcttatatgctaagtctaattacaaatctaataatcttatattaaaactataataatcttatattaaaactcaaataatattgtattaaaactctaattataatgctaagtctaagtgtcgtatattaaatctaatagtcttaattgcattaaaaatctaacaatcatatatttacatcacttgcctgcgcgaattccttcgagggctagctaccactccgacttgagggacgacgacgacaacgtcttttctgcaacatacaaaaagatgtattaggataaacgcaaagtaacatatattgtatttcacgttcgcgttctcgttaagttcatgtttcgttcatgatcgttcacgttcgcgttctcgttaagttcacgtttcattcacctacgttcgttcgttcacgtgcgttcacgttaacgtatgttaaataatgttcgcgttcttgttaagttcacttttcgttcacgcacgttcgttcgtttatgtacgttcaaatacaacgttaagttcacgttcgttcatgttcatgttcgttcacgttcgttcgttcgttcacgttctcgttcacgttcgttcacgttctcgttcacgttcgttcgttcgttcacgttcacattctcgttcacgtttgtttgttcgttcacgttcacgttctcgtttacattcgttcgttcattcacgttcgttcattcacgtttgtcacgcccagaaattcacgaaccagaatttctaagctgaatgtgtattaaacccctgtccaggaccagccatggtacacaaactacaattgttgacatacagatccacgtcttacaaaaacataaaggattacaaatgcagcggaaaaggtaaaagcgagctaagcctgaagacttgactcctgcagcgggcgattccattccataggcaacccttgacggcagcgacgaaacccacctcttcaagacatctccaactgagaaaaacttcaactctggtgtgggggaaaagagagcaagactgagtactacccactgtactcagcaagtcataccggaagaggaggtatgatgcaggatataaccaaaggaagctaggggttcttttgcataaagcagacatttcaaagcagtagttgaaagcagtaaaatagctgtagtaattaatcaatattaaccaatcactgtccaacgctacaccacgttgcaacaggcccaaccaaccacctgaactacaccagttcattaagctagactaggggtgagactaatcacggtgaatctggttgatcgcccataaccgcgggcacggctattcgaatagttttactctggccagaggtgtacaactgtacccacaagacacgatcccacacatgtcgccatgctccaaagtatcaccatgatactgcaaagggggaaatcgtgacaagaccctccgcataaccctcccctaaccatccacaccacgctaaggtttcacccccacccctcaaaaggcagtgggcggtcccctcttgcgccgcggtgaatccggcagctggacaaccggacaccccggctgacccaactccatcacgcccaccctcgccaccggtgcctaggaaagggtcgagctatacttcagatcaagcagttacccactcccgcttgtggtaagcacggtaggtctcccagggtttcccgtgaaccggtctttaactgccatgggtgcgaccagcaaaaccatgcacccacagcccaccatacagtgtattttaattaactaacaccattgcggtggcaccaatctaaagttatgccaatagacagagtctatgtaataaagtgatccccatttgtgtactagttgaactaagcatggctaagcatttcctaagccaacatctagtcattttaaatacccaagttatcaatggcatatggtaaacaataaatggctgagtaataggacccatcccacattacattgtaaaaggatgcaacatttaatagaaatgcgggatatttgtaaattgggtacaatatgatcaaacgtattgcatgacttgccttgctcttgcactgatgagacctcagcaacgtcttcgagaaaccgcggatcgacgaaacggccgaaatctacgcgacaaacaaagcacacaagcaaaacatgctataagactactgaaacaggaaacaaaagtatttttaatggattctttgcatttttcttgatttactgagacttgaatggacttaaacggagctcggatgaattacttatgaattttagaagataaactgtgtttattactataaaagaaaagccttaatgtatttattgcgcaataagtcccagggctgacgtcatccagggggcggcgccgacaggcggggcccacgggtcagcggctcaaaggggtggtctgccgtggaccgggtccacggggccggggtggtggtgtaccacgtggcaccacgtggctggccacgcgggccacgggatggacggccacgatcggccgagggccgatcaggcggctggggacggccggcaccgaggccagcccgggcatggcgctcgggcacggcatggccggcccggccatggcgcgcggcggctcggcgcggccaccggcggcgagcggcggcgcacgacggcgagcggcggacagcggcggcgctaagcggcgggcgtcgcgacaaagagagagagaggaagggagggagaccggtcctcaccgaggaggcggtggcggccggcgcggggaaacaaaggcggcggcgacgaccggcgacacgggcggcggatgggcggtggcaacacctaaagaaggtgaggagaggagttagggatggagaggacgaccgcgacgaccaaaatggccggccggagatggaaacaatggcgagcacaccggcgacgcggggaaatcggagctccggtggtgattcgcggcaacgaagcggcggccgaggtagctctcgcggcggcgaagctggcggaggtgattgagcggcgaggcgacggctctagcgacgacagcgtgcggccggaggcagcggcaagcggcggcgctagcggcgagcggcgcgggctcggtagaaggcacgggaggggacggcaaatgggtgaaacgagagaggggactcgggggcaggtttttatgggcgaaggaggggcggaaacggccgggaatggcccctatttggccggcgatgtggggagtggagggagagagagagaggtggattcgaatgcgaatcccgcccatttttgggcgggcgcgagagcggggagaggtgggggaggtgggcggcgacgtggacgcgggtgcgggcgcggagtgggcgcgggaagagcggaggaggcggcggcgtggcggattcggcggcggttgccgtcggaggcgggtggctggaggaaggggacgacctgacaggtgggccctacctgtcaacgtcccggagagagggggaaggagaacgggccggcccacaaggggaggccgagcgcgggagggagtgggccgacggcccaatagagaaaaaagaaggaaaagaaaaagaaaaggaagaaaggatttttcctgggatttaaaattgcactttggtgatttttaattggttaaaattatttccaaggctctaaaaattccactaaaattcttgttaatgcattggagcatggggaactcaagaaaaattccaccacactatttccgattattaattgcatttattaactagggatttagctctaggttaattaagataatttctccggacgatttatttaacaaatttttaaagcaagcaaaagggggaaaacttcagggtgtgacaacgttctcattcatgttcgttcgttcgttctcgttcacgatcgttcattcattcacgtggcggcagcggagcggcggtgtggcggcagcagagcggcggcatggcggggcggttgcggcttggcacgacggcggcatggcggcgcggcatcggcgtggcgcgttgcgtggcggcggcgtggctgcgcggcatcggtgtggcgcggtggcggcgttgcacggcggcggtgccgtgccgcaacggcgtcgtggcgcggcttcattggcactgccagtgcgacgtcgtcgccggtgccggccgcatcgaggtcggggtcggcatcgtcggcgcggcagagtcatgttcggccgcgacgacgtcggcgacggcgtcggcaacgaggcagctggctaaagatattttcccgctaaagatattttctatctttactcccggttattctcatcaaccgggactaaagatattttcccgttatttctaaattctctttaaacccggttaggggtaagaaccgggactgctaataagcgcactgaatattaatttctattacatatgtgtttctaaaatagaaaataatgcattaaaattatttaaagtcgaaaattaaatgacaattacttcgaaaaattattgttgtctgtagtaaattaagtggataaaacgtaataagcaaatatatgatttaaaattaataaaaattctaatagccatatatatttagcatatgaatgatattaaattaattgttaaaaactctaattaacatatgtaaatgccacatgcatgatttaaaacttttaaaaatcctaattatcgcatataactagcatatgcatgatttaaaattgttaaaaactctaagtaacatatgtaaatgccacatgcatgacttaaaacttttaaaaattctaattatcgcatataactagcatatacatgatttaaaattgttaaaaactctaagtatcatatgtaaatgccacatacatgatttaaaacttttaaaaattctaattaccgcatataactagcaattacatgatttaaaatggttaaaacctctaataatcgtacgtaattaacatatgccatacaacaattgatttatatggataatcaatacatccaaaatagtttacatcgtgtacacaataattatagcaatacatcggcggtgacggttgaccgcacgtactttctcctcactattgttccctccttgtgatcgctacttgagtaaggggtgtctttatttgataggaggatgctagggtcaatcgtcaccatgaaagggggttgcccatcaaactgatcgtaatcctcgtcagtcttgtcctcaactccgacgatttttcttttgcctgggagaaccacgtgacgcttcggctcgtcaggccctctgcccttctttcctttgctagacaagtccttcacgtaaaagacttgcattacatcattggcaaggacaaaaggttcgtccgagtatccaaccttgttaaggtcaaccgttgtcatcccactgtcatcaatcatttcggctccaccagtcaacctaacccattggcaccgaaacagagggaccttgagagaaccatagtcaagttcccatatgtcctcgatggcaccgtaatacgtgccagttgttccattgtgtcccatggcatcgatacgaacaacattgttttggtttgtgctcttcatgtcttgggctctcgtgtagaatgtgtacccattgatctcatatccctagagtgtcacgatcgacccagatggtcccctcgccaggaaggccagttgttggttgatcgtctcgttacccatgagatgttgtcgtagccacgcggggaaagtatcaatgtgatgccgtgtaatccatgcatcggacttaccaatgtttctggcgcgaactagagccaagtgctcctcgatgtaaggagctaccaatgaagattgttgcagaaccgtgaaatgggctttatggaataaattgttgtctaccgtcattattgctttccttccgagagttccctttccccgtagtctcccttcatggcgtgattcaggtaccccgattgggcgaaggtcttcaataaattctacgcaaaattcgatgacctcctctgttccataccccttggcgatgcttgcctctggacgagcacgattacgaacatacttcttcagaacgcccatgtacctcttgaaaggaaacatgttgtgtaggtacacaggcccgagaatactgatctctttgacaaggtgacaaagcagatgcatcattatattgaaaaatgaaagtgaaaatatcaactcaagactgacaagacattgcaccacattattctgaagggcttctaatctatccggatcgatgacctttgtcacgtcccaaaacaactctaaaatacatcctctaaattatgcctagaataattaaaatccgtgtgaaagcctccaacaattaaaatgtgcaaagttaaaagtcaaataaggcttggaggatttttgtatatttcctaaaagtctaaaatgtgtaaataaattttagtggaattttcagagcacaaataataaatattaagaaataaacaaagttaaaatggttttataaaaagaaaagctctaaaaaagtccttttcccccctctcccccttgggccggctcggcccatctccttccccctccctttcctctccccgcggcccattcggcctcctccccgcgcgcgcgccgctgacgggcgggcccgcccaccaccctcgctgacgggtggggcccacccgtcatccccttcctcccgccgctcccgccgcctcccccgcgccctagcgccgccgccgccgcgaatcccgccgcctcccgccgtccccgcgcgtaataaagtggggggaattattccccgggatcccctccccctttccccccatttttctctccctctctccctcggattcgtttagaaaccgctcccctaacctcgccggcgccattaatggcggccggttcccgcgcccatttccccctcttccggccgccctctctcactcccaaccctatataaaccctccccgagctccccaccaccgtttccgccactcaccgccctctctccccgccggaatcgagctcgcgccgtcgctctctctctccgccgtcaccgccgagctccggtcgccgccgtcgtcgccccggaccacctcccacctcggcgccgcctccttcgccttcgccgcatcctcgccgacctcgtccacctctccgtttcggtcgccgaccgccggagcaccgtcgaccctgtccacccgagccgcgccgccgccttcctccgctccggtcgccgtttccgtcgtcgccgtcgacccggggtgagccgtggaccgccgcttcgtttccccctttccctcccctctctcggccgccgctccgccgtgcctatggccgccgccggcgaccataggggcgcgggcgcgcagcctcacgccgttgcgccggcgtggccgcctccgggcgcaccgagcggctgccgcgtggggcccggccgtcagccgcccatgccctcgggtgcggctgctgcgtgggccccactcccgtggacccggtccgcgcgcccctcccctcggctgacgcaataaaccttttttttaattaaaatttaaatgaagaaatttgcaaatattcatttaaagagcatataaacttcaaatggccataacttggccatttgaactcggaattggaccgttcaagtctctaatttttccttaagaagtcaagaacccatttttgtgctttgtttcagcttgttatatggagtttattagagtaaaagccttttcttttccgttggtcgtgtagacgctgcagcttcggaagatccgctcttcgtggaagttaaagccgacgtttgggaaagcgagcaaggcaagtcacatcatccttgaacatattgaatcccagtttataaaattattttgatttaaattattgcattatcgctttatttaaattcccacgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaagcaacattaggtggttttacaactctagactttgggaattttctcatcacctggacactatggaatggtttgattattgtggaattggattcacaccgccccctctattcaaaatccccaaaatggttttaggctgggctcggggtgcctggttttgatagtagcacctcggccatataaggaccggtcttcgggcctctgttgcaaagcactaccgtacttccacatgtctagtgggtaaggcttagtttgtggctcagcctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctacctacctgtcccgggggttccggccgtaggtgggatttggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccaagcaatgtacccaagttagtgttttaattcttaaaacctgtttaacaactaaaatgtggaatggttggcctgggttggcttgggacgagctgggacccagggtcgggttgccaggctcgtgtgggttcacggccttgtttaataatattgtatagctctaggaccgtatttacaaaatagctttgagcaactaagtgtcttttaatgctgtttactgcaaaccctaaccctttatattataactcccttgtactcccttgcatttattctgcacttgtgggtgtgtcttgttgagtacggtggttgtactcagtcttgctcaatttttcccaaacccagaagaggagtccctggaagatgaaggctttggtgtctagctcgtgcctgccgtcaagcgcctgtggtcgtcgccctagtcttccgctgtttctcgtttgtctttgtgtgtgctggcccttcgctgcccatgtaataaattatccatttacgcttccgcttgttaaactctgaactgtatcaacttttggtgtaccttgcctcctgggacaaggaataatgcacacacgtaaggaacgcccgttgggttatttccggtcgtgacaaccttctgcgaaattgcgttcatgaatgcacatagttttgttattattgcccggacattgtctggaaggataccccttattacaactagtagcagttgtgtcatcaacacgtgacagtcatgagactttaggttcgtgaacttcttctccttcgtgcttattattcgcttgatatttgtggagtatccagatggtactttatgctctccaagcattcaaacatactttccttctctgccttgctaagagtgtagctggctggactcaagtaatggcttcctttgtcctttggttccgggtgaaggtcgccgcgttgttccatatgcttcagatcattacgtgcttccagtgtatctttcgactttccatatacacctaggaagccaagaaggtttacgcaaaggttcttagtgaggtgcttcacgtcgattgcgtggcggacgtccaagaattcccaatagggtaactcccaaaatatagagttctttttccacattgccgtgtgaccatcttcgctctctataggctggcttccag

SEQ ID NO: 55662 - DNA, 761 bp, Oryza sativa
cgactccaaccatctcaaacttcttaatttgtatcactgctatgctattgccattcttcttcttctttagctttggataataaatactcctactatgcaataacaaatactactagcagagtctatcttgttaagccgtgagataattaatccccaaatgggacacttgccaacacatttggctaccaaattggatataattaaaaatgtttatattttggagcaaagagagtagtacaatctaaaagggagtcacaaaaggattggtttctttggaatatttttcatgtggctttgtttgtaacaaaagagattgcatctaaagttctcaaggaaagttgagaatttttgtacttcaatggaaataaacagtgagattatccagaacagagattttcttctatttgattgatttgattgttgtctcccttttctctattcttaagtttcctgttacttttccaaacagagacaccatatataaaaaaaaattaagctgaagttttactaaattttagtgataacaaaaagagaaaaaaaagtctttatgcagagaaaaaggagaacaacctaacaagttcttatctgtaaagttctctcttgaaagttgctatttatgttatgtataaggtgaagaaaatattattttaatctttttaatccttttttctgcaatttttttgctttccttttttttgcgcttttttattacttttttaatcttcacgcatgtttttcaaatgttttgtattgaaagtttt

SEQ ID NO: 55663 - DNA, 1400 bp, Oryza sativa
caatcaaggaagcaagttagtccaaaggcaaccgatgaagcaggcagatggagaggagccatggaggtagaaagaagaagaaaagaagaagaagaaagcaagaaagaagatagacaagatagaagcactgtgcactgcagctgcacatgcctgatggcaccaccaacaatcaattgcattaaagttacccaactgcactacgctagggaagtgtcctcttctcagcccagcccagcgtggtagtaccaatctcagcacctctctctttttcgttttgctttttcaaccacctactggtttcaaactgatttttcttttctttccccccattgaaaccgtttcaattccagtagaagtagggaaagggttcatatgcgttccaaagcacccccaaaaaattatcatctgcacggtgcagtttttaagaccttggaaaacaattatcatttgcatagaggagtatttctctactattatgtcatccatatttaagttggtttttaagttttttcgtttttggaaatacatatccgtgtttgagttgtattttaagtttgttttctttaattgaagatgttttttgtggtattttggtatgccatctgtatttgagccggtttttaagcttgtttccttttggaagcataaaaggtgtcgtataacaaatcttttaaaaaaacttgcatgctaacttgagatgaaatatggactaataattgcaactcatgattttctgaaaaaatatcaagagaattcctaaagtaaattttatcctaactaaaacgtatagcaataataaaattttaaaaaaatatttacatgttgtaatgcacggacattttttctagtcaaacatatataaaagaattactgacaactccctattcttttaaaattatttaccggattatgaaataaattattcgctgcacacttcaatttttctataaacttttttctactgcattatttagaccacttattactaaacggaggagtattttgttaagtttatttattacaatatttcatccatccaaataataagtaaataatgtgcgataattaattaatccactcactaatctatatcaaatggggcctttaagatgatgccatgtctagtagatcttataataccattttgcaaataataatttgtaaataaaaaaagagaaaagtacgaattacccctgaactattggatgagtatgaataacaccactaaactcgaaaatcaaacatcgctcaccccgaactttcaataccggacaagaaaccccctagcactattgcgagcagtttagagttcgtatagcacacgtggcagtccagttagtaatttttttctaaaaaaaatagcgggcccacttgtcagaatcccacatctatttatctct

SEQ ID NO: 55664 - DNA, 1343 bp, Oryza sativa
tacccaaagtaatgatgacaatatgagtatgttaaatttccaaatgctgaaatacaagttgtctgataaaactaaaagttctgaaactaatgagtttgtaacattgttgtcgaaactagcttttctagccatcacttgtttgattttgtcgtggtttgctccagccattcaacataacagagttgattgttcctcctgtacaaatgtatggacatatagttacaagtcgtatttaaagtaaagaaagtcaccatgtaaaatgcagagctattttatctagttttctgctagcatgtatagttaccaaaacttcataatttcttcaaataaaggacattgccagagtctgcagtgcaactaattttagtatctaacatgattaaattgagttagaagtcatatgccataactatcatgccactgtatggacatgtgtgttctttggattgatggaaacataaacaaatgtgattaggctcactatatctgacattttttaagccatgcccctgttatttactgacttgtgagacccactgaaatatatatgctttgttacatatgtggtggctatatatagtactgtgttgctaatcatttatatggcatgcatgcttatcttagttagctcagataaacaaaacaaaggcctatggggcagtaacagaagcttatatgccccatatactaataaactaaacaggcaactgtttttgtcagcaaaggggacgtgccaaatactaatacaatccaatgagttaagtagcaaaagtaccagatcatacctggatgctacaccaaaccccgagctgatttagatatttctttcattcattcttccattttctcctctggcctgttacaggatttggccatacacaataagaaattattttttttacaaacagaccatgagcaggaaaacatattgtaaaattttttgcaaaagatcatttcaacatagcagcttgctgaagatttgtaattacctgatcagttcgggaccgtacaaaatttctagcaacattcctaagatgttgtgaagaaatattttgccgggtagtacttgttgttccttgcaaattagcgctgttaaaaagtgctttcacaactgtgttgttctgaatgcttcgagccttctttgttgtgtcatgtggttctctattctcagttggacaatctattgccagatcagacttcacaccataaaacaagaaatatatatattatgattccacatttgacatatataagatatcaaatattggtgaatgtgaacattttggcaatcattacctgttgttccgatgctacgctttgcgtagtaatcattttgagaatat

SEQ ID NO: 55665 - DNA, 740 bp, Oryza sativa
ctcttcttcctcctcactctcacgcgttccacggcaagccaatagcccaatactacgtacaatcgccttcctattttatgttaacaagaaaaatgttactaactcactttataggaaaaaaccggaaaataattctaaagcgaggagaaccataaaaacaactatatggagagaaaacagagaaaaaaaactctgatggcatcaagtccaccactactgcaagcagatatttccaatggcttttcgtagacctgccacaaacgccaacagccaatctatctatctattatattattaaagaaatagaaaaaagagcctccacgttcgctctcatggcctagaaattctcacattaatcggagaaaaagaaaaagcagagtctatatagaaatacaatttaaaaataacgaaaattcggaattaaaaaaataaggaatattagaagaggagactagagtagttattacacattagtagtttcgtaaagttattgcaaaatttaaaattatgttgtcattgtaatatattttaataatataatgagaaaacatatatgctattatatgagagaaaatataatgatgttagccgagcaatctgcgcgggccaccatgctagttatctttggatatcacaattttttacaagcgtgcaccttaaccacgcgtataaaaaatgatttttcatacgacctccttataaggcgaaaaaatcgatttttttcaagcatgtacttaaag

SEQ ID NO: 55666 - DNA, 1823 bp, Oryza sativa
ccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaattttaaacccatgcataaacattaattacttgaaaataatatgtaattaccattgcaataccaatacttcaaaagctaacaacatgtctaatttttccaataaataagtacattactcaaatactacacattatttataaaaaaaaaactctactcctacaaattacctacccttcaccacacatcaacccctttcaaaccctctcaatcaccacaaatccatcccacatcctaggccatcaccacacatccatctcccatcaaaccctgtgcatcaccaaacatccattccaaatatattttgtcaaatgtatcaataacaaccaaatagataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgtcgcacaaatcaccttcgattagagaggtttttgggggagattgggcgaggagaacacggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagttttcggcaggggttagtttcgaattaagtttttgaaaagggtcaatttgtcaaaaaaacggtagtcagcgctcgtttttggtataaattgttatactaatctattagcatattagataataatagtttagaataatgatggtagtagataaggttttattttttctgtgagatttttttaactaacaaattaaaaagaaatatacatatgaagtcatagtttcaaaattttaaatccagatttgaaaactttcaactcgaaatttattttttttaagtaaaatttgaaaaactttcaactcaactttaaaaactttcaacccagatttgaaaactttcaactcaagatttgaaaactttcaactcggatttaaaaactttcaactcgggattaaaaactttcaactcggatttaaaaactttcaactcaaaatttgaaaactttcaactcgagatttgaaaatttttaaattaagattttaaaaattttcaagtcaagattttaaaactttcaacaaaaaaaattgaaaacacttactgctggaagattaaaatgtaatcataaaaaaacgcaaaaaaaaagaaacagaaaaaaaatcacggaaaaaaagaaagtgaaaaaaaaaagaaaacggtggtaggttagagaagaaaaaatcacgcgcgtgcgccgcgtgggccatatgagtcgggagtgcgtgctgtcggtgtccgtgtgcgaattaggattctcgcgtccgttcgtactaatttcataagtgagaatcgtacgtgaagcctactatttcccccggccaaaaaggtgac

SEQ ID NO: 55667 - DNA, 12604 bp, Oryza sativa
acgagatcctctgactttgtgaagtcagagaagcacagtaccttggctttgatccattctcacccgtagcgagattaatcgatacagtactgctgtttttcgcgtcaacaagtacgctacagtatcagtgaatagtgaattagcacaatggtttttactgttttgtattgttgctacagccaaaacttcaaaacactgttatgtaccatagcaccaggcttattttactgtgtttatctgccgttcgcttgcaaagtcaaagagccggatccgtaggtgttgtacatccacgatttcacgtcatgaaccaactaaactctgcttttgatacaattgatcggtatatatactacacgccaaaaatctccctgcagtttttagtaagcgatgccattaacttttaaacatatatttaatcgtgtaaataagtcatacttgaaatatatatcttccatgataaaccaagttaaaaaaaactgataactacataacttttttaaaaaaaaaagaataatctacatattaaaaatcatctattaaaaacctaaggaacttggtcaaaactccggttttcgaaagctgctaatttaattcaagcattgggaacagtggaacacactgcctatgaatcgtactgtacattgatttgcttgtaccttgtattgatttctgcatgattccttggtttctttttttacacatttacttttccttcaccagatggaataatacacaggaatactagcctaagggcctatttaaatagcaggaatgaaaaaaaaaattgaaggaatagaaaaatcacataactctaacaagaatggaagtgattgaagtgtaaaatagataattgtaaaacacagaaccgtttgattgaatcgtggaaaaaaaacataagaatcggatgagaaaaatatacttaaagggaagtttcatccaaaatctctatagaattgtccatttcatatgaattttttttacggaagttccatatgaattttaaaggattggatcatttaattcgaaggcatttataggaattttttcaataaaattaaaatccttcaaaatttctattttttttctccgaattaaaggagcctaactttttttttctccatgcatgatgcatccaccaccttcctgacctctccctctatatacacaggcgccaccaacaaaaggcacaccaaaaaaaaatctcactactgatcatcacattcatcagtggagtgcagctagctagctagagctaagccaatcgagatgatcgggtggggcgacgtgtacaaggtagtggcggccatggcgccgctctacttcgcgctgggcctcggctacggctccgtgcggtggtggcgcctcttcaccgccgaccagtgcgacgccgtgaaccgcctcgtcgcctgcttcgccgtccccttcttcgccttcgacttcgccgcccgcatcgaccccttcgccctcagctaccgcgtcctcgccgccgacgcgctctccaagctcgccgtcgcgctcgccctcgccgcctgcgccgccgccgcctccacccgctgctgcggctccggcggaggcaagcgcggcggcggcggcgggttctcgtggtgcatcactgggttctcgctggcgacgctgaacaacacgctcgtcgtcggcgtgccgctgctggacgccatgtacgggaagtgggcgcgcgacctcatcgtgcagatctccgtggtgcagaccatcgtctacttcccgctgctgctgctcgcgttcgaggtgaggcgcgccaccacggcggcggcggcgccgccgccgccgccgacggggaccgacgacgacgacgtggaggacggcgccgccgcggcggcgacggcggcggcggcgaggcggtcgctgtggccgctggtgagagcggtgtggctcaaggtggcgcgcaacccgaacgtctacgcgggcgttcttggcgtcgcgtgggcgtgcgtcacaaacaggtgtgcctacgtaagcgactgcatgcatgcagaaattctcgttttgtccgagtctctcattttactaggtgattcccgcgctttgctgcggaagttccgaagtaacttttaatatgtttttaacagggatggatccagcgtaggtgctgtgggactcgagtccccctaccccgcttaatcgcattagtaattttatgaatttgtagtagtaataaaccaacatcattatcaaaacaaaatcagtttgctggaaatgtaagattctctagtcaaaatgttagtaaaaaaacacattaaacaggccataggaaaatgtttatatatagcctactaactgagctttctttattaattagtactctataaaagggacaatcaaagtggatcggaacaaatacaaccattgttagtggaacggctgacatgaacttgtaaaccatatttttgttaattaaagtaacttgatttgactacaagcatctctcatgtttgccccatattaatcaagaattgaatacaagtaaagcaacacactacttgaatatgtattggacgacagtccaatcaggcacatatatatggagaacaactttggcaatttgccataaagttgtctgattcaaatcaggagagaatgtttgctgcaaatgatcagatatgtacctttaatcaaccccccccccccctgaaaaacttgcatattacgcttgtttaggctatggcagattattccaagatcctgttcccaaatcaaacgatgaattctcgagagatttgcagggaattatctttatttgtggcttgatttattgtgactgtcgttcttgctttgcaggtggcatgtcgaaacgccaagcatcatagaggggtcagtgctgatcatgtccaagaccggggttggactctccatgtttagcatgggtacgtaattaaccaattaataatcagctatcacacgacttgatcattcctaacttcttttataataaatatgcagattaaattttttacgtaaaatgatgtggtattaacgtatgattgattgagttttaattattacaaactaaaaaaataaattaatataatattttagagcaactttcatatataaagttttcgcacgaaacacaccgtttagcggtttgaaaagcgtgtcacgaaaatttttatcttcatccaactcttgttggagaaatgaacgggacctaaggactaatgaacaagaaaacgctgtactctcctaactgaaatctgcatttgatttgtttgtgtttgtactctcctgtactgtgcaggtttgttcatggcgttgcaggacaagatcatcgtctgcggcgccggcctgaccgtgctgggcatggcgctgcggtttgtcgccggcccggccgccaccgccgtcggcgccttcgccctcggcctccgcggcgacctcctgcgtcttgccatcatacaggcatacacacatttacacgaaattcattcgccaagttctttttttcttctttcacctgaaatttgtctgaattcaaacggatgcatgcatgacacaagtcctcacgatgaaactgctcgtgatgaacaggctgcgcttcctcaatccatcacgacgttcgtgttcgcaaaggagtacggcctgcacgccgaaatactcagcacagcgtaagtagacaatcttatatacggtttaactggatttcactgaacttctttagtttgatctgcttcagtaccttctgtcaaatttatcttccagggttatattcgggacactggcgtcattaccggtgttgatcgtgtactacattgttctaggcttcatacgatgatcggattaagtttttttttttgtttttgttttttggcacgtcagaatcagagtgcaatgcaaagtagcatggcatgccatcaagctttgtatcactattgatcgagctatgtacttacagaatctgtacttctgatcttaggtaaataatattaagcactatttactcgatgaatgatgcaaaaaaaaaatctgatgcagcaactgcaaatcaaagtacaatagtacccaaatcaatagctagatacagtatatgtgctctacagtggaagaagagttcagaacttcagagttcagatacgaacgccatctcttcaacctctgacatactcctaatggacatggtaggtagcatctgataattaatgccaattaagcagcaccaaaaattgttcggattccatatattgatcatctgatactgcaaaattttgtgcgagtggtttaacgagcattgagtaagcttgcactcatgcatgtttcttcagattcgtgttccattttgtgaagtgcctctgaatttttgtggcattaattattctggttgtcccagagcatcgatcaagctagctacttctgccattgttggccatcatcgattctcttctcgaccaagaataatacttatcactttccacaaatttgctttcgcttggccttaggacaaatgcgttttttttttgtctgtcaggacgtcatgaattgacatgatgccatttgatttgaatgttgaaatgctacaagaatgacctgtttggaggagctttaaattctgaaaagcagctgtttggtaaccaacttctgagaatttggaaaagctctgaaacccagattctcagaagctgtagactgtttggggcagattctagcagaagagctttttggaaaaagctgcagctaggacaagctctcccaaacagggccaattggcttctactccatcactaagcctcaaattgatttgaatgttgaaatgcctcaaattcattgttgacgaatccttgtttgtttggggtcagacgaggccccgacaaaattccaaaatcatctggtaaaacattggtacaattcaaggttcacggtgccatgtaatggatctgactccaataatatccttcgctgctagcttcatccctgatatatgataaatgaataaattacatattggatcactttttataatagttttaatttgaactatcttgaactaagttttcactttttttagaacaaagtttttactttggaccggataatattttcttctttgttacgcctatttccctttggaccggataatatttcctttccgttacaccctgggccacccacatagttctcctttcacctcccctcgcgtgcctctatcattgttgcttaaccagtggaactgcatcttagtggggataattaagggctgctatgttccatttattgtatatcccgagtgatttctccactaagatggaaaatggaaatggattgttaacccgacaaaaaaagatatgaactactttaggaaagcaaaaggagtggtgattatgcaaaacttggtgtaatttcacatcaacgtagaaactgcattgacgaagccacctaatttagttattatatatatagtgcgacattgggtggctttatccattctaggcagcaacttccaattaggagtgttattgctaattaatttgctataggcacaagtgggtgtgggctttttgtttatgctgtagaccaggcccagaatagcccagagtaattaagcccatggtggctaaaacccggctccaagagcccaagacaggttgcccgcaagagagatatgaatctaaatatttttttatattgaaatttaaatcttgagttattattttcaatagtttgtcggctatgggaaatcctgatgccaatattttcaatagtacatgtcaatatttaaaatttagggaaggatcgataatatagcggtaaggttatggatgcatgattatacccgtcaagatttaaatcatagcgctcatgaatattacgaacacattggtacatttttaataagatttaatattaatcttgtattttccatgtgtgttaagggtattcacaaatgtgagtgtggtgtgcatacgcagtgtgcaccagtgtatgcgcactatttataatcaagaaaaactagaattgattgttttttttgttatatatagtcatattacttgttttttacatgtattcgtatgcttcaaattaattaccgttacagatttattgtaagtcaaacatttcagcctcttatcattattttatacaaatttaacattataagatttttatttttacattcgttatcagaaaaactttcatgatgtataattcacttgttgtcaaactgtatggattattaaaattaatgataacgaattagagatagacatgattgatatagtacgcacaataacaataaaaagtttgaaacgaatggaatatttaacttctctagactcccttgttttctcagacgagatgacaaaaaactgtccggaaaatatcctgcaggggcgtaatattcggccatttactacagtggttaataatacaccaacaagtcaacaacaaaatgcagttagcagacagctgcgcaattacgttgcgtgtttgcatacaaaccgataattgattaacaaagttaatgatgcaagcacaggcgttagctgcaaccgtaagttgacttaaatgagaaagaatttgagatcgaatcgtttagtcgctgtcagcatgtgtaccacacctctcccgtactgccggcgtgctcagctaatgctcgaagcctcgaaatcagcaaaaaggattaataaaataccatttactaaataaactacaccatgtaagcaaataactagtaataaaatgccgtctgaattggtttgattggtggggaaaaatattaaaattatgtaagatttggatcatattagaaaatttctcctatttggtgctttaaaataaagctccaagaatcctatgaaatgctcaagaaaaaaaaaagataattcgaaggaaagttagcatgacgttgaactgtatgaaaaccttttctttttgagtctttttattcattctttaagagtgttcataattatattattcctcttatattttctctctacaacttatatgaaactaaaaattcttttagttttcatatactcattttttttgcgggaaagtttttttttaatatactctcttcctacaaatcgaatgatacttatataaattaattattaaaaatccaaatccttttttttaaaacggaataaacccttaccgtatcatacggttaaaaggaccctcaaacatttaggatatttaactatttattaccactcttatatatgataattaaccatttatcacttagatccacatgttacttatgcataaggccccacatatcattgacacatggttgccaaatggttaaacgccaaatctaagagttaaaataaaaagttaaatgccccccaattttagagcggaaatgctactaggagagccctcgcccgcccagagcgatcagatttcccaccccctcccttcacctggttttcttttttagcatcgtattacttttctattttagtaaatttatgtacctaaagtttatatacctcaagtttacacatctaaagtttagagaccaaaagtttataaatcaaaagtttatatatccgattcaaatttgaatttgaattcaaatattttttatatatagtatttctatacatctaaagtttatacacctaaagtttatataactaaagtttatatatccgattcaaatttgaatttgaattcaaatatttttcacatatagtatttctatacatctaaagtttatacacctaaagtttatagacctaaagtttatatacccggttcaaatttgaatttaaattatatccgattcaaatttaaatttgaattcaaatattttctatatatagtatttctatacatataaagtttatacacctaaagtttatagatccaaagtttataagtcaaaagtttacatacccgattcaaatttaaatttgaatttaaattttttatacataaatttttctaactttttattttttaaaaacttttttatggtgtactgtagtaggaagagaagaaagggggaggaaggggagaagtgggaggagtgcctacagcggagtggggggatccaatcgcctggcgatcgatcgcgcgttaggccccccattttagaggcgttttctagtcagtttgatgaaatttgagcaaaaaaacgccgtagcctgacagcctcccctccccttcgcctcgttcctatcgcctctagtgcccaccaccaccccccaacgcccccgccgctctcctgatatccactagtggccacgccgcgccaccccctacccctcgccacgccgcgccacgccacgcctcgcccatctcctccctataaacccccccgcgcccccagctgctcgggcggcggcggcggcggcgcgaactcgaatctcttctgtccccttccaccaccgtccccccacaggagatgctgcgctgccacacgccgccgcaatgccgcctcggcgcgggcggcgcgggcgcgggggtgctgctgaggcagcggagcgaggtggcggtgcggtgccgcgcgcagcaggtgtccggggtcgaggcggcggcggggacaccggcggcgcgggcggcggtggagggtggggagaggacgagcctggcggagcggctgcggctggggagcctgctggaggacgggctgtcgtacaaggagagcttcatcgtgcggtgctacgaggtgggcatcaacaagacggccaccgtcgagaccatcgccaacctcctccaggtgcgccccccaccacccatgccgggattcctccccgtctcccaaagctactcttcgctggtcagattcgtgctctccgtggctcgatttggggtggagtcctctcggattgcgaaatgtgctgcggccacggtttgtgttgggggggagtggaagcatcgtcttcgttcttgttcttgatagattcggtggtttggatctgaatttagacagctccaatttctccgtacaattataatccgacctcatttgctgtgatgtgacaagatttagtaatactaactttcctcaaatccgtgggctatcatttgcgtagattgagctagagctttgataaagtcaggttgttctagtcttattctagtcgatgtcttttttgcttttatttatattttctggcaattaacaaatcctgagccggcgaaatcgcccatcgaaatttcatgggcatatgcttgcattcctaggtggtatcacactcctttctaatgctgattttcttgtccatgtgtaaatataataaagctataattcctgaattattatgcttaaatacctgataagtacttccaataggggttgtgtatcatgtcagtttaggtagttctgttctgtgtgtctggatgaatgtgcgtggctgttaaaaaaatattgaaattctgatttttgagttctactttggcatcaaatcatgcaaacaagtcaaaatatgactgggcgtatatcgagctagttctggtggaatatagtggattgaatataatcttgatttaaaaactaaggcagtatcaaatggaatgcttttttttcctgaaaacttctgatcattgaatttgaaaaattgataaccagtggtaacaatacgtgtttccgcgttccagaaaaacaataagtgtttctgcttctattagcatttttcttagctatcagtgttggctttatttatatgaagaacactgttgagaagcatctcattattttgtttgtactatgagcttttaatggtaagatttcttgtaaatgcaggaggtagggtgtaaccatgcacaaagtgttgggttctccactgatggttttgccacaactaccacaatgagaaaacttggtctaatttgggtgaccaaccgaatgcacattgagatctacaagtacccagcatggtaagttttcaggattgcatcgaacattgctcccacccttgtttttttagcaagatctagttctgactggtggttctgctctggtcaggggtgatgttgtggagattgaaacttggtgccaagaagatggaaagatcggtactcgtcgtgattggatccttaaggatctggctaatggtgaagttatcggcagagctaccaggtacttattgctcaagtataagagtattcataattacattattttgaaagtggttgcctgatgtgcattcactcaaccatgttgtgcatgctgggattctgaataggtattgagggggtccactggtgatgtcttacatgttttaacttaatatttctcacctctttacttttctccccaccttatttccacttattacacctacacttctccaaatgaattcaaccaaggtaagcctgtaaaataggaaaactcaggtactagattttagcaatctcaaaagagagcgtgaatcgaaacactggaattttttttaatgcccaatgatcttggtgcttgtcttatgcttgaatgttcttacacttgctggctggcaattgtagcagccttaattattcgttcttaatgagtgagacctgctaatgattaattgaacttagtagtttgtactgaacgaaccgttctcttttggtggaaaacaacaaacattttcattatttagtgtttacagtgtaacacagccatatcttcttgtttgtccagcaagtgggtcatgatgaaccaaaatacacgcagacttcaaagagtgagtgatgacgtgagggatgaggtttttgtacactgtccaaagactccaaggtaaacctcctcttgtactcatttagccacagttttcttgcacatgcacatttttgttgctttgatgcatctctgtttttactcttcaattgagccacagattccctttctttaacttggctctgttaaacacacttggatacatattcagtggttttgaattactcgagaatcagaagaatatgttttctttgtattcgtagttgcaaataattcattggtagcttgactgaagattgtacatgtattttctcaaatgactgttatggtataataattattgtaacaagctaccattgtgcagattagcattccccgaggaaaataatggcagtttgaaaaagattccagttcttactgatcctgcacagcactcaagactaggcctagtggttagttctcgtctcagaatgcggttcttttgctctgtccctaaacaattctgtgctgacatatattaatttctgtattgcagccaagaagagctgatctggacatgaaccaacatgtcaataatgtcacttacattggttgggtacttgaagtaagttttccattatctcagttttgctaccagttaactgttcttgcttcatgtgacaggctgacagccctctcctggctgtaatcttactttgagcagttatcatccttgttgatttgtgatgatttctgatctctttctttttccttctaaatggcagagtatacctcaagatattattgatacacatgagttacaaacaatcactcttgactacagaagagagtgccaacatgatgacatagtagattcacttacttatatcgaggaaggagaggagaagagttccaatggatccgcatttgctgcaccgcacccagaagagcagcgacagttcttgcactgcttaagatttgctgggaacgggaacgagatcaaccgtgggcgcaccgtgtggaggaagctagctagatgaattccctagttttgatcatacagtcatatgtattctgatccttccatttgttccatcattttgctcttggtgtctggcatagccctttcagagaatcggttgtaccccaaattttgtgttaatttgttacctttgtaatgtaccgtggtaacaattacagtttgtgacattcgtcttacctgaagttgtgcgttgctgtatactttgtactagtagaatcagtgtttatgaatcttcaaataattctatcggcaacagatagcaatggcatgccaagtttggttcttcctgtatagaatacccagctgctttcactattactatgatatctcagtgataaaaatgtctgttttatataatattataataataaaacgtgtgcatgatatgttggatttagaaatgttatgcagcttttattgtttatcatgtcataagttttgccatttaatttttgcaagtctctatgaacaattattcaaataatagatttataaattactctatttgcaagtgaacctttgctcctcatttgtggattatatgacaccgcagtcaacttgttagctgttatttgtatattgtgtttagttatgcccctagatctttgagggatttccttagattggattaatggtgagttgcttcgagctgaacttattactgattcttcttttcttcaggtcggtgttttcttattcttcctccattttacaatataagacaatctagacatatgcatgtgtttagattcattaacatctaaataaatgtgagcaatgctagaaagtcttacattgtgaaacggaggaagtagcctgtaaataaaaggcataggcaagatacctagcactactaaaactttgtaaatcaaaataggagtaacagctttcatagtttttcctgttgcaacgcacgtgcaatcatatgcacaaaactg

SEQ ID NO: 55668 - DNA, 4732 bp, Oryza sativa
tctctgtaagaacacacaaacagtaccatcaccacatgggaccatcaactaatgccaagttcaggttctttttaagaacacacaaacagtaccatcaccataaagagtacagacgcctaaagaaacacacaaacaggttacaagacaacatgaaagctctcatactacaggagctggggatatatacagtctccaattctcttaaccatggagtaatgtttgatctgagcaacctccaaggcgaaaaactccctgatatgttgctgtatgtttcatgaagcttccctctcctgcaatttcatcaacaaggccacaaggagttcagcgtaacatacaccgatgttgcctgccctcctcatcacatgatgaattcatgacagtaaagcgttctgggtacttccttagtaggtacatcagcttgagccacggtttgcattctgttccagctgctgaagagccagcctctggtgccaggtgcatctggacctggcgctggggccatgttgcactgtaacacgcaacgagctgcaaataatcacagatcagttttcgcgttcatgggtgcagcaataatgcgaaataatgtacttcccccatcttaatgaattcggtcgccgttccttcggccgacccggcaaaaaaaaaatcataataatgtaacaatgtcttgttcaagtttctattaatggcagctgaagtatctaactaattgggaggatagtgacaatggtacaattggcaggcaccactaacttgtaatatgctgagtagtcacttaatttagtataccactcatgtaaaatgattgatttaaatagcaattcgccaattccttagtggaagctcacaatcctagggtcagtaccacctctcaagttgacaaagacacaaagtatttccaaactagtgagtaatgagagacactggatatttccaaaaggtcgcgagcttatttcatgacttccacaacatgttaatctgaggatacggtagggcatatcaggtaggtgaacatttcacaactaaattggacattgcatgctaaagagagtttataaaaaggttatttctgcatgcatgcaaaaggcagaaattgacattgattaccagatacagcaaggttttactttaggctatttttagacctgtgagtttatgcataacttctggcacaagtgatgcgaccaggggtatcatggccacatcaacaaggctatcgaaggatcattgaacttctaagaatgaggacacatgaatgtagttacccaaatatttctgttcaatgtggaactaaggacagtgcaactgatgaatatacttggtccttcagtgcaaagcgtagcctgatgacatatggaaatgaaagtaaatgcctttttctgtatatggatgctagggaattgtttctttttttttctttgagtagaggaattgtctattagttaacaaattattatttctcaaaaatgctgatactttagtgcaacatgtacgaaaggaaaattaaagtgctggataacacaacccacattcctgcacaaaacatatctggaggtggttacactaactttctgaaataaagagacactggacagaaatgagtactcttccacaacaaacctctgaatggagtttttcaataggaatcatctttttaagaccacataggtcagatatcacgattccaatagatgcgagaacatattcctcttcctttagaaggacctcctgctggtctttattattgtctgctggtcttattgctaaattattgactgcataaagaaaaataagctagttaggcatatctacaaataaaataagaaatgtagtaaaaactgatttcttgcatatctgaagagcataatgttaacaaaaaaaataatacaagtgaattggcatagcatgtaccatttagtctagaattatgtttcagtgtatccacaattttgcagaaaaaggaaaacaaaaacttgtagtatcccatatttgttctgttaatattttttttaacactttgcacaactctgtattgaaaaaacaagcagtgaaaaatttaattattccaagagatcaggatcaactaaattttgttataacaagggatatcataagacaggttcacataatcacatgatatgacaattggaaaatcagaaagatagcattgagaaggctagtagtcttggacagttctgtgcatggacctctatttgtccatctctaaccattagtttctgtaatcatgagagctaattgtttatcctctactacagtgggatgcaacgtaaaaatcaatataggccaaagaagtgatagtattattaagaagtaatatgatgccatttcaacctgataagaacaggggaatgtgtgccaacgactgccacaaattttttttggcatgcatgcctaaggatatgcgaacaaaatctgcgccactttggcaagcaaaggacatacttgccacattttttttgcatcaatgacacatgggacctaggtgttaaaaaaatcttgccactagtgtggcaataaccaaaaaatgcctaaatcagtgaaatttgtctaattgaagtgtgccaatatgtggctataaataaaacaggcccataaattttattgtctgtatgagttggttgcatacactttgcagcagaaaaccaaaatttgaactacataaggaatagaaaataagccaaacaaatcctcatgcatgcctgattatttgctttacgattcatctgaacagtttttctgagaagtatgatttccagttttacgtttcctatttgaaattgggtatcatgccaggtaagtaacaaaagataattcacggaatcaggcatatttatcagcatacatatgccatgaatgtgtatactactgctacataagcccatgaatgtgtatactacatattccataaatgtgtatactacatatgccatgaatgtgtatgttgcatatgccatgaatgtgtatattacatattccataaaagatcctaattacaaacagactgattatacacattcaaacttatgcagatacaccaaggtggcactaccatcaccaccaggtgtcattcataaaagtaaatacataaataaagtaagataggaaggaatcaggtctagcagaagaatgtgtcaaagacataccaggctgaccgccaggtgctaatgttggctcaattgtgatgtggtggctgctgcatgtatccaattcaccaaaaggcatcttgttttgattcatgaattcctcttgtgtttcaatgccagctatattttcattttcagcattgttctggatatgagcaggaggaagagtgacgatgccaatttgaccaggttgagcagtgccaatatgaggaggaggagcggcggtgccaatatgagcaggctgagcagcagcacttgcagtgagattatgctcatcagcagcggtgccattgttagcaggctgaaaagcagcagaggcactagggccatgctgattagaggaggtgccgaagatagatcgagttggcaggagaaagtagaatttcttatgtccaatctgaaggaggtcttgggagtccagtttaataggactaccacctggaaggtgaaggacaccttcaacagtgcatccacatttaccaaggactagaagggaaaaccgcttgcattcaaaatcatagaatatgtgtgcgtgatggcgggaaatagtaagatctccaccagagatgtcaagatctaccttttctctcttgctatcgcgtcccaagatgattgaataagtttgcatgaagtactcgaaatcttcaccttgaagctttgcaaatcctacgccacgattgcgaccagcagatgccataacagaaatagaggaagccatcttcaatattcctggtagtagcagtacactgagtgctactgcctttcagtttcttctacaaagtaaaagcaaggcggatgcattaaaatcctttcatgttataaaaatgaaatggttcaaaagatgctaatatactagacaaatgggtactatcggttctttttattgtattactagctaaatgcctgtgctttgctatccatagaaggaaaaaaatatcataatattttctaaaataaataaaagcatattttccatgaaatatgttacccacattttcctatagggaaggctcacattaatttaattttataatgtggcatgtttgtttggcatactcaaattgtcaaagcttgccatacttttttagctaacagcctaacatgcggctaccaaaattgaagccacactttagttcgaagagagcaaccttgccacacttttatgtgccaatgacatctgggacccatgtgatgatgaaggaatcttactacaagcgtggcacgaaccaaacagacacctaactcagtcaaacctgcctaacttgaggcaaattgtggtagtgaaccaaaaaatcagaactacaaggcacattacatgcaaaggtttggtagactcaaactgtgacaatgcacattgacactaaaaatgagaaataatcaaagtgtgcaaaaactaggcacatattttagtgacatatgcttgtctaaccaacctttctacctcttagtatgtggttttaagtaaacatagcggtgtactatagaatggcattgactggtatgaataaaggatagctatgatacatcatgtggatatttttcacaactaaatggactcaataccctat

SEQ ID NO: 55669 - DNA, 15966 bp, Oryza sativa
gtgtgttctgtggggaggacagttttgttactctcctttgtaattattttccttttttgtttcttcttaatgaaatgaagtgtagttctcctacgttttcgagaaaaaaaaagttatcaatattgagattgcagaaaatatacactaccagatagattaatgcactgtcacaaactagtgcgatgaaacatacatttcaataaaacaaatgtgtgtgttgctctcatgtgcagtcaactataaatgatcaccaaaatagtccaactccactttggacataatggcatagatcaagtttatcaatattgagaatttttttttgcggggatcaatattgagaatttgagattgcagaaattatacactaccagatagatcaatgccctgtcacagactagtgtgatgaaacatatatttcattaaaagaaaatgtgtgtgtgtgtgtagctatgcccttgttcttaattcttctacctcacttgctgagttcttgcccttctgaagttcttagcgaagatcacacccattaccactaccacataaaaccaattggaagaatcaagaatattcctcaagcaagcactacagtagatgccaatctatgacgaatatttggaattattttcaagacgcagctaaagaaaaaacacggtgcaagagctagatgaaggtgaaagagatatacttagccaagctctcgcgattcctccggagagcgcaaagatcaccagtcgctgcccgagatgagtcagcggctgagcgagagaggaggatgtggaggcctccccaaatctggctcaaaaccctaaggatgaactcctttccactcctcgatgctgcatttaaatccaaaaatttcagttacaattttctcaccaccttcatgatgatttgcgtgttctactccgcccacaggaaaacccctaaaaaaaaacccaagaaaaccatgagatggccttgactggtatgcataaaggataactataatatagcatgtggatattttccacaactaaaaggactcaataccctatgagcttcaagatggtcatagaataatgaagtagcaaaaacattatcacacacacaactgacattttttcaatcaacgaaacctaggaactgcaatggatttttgtttatttacttcttcagcaaagtatgatggtaaagctctaaatatgatttattcagaaaagctctcaataggctataattatttcacgaaatcgatccaaagtactgcaaaaattgctttcatgtgcagtcaactataagtgatcatcaattcagtccaacttcactttggacataatgggtatagatcaagtttaccaatattgagattgcagaaaatatacactaccagatagatcaatgccctgtcacagactagtgtgatgattgatgaaacatatatttcattttaaaaaaatgtgtttgcagctatgctctcgttcttaattattccatctcacttgttgagttattgctcttctgagaaaagaccacacccagtaccaaaacctcgcaagactaattggaagaatcttcctcacgcaagtactgcagtagaagccactctatgccgaacaattcagaatataattttttcaatacacaactaaagaaacaacagacatggaagagctagaggaagaggaaagagatatactttgtcttaatgcattaaagaagaaagagagaaaagtttaagtgcagttacaaggcgcattacatgcaaaggtttggtagactcaaattgtgacggtgtacattgaaaccataaaaagaaatgatcaaagtgtgcgaaaactaggcacacattttatggcatatgctcatctcaccaacctttctagggaatataccagaactgtcacttaaagcaaagacaataatattgatgcagtatccatcgaattcacctcttagtatgtgattttaagtagacatagtagtgtggtactatagaatagccttgactggtgtgaatacagcatgtggatattttccagaactaaaaggacgcaataccccatgagcttcaagatggtcatagattaatgaagtagcaaaacattatcacgcacaaaatgacattgtttcaaccaaagaaatctaggagcttcaatggatttttatctgttaggctataattatttcatgaaattgatccaagtacaacaaaaattgctttcatgtgcagtctactacaaatgatcaccaaaacggtccaacttcactttggacataaatggcggcatagatcaagtttatcaatattgagattgcagcagcaaatatactgcacggtccctagcagatagatcaatgccctgtgacagactagtgtgctgaagcatatacattttcatcgtaaaaataaataaataaataaataaaagaggacatatgtagctatgcccttgttcttagttcttctacctatcctttcaaaacaaaaatagtctgcctcacttgctgagttcttgctcttctgagcgaagatcacacccattacctctaacacgcaaaactaattggaagaatcttccacaagcaagaactacagcagacaccccaactctatgccgaatgattcgaaattattttcaacacgcagctaaagaaacgacacgatgcaagagctagaggaaggtgaaagagatatactcagccaagctctcgtgattcctccgaagagcacaagatcacccgtcgtcgggcgtcgtcgtcggcggcggcggaggatgtgagaggcctccccaaatctggctcgaaaccctaacgatgagctcctttcccctcctcgctgctgcatttaaatccaagaaatttccgttgcaattttgtcaccaccttcctcatgatttgcgtgttctactccgcccacaggaccccataaaaaaaaaaaaaccaccccccggattgctgcaaccttcatccaatcgcaggcgcggagcggcggcgagggaacgccgccgccaccgccgctccggcgccccgctcccccagctcgcccatctcccaccttcagccgcgcgcctggccgcgcgcgcgctgctctcgccgagcccgacctggagcgagcgcccatttgcggcgagctcgcgcggcggaggcggcgcatgcgaggtgctcggcggcggaagcggaggcgttcgcgcgttcgcggagagttttttttttcctttttgatgatttttttttcgaaggggagaaggctgcagctgtgtggctctgtagagagagtctgcccggtggggccatggagtcagtgagatgaagattcttcgtggctatcgtcgtcttcgcagccagcgaggttcggcgagaaagccttcggcaatggcgaagctcgccgttgctcgtgggatgatcaggggcggaggtaaaacaaaacgaagagggtttcactcgttttctttactctaatttagatataatttagtttgatacaaatgtttaagtttggatgacaggtacatataccgtgaaattagataaaatatattaaaaaaagttatgaaccgggttcttgtacaccccatgagacggtggcgtgagaagaaattgagtgcacaaacacacctgaacttagaagaaatcctagcttgtaatgtatcatgtggatcggtcctatttttttcgcttgtgtttattcatatcttattaccagctaaaaataacttgagaaacttagcaattgaaaaacaaaccatgtaaaatagtctacgataaaaactataaaatcaatttcaaaattaagttttaaaatattcaattttggcttaaaagtataaatataaacaaacatatgagcctctagatagattacaaatggagtaggactaaaccataaacgaacaaatcagccttagatagattacaaatggaggagggctaaaccattaagaataaaaaaaagggctacataattgtttttgttaattttgtttgaggaacataaagacggcctagcattgtttaagaattgtcggatcatgcatgtaatttgggaagaggtcaacaaggagatatactatagtagacaaaattaggactatatttgtcgaaaatctttaattgattgttgggggaaaggtacaggccaaggaggaaaaaatatcaaagggaatgaaatcgatgttcattcttattacacgggaaaaagccagagtggatgtaataggatggttttcaagatgccaagaagttggttgcggagagctgctcggtagaataactgatgagctcagatcattgagtttgcgtggagcaaaaggtgatgtgattttttttcttcctatattttcactataaaccgatgtacataaattgatacatcttcttactataacatcaacaccctattggcttggttttagaaaagagagctggtttatcatctattttctaaaatatttatgtacttgaaggattagctggtcaaaattcatacgagtatgatacccaattcgaccaagcgttctttattttattttatgttcgacgaaagaagagggatggattaggttaaaaattaaagcatttataaattgtaagggattgcaagcgaatttttggtcgtgaacgtatttataacaatggcaacgtagattctttattgtcaatttttttcattgtttgttataagtagtttatgtaaaaatgtttagctatgagagcgggaattatgtgacagttagatcatattattatgttattatagagttcttttccgcttaattttatatgcatattacttgtaatcaatagtgttatgttacctcggcttaaattgagtctttactaactaatccaaccatacagtcatgggtttaatatatattcattgctaactttaaaaacctaatttcacccgttggttaatacacatatcgtcatggtatcgaaagaactagatacaaccatgcactttgtagcgatatttatagttaagaatggttgaaaaattgtcaaactatagcgtcatccaatattagtagcttgtgaggtggattaaggagaaagaaagacgtgtgagtctatatgggcccaacctccagtttgggatttgttaagatgcgaagatctaacgatggctaaaaataagtgatggcatgactcaaccaacatgtagccttttataccagttatttttgttggtggccctacttagcatgatagtttgtagcagaatggccattaaggttctctttggcacaactatgtacctaagatattttggagctaggcatttctagttctacaaattcatagatctagatctacggttactttgataacatttagataaataattttgttctcattttagataaaaattaaaatgttaaaccaatataatttaacatacaaattaaaatctaccatagatctgagatatatatttgtgtcaaatatgacctaaggggcacttttaatgtggaaccttggtccatgcgtggatggaccaggctcttctcccacctgctttggcccatgctcaagtctaaatttcatgtaatcagtagcaactttctttgattctcgtcaactacttctgatgaaccctgagttcctctcgacattcaaggctgttgttggcccgatctttcggtgagttgtgataactacgatttgggataaacgttgacgatccgactacaaccgtacgagacgttgtgttgcgccttagcgatcgatacacctctccgtgggttgttgatcttgcctgacggagcgtgggggctcctcaccgggagaccgcgcaggcctccctttgccggttcggccgggggccctgggtgaggttctaagctcctagcctgtggaaagttcacgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttcccctcctctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatagctgtctgctgacgacatgaccattgtcagaccggtcacaaatcggtcattcttgtccaccacgtgtcagtttaacaatctgcatgttcgcccctcttcatacaatgtcttgcttgtaatggttaggatgaagcctggtatatatctgaccgggaccaacgtgccatctccaggaggtaacacgccggctccggctagggacgagtgcttggaggctctcatcctgatgggatggggcgaggcgtgcgtcagaccgcctgtctccacctaacccacgatctgatcggtctgtgactggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgactcctcggggagacaaagagaagggcggccgtatcaccctcgggcccgaccctcccccgagggggttaggccacgtgggtgatcgtgtctgcctcaagtctctaagtcatgatactcccggtcccatgtcaccgacattgccggtgcagaacaaccctatttctgcaagcaaatcgaagaaacaagcaagaacaagataaaagcaatctgatattgcaaataggaatttaatacaaatgataagttggggttccgaagaacaagcggacggacggtctagccgacacgcgcgctgcaagcaagtagcaatggctaaactttaatctatcaaaacccgagaaacccttaaggggtacctagctatttaaggaggtgggaggacgaccaagagggtcctagggtcgtgctccaccagcttgggccgcaccccacatgggccccacctgggccggggtcccaaatgaagttacaagcccacaggcccattataggtgacgcagcaccttgttcctgtgattccggccacacgagatggaattcggagaagaagctggatccgttggaaagagggctccgagagctttccatcaagtactcacgggctgaaaacggaggtcgtatgcagattcggcggccgtttgaagtcagcagtgtagtaggtggccgaatcggattccagcactgggaggacttgatctcgatatcttcttgttcatccatgatgtgagtaatggttacatccgtggtagccatggtcacatcaacttcaaataagctcatgtttaaatgccatcaaacaatttatgattttagcccaaaaatatttagttcaaaagccatgaataaagaagacggtgtaagagatacacatgtaataatgtcgtgctaccatggtacttcctcgttccaaaacgaaattgtttctagcacatactttgtttcgaatcgaaacaatttctccacctacccctcctctcgactgataacaaatattctccatctcattttttcacatactatcttttatcaatcaatcacaacatttatcaaacatttccatctactttattagtatcgtactaatctaaaaatatttatattttgggatggaggtagtacgaaattgaacggcccaaactgtccaaccaacccatttacccaacccaaattaatcaggccctgttactgaatcgaacagcccaaacggcccaacccaacccagcccagcccaaattgaccaggccctgttacgtctcgtgctccccttcatctccccatctcattggcagcggctgccggataaaataaaataaaaataaaaacttattttttttcctcccccactctccccgacctccaccctctgccaccccggccgcctcaccgccgcgccgtcctcctgcacggcggcgccgccgccgccaaagctgagcctgctctcttgccgaccggcgcccaactcccagcctcggcctccacccttccggtaaagctcgccattcttttttttctttctttctttctttcttttctgtttgggttcttgacactggttgtccggcttggtttcttgcttagtcttgatctctccgattcggaaggggatttctgttggtgtagggtttgtacacggttcgtgcccggagtttctgcgcggtcgtgggttttttttcccccttaagcttgacaagatttgctcgtgtagttcgtgattgggttttgtttctctagggtttcttgagatactcacgatatggattacatttcagattcttgcgtctcggcatcggaagcgatggggaagagggtgaaggcgaaggccaagaatccgaggaaagcacagcaacaacaggagccgacggcagcggcgccctctgatgctggatctggggatgcggcggcggcggcggcgcaggactcggggaattcgacggaggaagctgctgctgctgctgctgctgccgcgtcggccagcggcagggagcagtgcggacactacggcggcgacagcgcccgcttggacaaggtcctcttggagatcatgacgtccaagcatttcgcgtcgtgcgagcattgccgggatgatgcccctaggaagaaagggggtggcaaggagaaagggggtaagcagcagcagaagaagaaaggaggtggaacgaaaggttccgcggccaaggcgaaggtggagaagagtgacatgtgggtgtgcttggactgcggtcggcatttctgcgggggtgaggttgatgtgaccaagccgtacggccatgcccgaaggcatgccaagcaggaccggcattggtgggctgcacggtttgatgatccgactgttgcgttttgtttgtcgtgtgagaaggaggtgtcgatcgagatgcctagaatagagacagttgccgcagtgccaacagaggtggctggtgcagctgacagagatctaggtttggttaactctcatggtagtgtaatcagagggctgccaaatcttgggaacacatgcttcttcaatgcagtgatgcagagcctcctcgcgcttgataggttgcgcagtaagatgttgggaccagatgttccaacgggggctcttttgatgtcattgaagaaactcttcatggagacaagtgcttcaaatgatgtaggaggtgcgctgagtccaaagaatctcttctcaaatatttgctcaaagtacccgcagttcagggcttccagatgcaggacagccatgaattactccgctgttttcttgatggtctgcacacggaggaaaatgaagcacggaagctagcggatgaagcttcaagtgcaaccattcctacaattgtcgattccatctttgggggtcagctgtctagtacagtgtccagcacagaatgcacacacagttctgttaaacatgaccaattccttgatctgtcactaccagttccatccaggaggcctccagccaagagtgtgtcatcaccaccagcaaagaggaacaaacaatccctaagagataggaataaaaatcggagatatgggaagatttcgacccgagtgactcctacaatagaggtgagcaacaaagaaaagattcaaacagttgctgaaggcaataattccctgattcctggttcagagtcaggacaggttgtcagtgagaaagagcctgagccttctgaatgcagtgagtcatgtgcttctgtgcctaatctagaacaaacaggtacttcaaatgtggaggatggcacttgctggttggattacattgatgatgcagatgaagcaaaatcagagattcttgattctgcagattctattgaagcgggacagatctgggaagacaagggtgttacttatggtccatttcttccacaggatgatgccttatcgaaagagcaggtcttgggttctgaacactctggtgaaaaccctattgatgatgcaacatcttcacagcctgttatcttgcttccttacaaagaatttggttccactgccaatgaaatggatggaaccacagaaaattcacagaaaccagaagatgcagttgctcctccagctgtttctcccttgccagaagataatgcacaacctgcatctgttggcgatggggatcaagatgactatgttggtcttggtgatatgttcaatgagcctgaagttacttctgaagtcaagaaagaaataggtacagttgaagatattgatgtgatggcctggagtagcaacagtgctgaagacgaggtggatgatagtaatgctcccgtatcagttgagggctgcttggctttgtttactgaaccggagttgctctctgaaccatggcactgtgagctctgctctgactctattgcatgcccaaacaccaatgatggcaaagatgatgagatggcgactagtgtcaatgaaagaaaggatggtgaggagatgatggcaggtggtgatgaaacacaagacggtgataagttgatcgctaactgcaccgaaaaggagggcattgatcagattatggcaactgacggttgctcagataatttaaatagtgatatgaacagtaaagaaggtggttgtgcaaattcttctttggttggtgctgacaactcagttgatgctaactttccagaaaatgggaaagttgctttactgaaaacaggttcgtcacttgttgacacaactgaacaggcagacagcaaagcatatcgtcgagagattagggatttgaacaactcagcagtggaatatacatcttcgagtaagcaacctcatgattctgcccagcataaggatgaacataatgtggatgtagcctctgaagaaacaactgcaccagagtgttcttgtgacaacgaatctgcctcttgcagcacaaccaataagaatgaagctgaatgtggtgttggtgctgaagaaattgttactagtagccttccatctgagacgcaaagaatcttaccaggtgaaaaagacaatgaagatgttgtcacgcggaatcatggcagaaggaagcgaatgaagatggttggcaaggcacatcaagggcaagataaccaaaatgaacagaaagagaatggaaaaaaggttttcagatctgcaatgagaaggatccttattagcaaggcgccacctgtattgacaattaatttgaacagattcagtcaggactcgcatggtcggttcaagaaattgaaagggcatgtgcactttaaggagacacttgatgtgcggccattcatggacccaaggtattgaactttttttttcagttagaagtactgatgttttttatcaacctgtcagctttctgattagctgtgaccatctgccattagtctattcgcatttgctactaagaggtcccactgtccatgcatagccattgacatttaaatatttacactacaaattacctcacaagtggttttcaactatgtagctgatattactcctgcaaggaaattgtcgtagacacatagttaggatagatagcgaatgtttagcttccaggtaattttggttcctcatccctagcgattggccaatgttgtttgagaagataaattgctgcactatttgtcatgctttttaagaagaaatgtagatcagatttttgttacattgagagtgcattgcattatcgtattcaactccaccatgtccttatcgtcgtataaacagtaatatacctgaaaacatttcatagtcaatgtgaatttggaggtctgggttaatttagcagtgcaacacgatttagactacaaggtagtaagcagatcaatatgtctcttttgtttacctggaaatgtgtttgtatttacggatgctatgtctatgattaataaatgggttgcttctttgaactttctaattcctaaataatcagttatatctattgaaagagaacaacatcatgtggatacaaattggttagcttttagaagctgcagcaaattgttattcaccatttatatgctgattgaaacactttgacttgagcaatggttctgaaatttcccatcggcttcataattttgggatcatgtctagatgttgaccatgtagtacaatagtatacacaacccagtgcatgtacattcttgcccatgatttttcagaaaggatggccagtccaaaagattgtaaaagaacagtcctaaaccagctagtgcctagtgatatgggcatatggtagtgattagcagaaaacaagacctggtttcctcttgccctctctcttctgctggttacacacgaaattaggtagatgaaagttcaatccaatctttcagctgttctttaatttcaagagttggtgttaaaagtcatcccatagatgtcccaaagaaaaggcatttacttttaatagcttgtaccatctacacatgatgacttctcaagtgtatataacagtatgccttcccatctgtacaagaataggggaaaaatgtgcttccagcttccaatcttgaattgaactaagaaacgttgtagatgtgcatgtatcacatctgatttgcacgcgagatatcagtattttcggtttcaatgttattaacttgatattgagcccttttgttgttgcatatttcaactgaatggtcttaaacttggtgtcttcaatttgtaatttatgaatactgcagccttagagttgatctgctcatcacctattctctgtaatctgcaggtctaaggagaatgacaatacaacttatcgtctcgttggcgttgttgagcacttgggaaccatggcagctgggcattatgttgcatatgtgagaactggcaagattgggggtcggcagcagaggagcaccggctccaagtcatggttttatgcaagtgatgcacaagtcagagaagcctctctggaggaagttcttaactgcgaggcttacatactgttttacgaaagggtgggagactaagaaaattatgtctgccatccagcaacatcaatcagtctctatcagggcatgttcaaatggcaagcaatagataagaaacgtcattttttggaaaatcagaggctcagttagtcttcatactaattactatccatcaagtccattttgtttctttgattgagtccagttggccttgttaccatttgtctactcagtcaaagagatttttcacaagtggacttgagcagttaatctgttcatactgcctacagcctttttgtcttttgaagcatattttggaggtgtgcaaatgttcagaattggcgagctgctcatacatatcttggcaagggctctgtggagaagcccatagatattgttttacaaccaaacaaacaatgttcaccttagtactacatattttttgattattatgtctccagtctccacccctaaattttgagtgatgggggtgtatactgtaacgtgccctaggtccatttaaaagtggtaattacatacttttacctctgtcatctgggatggaaaaaaatgctccttttattgagaatttttctgtttcatcagaatgtagtgttcgtgctgttgtttgccctggagcttgtgttgaaatgcagtgttttttttcttttttgccctttctgatactgatatctgaatatctgatggtcacacaagccagcaaaaaaccaagatgataattgttaacacatccagttctaactttacttttgcactcaaacctttttctttaagaaacaatttggttacaatctggatccatcctaatgctagtgtgctagtgccgatgctacgttggaaaccaactatggtgagcagactactcaacaacgccgcgtacagcttgtttggatgcaactggaccaagcaaagctcaccgcagatagcgtgcggattgatggcgattcactacgtactggcacacaaaacctgcaggtttctggtttagcacatctcttgttgccagcacaaaaacgtaagaatagtctcggacaaaaaaaatgggggggggggggggggggtaggatcgtaagatctaagtagcgaaggtgacacgtttagccttcctgtattagcttaagctttagatcgaactgattgattcgtataactcaatataggttttttggatgaactgatcaacacatacaactcaatatacgcaatagtctctaaatccatttgtttctcttattcatatgcttatccgaatagcttattagctaataaaaattatttgtgagcgaagcttttcattagcgactaaaaatataaactacgataataaaaagattaaaaataaaattcaaaattaagtttaaaatttaagctttgtcttataagcataatagcgtgcggatcttaaaaataaaacaatgaagccttcagtaccgttccaatttttcccaaacatccaaagggacttcacacagtatggtcttcttgggacttcttgtgcttccagagaataacgctttgatttgtccgtttgacaaaagcacccagccgcccggcgcccaattcctgcatttctacctccttcggtgacccgcgccaacaaccaacgccaaccatccatccatccatccatccatcacaatccggtcactgaaaaatccaccagaaaaaacggcttcggaaacctgcccgccgcttcgtcggaccgcggctcgtagccgactagtccgtccgttgttccgtcacggtcacgccccgcgaaatcacccgccggtcgctgcaaaaacggggcgaaatcgcctagatcgtcttgctcgcgtggccgcggctaaactaactcgagtttttcaccttttgagttttttttttaagaattacacaatacaacacatacactcacccctataaatacacgcacgcaaaccctatccttatgagcatcattgaagactaggccggcaacactcacctctataaatgcacacacgtaaatcctatccctatgagcatcatcgaatactaggccggcaaatccattctggagattgacgaagttactacaggcgccttcctgttgatgggtacgttgcctaccactgaaagcacaaaaccgttaaatcctgaaaaattcgctccttactctaaattattttctaaattctatgactacaatttattgtaatctaaaaaaattaaattgtttggtagagtttctgattttaggaggagcttgttgctccgtcaccggacacggtcagagtccgcgaaatcacgcttcggacgctgcaaaaacggggcgaaatcgtcgtaaccccaccccgaccggcgcccgtgccgctcgcccgcgcgcaccgcgcccgtgggtcgccatgtggtggtcgcgcagcgcggccctcgcgagagccgcatcatcggccatccgccacgtccacactaacggacacacacacgcaaaaaaaaaaaaaaaaagaagaagaagaagagtaaaaccggcgagaccatctgcaagagaggataacacaacacaacacgctgacgctgctgatgcgagtgagataacgagatgcttatgtatttttaggctcttctcgtgaagctgtgtccaaataggcgtaggcttctgcttctccttctccttctccaggtgagtgaggagagaatggaggcgcgggcgatgccgccgccgacgcggacgcggcgaggcgtcacgctcgccgagcagatggccgcgtcgtccaacctccgcgacctcctcaagctccgcgacaacgacgacgacgacgacgacggcggcgggcaaggtggtcgccgccagccgcggccgctgcccgacgcggtggtggtgcggcgggcggcgacgcacgctgctcgacgtcatccg

SEQ ID NO: 55670 - DNA, 8251 bp, Oryza sativa
ggggagcgcggggcgggagggtgtcactgatggcgctgctggagcaggcggagcggcagtggacgacggccgccgccggggacgccagccggaggcgcgtcgcggacgaccacgcggcggcggcggaggcgggcacgaacaagggcttcgccggcgccgccgccggcgtgggagggcggtgctgcgtgtgcatggcgcgcggcaaggccgcggcgttcatcccctgcggccacaccttctgccgcgcctgcgcccgcgagctccgagtcggccgcggccgctgcccgctctgcaacgccgccatccacgacgtcctcaacctcttctgatgtcaccatctccgccgccggcgacgacgccgccaccattaattccgtcgacccaatacaccattgctgtaatgtacttgtagataaaaaaaaggttctactacttcttggcttcttggcaactgcaaatcatatcaaagaattctcagagcatcacctgttcatcaatcacccacccgtgctacacaaccaatcgcgcgattcttggatcgatcgaataaccctctgttcctccatggcagcaacgatccgcagatcccggcacaagtgctttgctgctgattagtaattacgtttgcagccacgcgagtgattgaagattaagttggcgcatgtaattagcacataattaattaaattttaattattataaacttgataaatgagtgtatttgatttttttaaagcaacttctatatagaaagtttttacacggaatatattatttagtagtttaaaaaaaatgctaatgaaaatcgagatataatctacccactctgttttataatgtaagttattttagatttattaatatttatataaatacggacaatattagaatgatttatattatgaaagcaaatcttaatgagaaaataacaggttgctcggtttcagtgcatcgcagtcaccgttgaactccacccgtttgctcggtttcagatcaacgcattagttaaaataaatcaattgttttttcagacgatgcgatcatgtgatgtcatggctggaggagagaagattagatagggatgagttgaaccgtgagcccatctgaccaacggtactccaaacctgacaccttcgttctgatgatgttgacttccctgaagaaatgatcaaattaatttatttcagactaagatcacaccaattgacggcctctgcatgatccggagttccggacagtccacttaaacggctaaaccctgaactgacaaaaatttactgtactataaaatggtttcagaggagatactaaaaatgtggcacctttaggatcgtaaaatcactcttgaactgaaaacgtagaggatacgtacatcattgcttattgcatatgaatatgatatcttgtatacttgtgttgaggctatcaaggccagcactacagtgccaatcactttaatcacacttgtactaccatatttgttagttaagtactagattgagccaatggggcactaacacacactaacatatgcaaccatgcaagcaatgggcactgaaagtgtactttgtaacattggatatattatatcatgttgggtaagctaacttttaccatcaatccatcatgcagaagcacgggttcagagtttcagagcaaaaaacaccccaatcttaaatctaaatctatccctctctagcctgtgattgcgtgcattcgtcgccgttagcctgtctttgcgagcggcgacaccgggaatgatggcgacgccctgcatctgcatgcaaatatgcaatgcaaagcgctagggaccgggaaatggttagctgaattcgctgaaatggcaggagagaagaactggacctttttggagatttgcaagggttcagacaaagcgcattagctggggtggaattgccgtttagcgagcaggaatcgtgtagggctcatgcagtggctgatgacttgtgacagcctacaggaatggggtacccaccactgtactggtacttcgcctgtaatggatcgagagaataattgtacactcagatcttgttgcttaatactttaattccttctggaattacagtcccatcgatcatcgttttgtctccaactaattgtaacccgtgagaccataaaaaactaatatgtaggtaaactttttatatatgtgttcttagctatttaaaaattaatgctgaaaaataaactacgatgagaaaaattatcaaaaacaactctaaaattaaattctaacattaaaatttgcatgcgagcgatggccaataagcatattttacaaactttacaaaaaaatatcttgtgatagattttagcgcaaatcagtctctgtaaaacatggcatgggtagctagctctggtcgccaataattgatctcctcatgaggggacacaatgacctaagcttaattaggagtttaggacagtgattcagtgaacaccgttggttgatgctgtcctagatcgcggtggttgagctgccccgtccgtctgcatggacgcagtcacactatcacaaattcacacaccatctggcattctctgcttcgatggagatagcttgcgaggaagaggaagatgaacagtggcgtcgcacagtttctgatcccaatttttatccattgccacctcagcatggctccccacaataggactatatataaatctttgcctgcctgtcgatctctgtatcttgaattcttgatgtgttcatcggacatgcattgattgattgattgcatgggactccaatccatccactgtttggattggatcgaccgtttttttttttgtggttggcactgggaggaatgtttgtcagaggccggccggatgattagttaaccaaacgtacgatgagaaagaaaattaacaatgcagctagctttagctcatggttgcgaacttgggatggcgaactgtgcatggtccagacaccatacacaaatttcagaggagacgatatacgtcgtgatcatgtactccctccgttacatattgtaaggcattttagtattatcttaaatcaatttttagtgctgattaaatttatagataaatatatgcaacgcttataataacgggcgtattgtttatccgtcgagagcttaacacaaaaaactttactggttgcccatatttcctaataaaccaaacgacttattagggaataaaaattaatttataggtaaaatcattatatatttattcgtaactacttaaaagacaatgataaaaagaaataacgttgaaaatatcttaaaattaacttcacattcaaattcaaaaattcaaattatgcctttttgttttgacttattaggccaatcaatggggctccaagatccatttaggttggaggagatgggagactacggagacaaagagaaagtagccaagtaggatcagaaaagaagcctttcgccttcccatcaacgagtattcctcagttgaggtccttgagccctgaggacgccagcttaggggcctcatgcctcctccgtccagtgtcctgctcgataacgtgcttgtccatgcgattccatgtaacatgcgctgtagccatcagctatgctatgcaacagttgcaggctctacaggttagcacctaacagggatctcctcttagatgctagcacagtttgttatgtttcaagatcaatgtaaatatttttttagaaacacgttacaatcacataagctcacaacgcgtgccctacccctataaacattttcggaagattaggtcaatatatatcttgagattaatgaagtcaccacggccgtatctaactatagtacttaatccgggtgggttggttccaccacaaggaacctaactagttgagctacactcacttcgcaagatcaatgtaaatattaccacgttaaatctagaaatcttctattatatactaaaagtccattaaacttcctacaaacgctctcaagttgccacatggcgctctaataaattagagaaaaccctagaaaatctgagaaaaaaagcaaaacatccgtacattgattttcattaaaattggtgggtccaatattataaaccgttatattagatttgtcttaaagctaaccgcaactacaactatggtcccaccagcctctcacctccccataggtacgtacatgatgtacgtatgtatcgcaacaaaaaaaaacacgccgctctccttccttttgtatctttttttcccttgtatatagtttctttggaatataaatgcatacatatatatgtcgtatttttggattggtactttgtaaagaggagaagggttaatgcaaaatataagtacactgtaaccatgtaaggtaattattatgtctatattcgcggacaactagctactaagctcataactaaaatatcacaccagcgttaaatctaggtctttacagacatatataaattttatcatcatatcgctctttccaaatatacatacctaaattagaaatgcaatattttaaaataaagtttacacccattatatatatagccatttattatctatctattatatactaaaagtccattaaatttctagcaaacattctcaagctgccacgtgggactcctataatcattcctaagacgccacatgacactctaataaattaaagaaaatcatataaattttgggccacatgggacttctataatcgctcctaaaccatatcacgtgaccctctaataaattagagaaaatcatataaattttgagaaaaaaacatatgtaacgtttattttaacttaaattggtaggtccaatattataaactcttagattaaattaatcttacaacaacctagacattagaatttctacagtacatatggtcacacctgtacgtacgttacgtgcatatactctctcccacccactagcccacattgcaagtacatatatacatagtacgtatatgtttcttccttcctctaatcatccctccctcctacttatataatcctattctatagctaataaaatttgaagggtagaatccaatacgcttccggtccgtcacagtatatcaattcattcattttcacttaaatgggtggttccaatattttataccattagattagatctattattaaaaaaaagtaacaccttcctcatatatccatatacatgaggacaaatatattattgtggacctgggcaaaaaaatacttcttacgtacgtatgattgaagaaagaaataaagtaattattacttactactgttcgccacaagaaaaataaaccataagcacatatatacttataataaatcatgataaaggaaaaaacatatgtacgtactacgtgtacagttaggaaaaaaggtcgacgtgttctaaaataatatttctacaatttaaagataaacaacttacacagctgaacttgatctatatataattcaaatataatatatccaatcaatgttctttaaatgttctatattttaaattattttaaaattacatatctactttattatttatatttatgtaattaaataaactactaatatctatggtcctaaatacatcgcaatacatggagccgactgttataataatttttaaataattttacatcatattttagtttagggtgtcagataccactagaggaatatataacactaatttaaatctgcatatgtgaaaataaaaataaaaataacataatttagttgtttttaagtagatatgatttaattttaatttgacaaaaaattggaattttttaagactatttgattggtatttgagaagtgagagaataaatacaacataggtgtgaaaataattatcaaaaatatttccagcctatgatcttgctatatataatacaactccttaatccatcttgatatttatggtcattatgtatgttttttctttgctatatagttttgataacaaataaataatcaagtaacatgtgcgtaacaaacttgacgttacactatagatatttgtcaaaatataaacaataatatagtgcttaggagattatcttggtagtattctttaaaaaaatgactttgtcccggttacatataaattcctcttttgttttgggataaaatttgactcatcgaaattatgtgacgaagggagtataagcaatataagtctatctttaattagataaagtagtctattagctacgttttaacgaaaaataatttcattaatatataataaatccataaagtcatctatagcacacaataaaaaatgttagtaaaattttggaaactgaaatgctaaattctaaaaacgaatcacatatagtacaaatatatatgaaccaactccatcattgtgacacaattttttcttggttgtacagtttcaaataattttagtatagagtttatacgttgcaaggataatcagaagaaaaacataaccaatgtccaaacctattattaaccaaaatatgtttaaaatggactcaaaaaaatatttcaacaatatcatcctaacatttgtaataaaaactaaagcaacattaaataaggtgtctgcgcgtatgcgcgggctactttcctagttttctataaaacctatatataaaaatgtaatccatgtctttgagcaacggtgctgaaaaaaatgtgaaaatgtggtgacaccggtataagataatagcagcgcattgccatagtgagttttgttcggtctctaaaaaattcagctttgaacgtttgagatagctgaaattgatggattaatagatagtctgacttttctgataactatttaagggtatccacgaattaattctctctttcaaagttgttgcataaaaacatttcaaggaaaaaattatatagtttttttacacaaaacgtatgatttagtagattggaaagcatacagatgaaaaatccaaaattcataatcagaaaaagaagtacgtgaaaaaacaaactagcaatgggccaccaaggcccatctcaacattgccaatttctatatgggccgcaagtaaaaccaccgggatatacgaccgccgccgccgccgccgtgctctcgctcgcagggcgcatcggcgagccgccatggcggagcggaaggaaggggaagggaaggtggtggtggtggaggaggaggaggaggagcggcggctgctggggcctgcggagcctgcagcaggaggccggggtgctggagcggctggtgtacaagcaccggaaccagcaccgcggcgccgcctacttccagtacctcctcaaggtgaggcgcgacgtgaggctgctcctcgccgccggcctcggggacgtcctcaccgccgtcttccccgtcctcgcctcccgcaagccggccaacaccatcctcgccgtcaacaggtcaagcttcattcctatgcccccccttggaacttgaatcaacgctgataaaattttgtcgtagcgaggcgtagaattagacgaagccgctctaggattatggcttgattgtgttttttttctttaggcagagtaagaagaagcctggtgcaaaccattgtcaccatgagaggcttttgggtgtcgcacgcttgttatcagaggtgagtgttatactgttattcttttttaccccattgggattcaacacttagcttaagtgtttagagaagttggaagttggaaacactaatggtagtttggacttaataatgtgatgtcaactgacatttttttttcttttctgctactatccagctaattatgacatagatgcaaattattgtgattatctgtaacttatttaggatggcactcttcaccggcccaatgaaaattattgtgattgtccttgcatatttcaaagtcctaaaggaaattttaggtcatatgcaaatccatttatttcctctatggtatatgcggaaaattaagtgacaagctttgtatgctatattcaccattcttgatatgcttctggacagctctagctgatgatagctttacccaaagagaaacttatattttctctgttatgtgcagatggctgaacctgttatgatgggagcagtgtatcctttgcctttttttttgtttctttgttccttgtattctcttgtgcatagaaatattttttttgactggatgcataatatattaaactgtacacttacaactggtttgtcttgtgcaacgcgtgcctcatatttgtaatagtatctttgcccattcttttacctttcatatagt

SEQ ID NO: 55671 - DNA, 7414 bp, Oryza sativa
gatcattttttgttgatttttgccaagcgattcttgctttgctagcaagagtgagggctctggttcaacaggtgagagcagctgcagaattacctacagccaagactgtgttgctatagttatagtaggaaatatatatagtggaagcatatgttggctagtaaggttctttccctcttttcactgaccctatattgtgtgcagatgctacttgatgttgtctcagtttacaacaaggcttctgatcttattgataggaagcaatctgttaagattagtattggtggagcgcaggtgagtttgcttccagagtagcactctgcatgcataactgtcaaatgtcaagcatgatgaaactatactacgtcaaatcatgtttggattggcagaaaactatatttattcaccacataaatcattcatgtcacctttttttttaaaaaaaaaaatccctacaggctttcagagagtactatccctcaagcaatgatgcccgtacttttctggaatgtgtttgggtgaaagataaatttgttttgcatgaaaatacaaaaggtaactgtgagaaaacccaagctgaggatcaaaagtcatgtgcttccgaatcagcagtcctgtatgaaactcttggacaagtttctgaaggttgggatgcaatattttctgttcttcatgatatatttattaatactttggtttcttggtcgcattcttggaatatttacaaatgtccatggcatgttgttttgcatggtatcatgatgtatattagtatggcatttaacttctgattgttgtatcgttaccaccagataatttgattgtgataggtgatatggtgctggctagtatgttttgcaaatttcttcaattgcaatgattacttcatggaataaaatgaaaatgttttcattaccaatagttatgtactccctccatccacaaaagttacacatattacttttgacaccaagaccaaggggaaattaaatcaccttggatgttacaaaatcaagtagtgttgcaaacatgcaacaaatgagtatttagatgactccttaagttctaataaaacatttaatttatctcttcatttaagtcttgaatacataaagactacaaataggaacaacttatttggaaaaactcaaatgtgaaataggtgtaacttttgtggatggagggagtatttaatatgagagggcactacttttatttatggtttgatagcgtcaaactttaaaaggaagtttcagataattctagtgcttctgacatttttttcagatatggaaaatgctgaaggattgaactctcccatgaagctaccagatgccaccttagcaaaccagccagagaaaacccattgccatcgtgatgaagattctcaaagtaggaggcaattggtgaatgacaacaattctaattctctttcagatgcagttgctactcatgtgcattcaactccatgccctgatgtcaagcctgagacaaagaagagagttgcattcattgcagttggaaatccgaaagccactgctagttcgattggaacaactttaactaagaagcagagactagatgtgattccacgcgccactgcagaacctgaagatctatatgtcaagcctgagacaaagaagagagttgcattcatcgcagtaggaaatccgaaagccactgctagttcgagtggaacaactttaactaagaagcagagactagaggtgattccacgcgccactgcagaacctgaagatctatatggcaaattttctgaggatacagacaagtccatattttagattgttttgcactgcagctgaccagtgatcactgaaatacttctcagctttctaacatgaaaagaacaatcaatacaaaagagggctcggtgtagctcaagatatggttaaattttgaagcaacttttgctgtagcatctaggaggttgcttggtttatctcgctaaatcattagtatagccttcattgtattctgggatgcaatattattttgtcatccatttttcaggtgtaattttgcacaaagatgaattttagttcgtcccatctgatgttcaatgtaatatgcattcattctttgatttgacgctgactgcattacgtttgtggagtggccttaagaactcgaaaattcaggagtctggaacgaagtgtatcttgaacttgggttctaaagcatcagattatgcattactgtcgaaaaatcatatgcagacaaaacatggtaataattcctctgaaaaatcctccgtaagtgttaatgctgatctgaagttatacaagaacaccagaattgcatctaataccaagtgatgtacgtcacaagatcagaagcagaaaaaactaacagtaacagattctcctgctgctatctcatcagggcaaactagggagagcagctttgttggaggagaggaagctgacccgtccgttgtcaacatggcaaaatttcagaggaatgccctcaaacttgttttcaacggtttctagttcttcccttgatggtggtttgttgctgcaccaaattgaaaagcaatacatcaaaggtaggaacaacaatcgaagtacacgcaaataacccaaaagtcatgaaccatacgtcgttctcaattttattgcatgtaatgtgacctcttgcgcatttctttacctaccttatgacttgtatggtattttcgttacttctcagtattctttaggggaagttggtgaacaaaaagagtaagtcaaaatagatggagtcaatgataaaatataaaagaaatcatatgattgggtatgcaatttgatgagatggcaaccaactggaacttcggtgctaagcttgaatcgcattcatataattaacatagaagccactttgagtggatataccaggatgacaaacagatctatgactacgtagtacatgaatagcacgtcatagatacatcacgcatgacaaaatacaaaagcttcataccatatatgttactaaatttatatcaagaaaccacaaaaaatgatcatttatgaattgacaatggacggtcaatgcagtaattcaaatatagcactagtgaagatgaactttgtgatcaaaataaaacacaaaccatgatgagatgaaactagagcacgtttctaggtctggatggatgacattcaagtgaccggaaaaggcaacagtaccttaataggcataggacgaaactagggtctcctggggatgtcttcttaaatttgctattcggtagatacacttcaaaggatggatgcatatcatctatgcacatttccttgagcaatttagttatgtcattggaggcaccaccgactctatttaagctctgaatctgatcagtttcaaccacacttgtggaggcatcagtgacgctgtaagtatggctacgcttaactgtccagggaacgccatatcgtccaataatatagccgagcaacttcaagtgcttgtaagcttggaaggcatcccaggagcacccatatttccctccagcaatctttccgtagatttcctccattccaattgtttcaccctcgtaatcaagaagaaccaatgcccctctttctgccaagaacctgcacggtttggtcagctgacaagcctcaaattgagaacgaagcgaaaatccaaggcgtgagaatcatctataatctaaaagcagtgcagcagcgctagtgtagcattgtaaacagagtgcaaactttgggaatgtgaccgaagcaagtgcaatcaagtgtacaaggaatccgagtagcgcaggcatttcatcgaacaggtggcgtacccaatctcctcgacattgtagtacagcttgccgtcccggttgacaccggtggtcagccagagcttgcccttgctgtccacaacctccgccgcaccagcctcctccagccacaccgcgcgcgacgccaccttcctgctcccccgctacacaacccgatgagctaacacgaagcaaaggaaaaaaaaaaaaagacagcacctgaactggactctcgacgaagacgacgacggggcggcgtccaagaacggattgagatggtgctcctcgccatcatcctccgcggcaacggcgacggcggcgatcgccggagctcgcccgctcctccgccgccggtggtcgacggcgcgcgtgggcttcggcatggccacttccgtaatttttcccaccaaatttacccttttacctttttaccccccaaccactgccactaaaccaacgggcccacgcgccgggccggcccaccagccggcttctcagccacatgggccacggcaggtggggcccacccgcaagaggtcgaagcccactccgcctcgtcctctaccccctcctcgtctcccttttaaacaggaggagaagaatgggaaacgacctctcctcttcttctctcttcactcgtgttgaaattgaaataaatcgcggtcaagataaaaaaaaaagaaaaaaaaagaagaaaaaaatcgcggtctcctcctcatcgagccgcgcggctggatcgaggattcgagcaggtgcggaatctccaatccctcccgcttctgttcgtttcgatttcgcgtgggtgggattggctcgggtttgggaggcgttagcgatttcgcgtgcggatcgacggggagtttaggtttgatggttccgattcgtgggggggggggggggggtgttaggtttggatttgatcggggaattttggtttgggtggattgattcggtggagatctcttcttcttcttgggggaggttaggatttgggagcccgtgaactacgtgttctagtttacttcttcagtttctggattgttcgtgtggattaaccggggttgatggctacttgtacgattggtggtagggggttggtgggttggtaggttttttggtgataaggctattggatttggcaagtcgagaggttaatttcccaattctgttaaactgttcgcgattttcatttcctagtaagtgtgtatgttgtttcaagattcgtaaatttgtgttctgaattttagaagtatgaaatcctaataaattcaacagttagtttgaattgaaagacgcgaatattagggaaggacctaatatcaaataattagatatttagatggggcgaggcttcgaacacaggtcatttagcccaccaccttgtggagctagccggaagacccctaggtgtttctcaacagttagtttgaattgaatcatataagttcgtaaccccttgaatttcaggttgatttcagagttgagtgccactgattcagctccaaagttagcatgagtactgtcagcggcactcggcgtgccccaaggaggcaatcacaagatggtcctggtgataaagtcgttgtgaacctggacgcgatctcctccccagtggttggaagccgtcgcgcggtgccgacctccactggtgcgcgcgcctcccccattgatgtggaagctctggatgatgaagtgcagacattgtccgcttcgcaagtgcctcctccggtatgtcactttttgttatcttgaactgaaagtattagttcagtcttgattatattctgtactattatctgtagttattgttatatgattgggttcataatgatgtttaagtcttttaccagggtttatgtactactccctatgtttctcaggcacactagatgttcctgttaagaacgaactggtgactttgtctccatgaaaaaaatgatgcatcccttgcccacatttgttgaactgtcttgcattttgcagagaaggaaccggagaactaggaggcagcctgtggcagtagttgatctggaagtagatgctagccgggaaggttagttcatttatacaaagattgcattaatctgtcctaattcataaattagtaatcacgggaaacatgggaatatgctatctattcctatgtttgccattcatcaatctgtcctaagtcataacttaataatctgtcctatgtcacaacaataatcatgtattaagtcaagtgtgttttgtgatgataatacacagggaacaaacgtcaaagggttgcacctgttatacactgcctctctccagaaaggggagaagggtccagcttgaaggtatcctataatactatacaattgatccccacttagtttattttcatactccctccgggctggttttatttgtcgttggagctaagttagctgtggatgagaaaatttgttgttcgagtgtttttctcacgtatgggacgagattgcccttgtgcattgatgttgttattcttcccagatcaactcctccttaactccttgaatgcttcgttcccatatcacttaatgatggcatgcatgcatgcagcaaatgtggtataaatacatgcgtaatgtgtggcaaattagcgcggcaaaaagcgtgcgtaagcaaaaacgagattttctagcggcaaaacgcgcgcataagcacaaagtataattggttggtttaattttcgtatgaccttgcacgctggctgcaccgaagctgcatgcatggtgccatgcataatcgccaagacaaaaaaaatgcgcatatccgagaatcgaactcaggtccccacgcaccaagacagatgcactaagccaactgagagtaattagttgcttgtttggatgatacacccagccgtatttaataaggacaaaacaggaaataggaactttacttagtgacttcttggtttttgagattgtgtccgaaacgacaaataaaaccagcccagagggagtaatttccaagtcttcaacttttcagctttaagggcctggttggttattgattacttgtcgtcgctctttattttcttctatgtaaaaagtagctggtactgctgtgcgctcaatattgactcttttggcctccctatagagtttacaagttggcctttcagtggagtgagttatttgttttaagttgaaacttgtaggcatttttcttggtccattatgtcatagaatactcatgcttgtagtattatgtatttatgatgatctggtagagagctattaaaattgttcttgacagccactggtagttaagattcttgcttgtcacaaacaattaggattttgctaaatttcaagcattgtcttatgcattctagtgtaaaagtatctattacatgcatttgatacttgtggctgatggcttattgcgttatgcatttagcttaacactgattgcatttcctgttttggaacaatgctgtgaagactagcaatgagcctcctaaggcaaaggaaccggtttttaactgtccggtgtgttggaacaagttggaggagccctccacaacaatttgcggccatatcttctgcacgacatgcatcaagcaagccatccagattcagaagaaatgccctacttgcagaa

SEQ ID NO: 55672 - DNA, 6860 bp, Oryza sativa
cccggcaaaatgaccacctagacccgcatgttcatccaaggctactgttgtttgtatgtagatgcatcaccaggagctcatcagctgcaggtgacaactctggtttaggctaccgaatggcctctctgcctccaaaggatacacaacaaaactaactatagtccccattggttagatttatctagtttgtgtactgttgtatttaccatgcgtttggccatgtaccttaccttctctccatagttgttgacgtagccttgaatcagcttgaaatcgtgatgatgttaacgcattacatgtttactcttgcttgtactcgtttgctgttctgtcttctgtgtcttcaagtttgccttctgtggcagagttgcagccaccaagtcggcacaagtgcagctacatttgtgttagaagtgatgttttttttttcagatgaaatggcccgtgatgaacgaactcggaataacaggagggttgaaggatgcaatcatgcaggtcgaacgaatttgacaggcacttcaacgagcaaacgagcagagacaccgcaagaatttttcaggatttcatttgctatagaaactaaatagtaccaaagccatgtttttttttacacatcaaaaacacatacagatacagaccattcccaacccgttgggatcttcattgtaaatgatttgcctcgcaagctgctgcaacaggaacagctgtatatagttcggaattctgaattaaatcgttcgttaggggcaattctgaattctgatactatatatatatatggctttgaaatataaagttctccaaggaaggtgacacatatttcctgttgtacgagcataaggtgatttgacgctcagactgataacaactgaactagggctcagtctgctttaggcctttgaaggcagtttgttcatcacaggggctattttgtcctctgggagccctctttgaggatcaatcttgtaggtgtcatagaagtccaaaatttccatcgagatattcttgacctgagaattgatgaaaatacaatcaatcattaatggatgaaaatagcaagagaatcaaacgatgggagccagggcaagatcaagtgatcaacaggcacacttacaatgttcatgtcaacacggagctcttcaaaccacagagttatgtccttgtctttaagaacgcttgcaatgtagatgcaggctaatgctatcatatatggtgggtgtatgagaataagatccatcttgtaagtatcattgacaattcccctgcaagtaacagcagatgataagcataggaaaaggtatagttgaaaattttgcgtgcattatgttcactaatcataataaagacaattcaattcatttgtttatttctcatgtgattccagataaaagctactagatcttattgtactctatcacactgaaatgattaaaagtggtaagagtccttcaaaggatattcaatatgacaataataaatggaaatactctcttcaaatctaaaaataaatgtcaacaaattatccatgtggtaattaaaaagggttagacttggaccaccaaatgccagaaagcatctaaaacagcttttctgcataaaacaaaactcaaaacagacttcacagatacaaaaatgcaaattgttataagaagagtaccaggcaaattgtgtcagatctgttatgccagcatcctgcaataacctaaaatcaaagcatctgttaataccattgcagctctgatgttcatttaaagtatatataagggcttcggtaattccggtgaaagataatgttgtttcatcgcatgatagtggaaaaagaatcttactgtaaaagaggacgatatgggtggtaaacaactaaataatagtcaagtgcctccaggagcttcatttccatttcaaggatatccttgatttcaaaccggtacttctcatcagaagctacattttgcggggggagagcacatgtttagttttaggttagtgcagttcttcccgataaatatgtgtccatttatgattatgagccttaccacacatcttttttatgtaaaagacaagaagtcttgcttgcactgtgctctcttccacctttgatgccaaatacaaacaggttggtgctaccagacgaggatcatattcagtcatgctctttctgtaaacatatccagcatcagaacaaaattctaatagcttgatgttccactgcaacaaagaattaaatgttctggaatgaaatattagaaagcactgtgcactgtgccactgtgtactctagttcttatcgaagaaagtagagaatcacatcaacatagtagagaatcacatcaacattttgcaagccccccacataccataattcttagggcattaattagctagagaaaggaaaatgatagccttattaggaagttagaaagtatattgtttatagattataaggtagtcaccttaatgggaaagtaaggccatctacagtgtgaattcgcaccaaacaagctataaagcagtctcgcagcttagcattgttagctctagtgtgttactcatctcctaattaacatttggaacccataatcaagtcactctcctctccacctctctcttgtatatcagggaatatatttattgtgcaccaaattgagaagttctattttacttacatgagagatggctttactttcccattaaggtggcaaccctataatcttaaaaatacgctttctaatttcctaataaggttatcattttcccttctctagctagttaaattgacagtcaaattcatatggatatcttaggcactctttctcctcgatgaatagaaggcaactgcctttcccatgtatccttaaagagaatcataccttgtgtatacacgcctgaaataagtaacagcagtagctatcaccctgaaaatacaaatgacataagatcagtatcttcaaaaacttgaggtcggtatctcaaggtaataatggataagtctggtggaaaatggacaaaattagtagatatagagtaaacattatgagttacagttaaccttgtgagaacgttgaaatgcccttatggttgacagatactacagtaaagggaaaaatataaaagtataactaacatgttcgtttttctcttaaagaaattatatctcagtctttaaggccaagcagacagcagaaatgttacagcaaaaatgaatcttgacgagggaaacattaaaacaaaaccaaagtatttatgtctctaaagtaatgagccagcaatttatacactataacatatatttccacaggcttgaaagtaatccttcagaaaagtaactgccaaatttgttgcaagtagaaaggaagcagaatccccttcttaaaataattaccctaaaaaagtcacccttggtaacatttttagaaatagtctacagcgcatagagtgtacaaggaaagcctgctaactaagtcccaatgcaaaatgacaactttggttgttcgataagggcatcctataacaaatggtacaggccagaaagtggagagaaggtttaacctttgtctaactttcacctgttgtgccaatcgccagatatctgaaatcatcaaatgatttgccttaatttgtaggactaacacaaaagtacaaaacatgaacatcgagcaatcttaagtgagacgctacagcttctataaatggaacgaaatactatgcgctcctatccattttcatacctacggtagttatgctacacctttgtcgatttatggaaacaatgctagcatagcttgcagtgaccccactataaccgaataagaatacaaatctgtatgttcgagaattttccatacgaagatgcataacattgcgcaagggcatgactacacatcctatgacaacttgattcattgcaattacagcaaaaatctgtgcatattaatggctaaaagttccctttcttaaccaccgaatgaccaaacaacacatgccgtgagctgaaaatgctttgcatacaacaattatacactacaagcatactacacaaatttctaattgccttgtaactatagccaattcctttgatcaacacaacccaattaaaacgtactagtatgcatgtgacacaaagttgtatatactgactaccgaattcatctagaacgagcccactaacgctcgcatactagttcctaaaatcattctcaaatccgtttatgctaagtagcagtatctccccaattccagaaaccaggcaatcacaccgagcccggagctgagaacaaattcgcgtcaacgaaagcatcacaggaaagctaaagggaggagaagctcacggaaggacatgtggatcttgacgaggcggaactcctccagcgtgatgccccggtcgctgtccgcctgggggaccttgtccacgtcctcctggtccagcagctgcttgctgccctcgctcgccgcgggatcacacacgaacgaacaccccccaaatcagcagcagctcagctcacggattcgcagcccaagaaaccgaatcgagagggggggaaacgtgggggaggttggacgcttaccagtgcgacgacgtccagaagttggcggccatcgtgggcagggcggaggcgactccggcgagcctctccggccgaatcggcggcgctcaccgggaagagctcggagttcgccggaggggaggggtgaaggggaggggacccaccggcgtcggggatggattaggaggtggttttatcaggctcgagttttgggccgtttgggctttgggctcttcgaggcttactcggcccagaccaaatgatgggccgattcactatttcgctagtattttgcctcctaaagttcaaaattacaggagcctctctggggaatgttaagattgtaagaaataattggttggtaaccagtttttgataatgaaaaaaaaataggtttttcaacttctaattttcagttcatttttttagtctacaactatagattcttagaatctggacgaaaagctctgggagaagcgggaggtgatagaaactcttcaaatagggccttgaactgtttggtgtttggtatgttacccaaatcaatcatgataaatcaaattatgtaattcctctattttgttgttgcgtcagcaaaaatgtaattctgaattgtgacaaaaaaggaacttgtatggtagaggtatgtgaatgcggatgtgatagtatttttggtttgatgccttccaagatgtggtacctcgtattacatttttggtatagtggggtacttagggtttgtttggattgctaccttccagaaatttgctatggttggtttgggcaaacataccaaacactttgttttcacaagcaaattggagctcttttttaaggagggaaatataattaaaaaccaaccatgaattatattagctttttttctaaaaggtgaaaaagtataacaaccatgaattcaaaagtgctacatcatcaacattgatttaaataaacaaagggtaggagtaacctttcatacctgtcttgtaacatgaggattgctgtggataaaatgcctatttaccccccaaaagtgctcattcccttatttatccctcgttctctcaataacactcgagcccatattccacatgtcaaaactaagacatctatacattctatatagttataacccactaagtttaaaactcaacatacaaatatactagctcatcattcactaacaataattacatataaaaactcatacaagtattcaacattatttacaattcattgaattctacaaatcaacatgcaaagcatatgtgattatcacaccttacatcatttccataatattttaacatatctattcatcattatattacttaatatatatttatccggataacatttattgattgctcccagcgaaaaacatttagtccttatttggttaatccttacgagggaggaattggaggggatttattgtggtgtggaattattccccctcaatcccctctaaaccgaacatggccttaatcattgccaaccggggctccccttttcccattaaattggaagtcatcgggaaatacatttcaccgagggccctggcaaatgacactgtagctagctctggtaggccttctttggctggtatgacaagtgccctcacatgtaggtcgttgtgcagtgtcatatattgtacagtactacatatgagtacttgacaggaggaaaaaaaaaagaaatctctttaaggtggtcgctcagtcgtctactcaccatgtaagaacaaacagttgctgctcccaaacattcacatgctgtcctctcccaagtctgaacatgcatattcagaccaaaaaaaaacatcagtataactaacagtccaatatgtactcgtgctatgtcatttgctctctcctgtatcgtaggatcagccgcagctaaaatctataattttaaaacttaattttagagttgattttaaatttttttcgtaatttatttattaacactagttttgaagtaactataaacacatcttacaagttatattttttaaattgctaataattaactgtggacgaaacgcgatggaatcatactgttcatcttcgaagaacagatgtcggtttgcacgtccttcttggcgcaattcaatacgattcaggcttgatgtcgacgacgacctgtcatggaatgataccagaattaatggatggggaacacccagcatgttgacgtctcagcaaccaatccaagtgaattatgatctaactagctactgaaaattcctttatccagtgctaaccaatcagctctaacgatgaaactgtcagggaaaaggttggagtgaatatc

SEQ ID NO: 55673 - DNA, 5476 bp, Oryza sativa
taaatattgccaagtgtggcatactcatttcagaatcttccaaagtttttttgaactaaaatattgccaactttgcatctctctatggattagatttcactaaagatattttcatcatgcagccacccatatgatccttgtacttacgcaggccgtagggtcccttggcttcaaaaaagtcaaggaatccaacctcaaatcagataaactttagtgcagcgattggaacagatgccacattggatctgattggacttgtctggataggattatcaatttatcatggccaaaacatccgtcatgtcatgtgcatacgcctgttcgtccattgccagctaaatattcagaacctaacactgaactttttccacactgatcagaaattaagaatgccaaacacaactagctcctgatcaatcaagcgacattacaatctgcaactgcaagtgagtagatgcatgtgtactgtagtataatcgcattcaaaacgaggagtactacattgcaatgaagaatttgtttcgccaagattgatcaacctgacatggcagctccttcgcaattgcagcattgcctgcccttctcctgaaagtgccataagtcttcctgtacctgaagaacataaattcttgcaacaccgaacagatcaccaataaatcatggtacttttgaaggacatatgttcgtcagatctatgcatattcagacacaatacttatcagggcaaatacttatcgttggaatcagctagcaattaactccatgaagtttcagctatacatatacatattcgatgcaagaattaatcaatacggttatacggagatcgacagacataattgcatctagcttgacgccttaatctgtctgacctacactcgtgtctctcgtagtactactactaaatatcaggattatatatgtcaatggcatcatttccattctctgcattcaatccaagaacctttcaggctttcagtgacaaccaaacggtccccctttgcaagcctgcaactgccatggattggagagcatgcttcgtcataaagtggcatgctctccatcgaaaatgacatgcgtgtgcttgatgcttcgatcgatcttgatttggtggtctcatgacaaattacgaattggggttgcacaaacatgtcgacattttctttcaggattttgccggtgccaacatgatcaatggacttattaatagcagcagcattagcagcatgttcaaccacatgtatcatgtacaagtacaactgcaactcacttaatctggaacatgcgtaattaaagaagggacatggattacagactcgtgtgtatagctgaaatagtgaaattaaactgtactctaccctgttaatcatttacgtttcagttttttgctacctaatactcgtcaaaaatatttgacgagatttcgttaaaaatttaaagttccgaccatcaataatttctttaaatttgctgcctgttactatagaaaatatttagggcgagattcagttaaaattttagaattccaaccatgaataatttatcaaatgcttagtttttttaagaaataataaacatggatttgtctcaaaagtagtatcataaccatgatatcgtaaacttattggatatcataaacttattctaataaaaagttggtttttagaatttaaaagtttgatagaattttatcctaaacattaaatatttataaccgcgcgtgggactaccaaattacgtgaaacatagtactaggtcagttcaacccaaacaaataacatggaatgtaaaaaaaaacacaaatattagataataaatagaagtgtgagccttcgaatctaggccggctagtctaccaccctatggagttagccgaaaaacgctgggcgtttctcaacagtgaaatatataacaatcaaattaaagaatcatgcatcatatccaattatatggtcgagcttaaccaaatgattagaggggagaagggagcacagacgttgctctcagctcgctctgtcactacccagtgagccactctgtcatgcacgttgcctcgattgctcagtaacgcactccctccgtcccacgatataagggattttgagtttttgataacaacgtttgactactcatcttaatcaattttttttaaaatataaaaaacaaaaagttgtgcttaagatactgtagataataaagtaagtcacaaataaaataaataatagttttaaatttttttgaataagacaagtggtcaaccgttgcaagtaaaaactcaaaatcccttatattatgggacggagggagtagttactagagtaatacccatgcttttctaaagataaaacaaaatatattatgatattatctaaaataattcttttataaatatattatctgtcttttttctaaggggaatattcatcttaacttagttttatatgtgtttatcatttagatttggatagtttgtaaaatttatatgtgtttatcacttagatttggatagtttgtaaaatttataatagaaagatgaagtggtagattactatcaagtaccgacatataattaagctggattgaccaagcatgcaatgatataagttactaagaacatccatgtgaaataaatatatattccttccgttttttaatagataacattatttactttcaaacacatatttaaccattcattttattaaaataatattatgcatatgtataagatataaatcatacttaaaatatttgaagtgataaaacaactcacaacaaaataaattataattatgtatttttttaataatacgaacgatcaaatgtgcgataaaaagttaactacgttatctataaaaaaaatgaggtctatggcattgctctcactctcagctagccaccgacacatccagaaacgcgtgcagacgccggccatggctgatggcttaggtacaggtacatgccctaacattgtctgcatttgcatgtactcctatatgaatgcgagaacgacgacgaccgtacgacagtaccggcttttgtatcttacgatgggagctgggcactgtgctgctgtctaacgctgataataataatactagtaatcaattaagtcatacccttgctgctggacctgtctgtcatgtggaagatacgactgcacccccccatggtctgctactcatatgctagctgactgatcagtgatccagttgtagtttttcgtttcctttcagctatctttatgataataagctgtaggtgtagggaccaaagaggatttttttttatttatttttgaacttttctatttttaatcttaaaaataaacactttcaaaacttatttacttataagatctgaatcttttggttatgtcatgattggcatggcaaaataacattgtcacgccgatctggctggcgtggcagcgttatttggccacaccatcctcactggcatggcgggataaaactgttatgctcgctgtgtgtgacgtgtcagtattgtttcgaaaataagttttgaaagattggcatggccaaaggttcaaattctgaaaacaagttttgaaatggtctacttttaaaataaaatataaaaaaataaaaaaataaaaaaatcaccaatgcgtggttctttaaccttttgagatcaatcttgcaaactcgtgcttgttttgcaccctatattcatcggatttttctcgcctattagagcaagtttaatagtactctttccgggttgataatacttgtcgttttggataagggtgaggtcaaactttagaatctttgattatcaatcatttttaaaatatttctctttcaaatatggtgactatatgtatagattggtcttaaaaaatactttaataagatcatatatttgtttaacacttttatatatattatagtagaaaataatggttaaagttgttttttggagaccgtgcctttgtccaaaacgacaagtattatcaacccggagggagtataaccaactactagctctaattcatctatagtcaatctaatagttcattcatacaatagttacctatagacatatactaatccattaatatatggtctcacctctcatacacatacaacgtattggagtccgtgccgcagctagctataaatctgtagtctgctttccttctctctcttcttttctcttctctacatgtgtttgtagctgacttatagcctgccattgtactcgctcttactcgctccacgcttgtaagattatacgatttctcaaaaagctttcatctaatgcattggttaaaccattatttcagatgttaacgaacttgccgtacacattttgcttggactttttttctttaatttcgggttgagatggctcagttgttttcagttttcagttggcagatcattaagtcgattcggatcggagtttccgacaggtacattggttaattaattaagacacaactgagaatacaaagataatgcacccggtttttttcaagctacactatcgaattatttccgcgggttttttttatttactatacgtcttgaaaaatatgtttcctcaaaaggatttctcaactttttttaaaaaaaaaccattcctccaaattgtcgacgggggatacccatagactggatatagagggtattggggtacgctagtacgaggatctacgtagtacaacatcaagcaaacaagagacagagattatactggttcagaccccttagtaggtaatagccctaattcagttgatatgggattatacgatgggaatcacagattacaaagggaatagtggaacttgataccaacgagattgtagtcgagttggttcgactagatcacccggtgacttggctcatgtaggctccggcttcgtaggctgtggtggatgtgttggcggtaagattccatgccttaggtcctcccaggggtcccttttataccgcaggtcaattggtctccaagtagaacttggagatgtcggaccccatacgatacagtaacgatccagttctgtccgagtagtactccttccatctgtggactccgtgatgaatttccttaacgtgtacatggaacatccgtatacgtgcaggtataccatatcagtacacgacgtatatccaagggtagagggtataccttatccgtaactctgacacaaatctttgttaaatttattttatgaagtttataaaatatttaattcatcacgataatcaagtagataaataatctaaggtaataatgcgcaataacctgttttcagacagcctcgctggtgacggttgagcgctagcaaacagctcgcgcatgctgcccatgcagagagtcaatggatcaatccatgtatgcgctcgccggcggccgctgctcctcactgtgcgccataaattccaccttcggattggatctgaatatctatcatctatttttagttcgatccgtttaatttaat

SEQ ID NO: 55674 - DNA, 8073 bp, Oryza sativa
  unsure (1)..(8073): unsure at all n locations
tcgatcgatcgagccctactagctgtacatgaacaatgaacaattacatcgtgatctcttaattgaatgcatcttaattctgcatgaattcatgcatgctcttctcgatcgatcgtgttcttgaagcgatcgaggacggacgacactgtgtacttggacgtgaccgatatgcatgagagctttgtaatggtagcgttccaacgctaattaaatacaagcaaattaatcaaggtcatgtcctaatttatgcatgactaaattatgtatgagacagtattgcagcttgcaggtatgccatgatgatgttaacagtcctgcttctggtatccttgacaatgaacgatcgatcgatcgatcgatcaaattaaaggacattagctacgcacagtactgatcaccagcaaaacacatggtcagttgttaatctaatcaacctcctttaatttactccgatcgatcgatccaggtgctaaatagctgttcattaaattcgcagaggcatcagatcaccgttacattcatccattaatccagaatttcaggtactatttcactgcctgcgactgcagtatttgcttctgtgctagtaagagtacttcttttctgaagaatctgttactgctgctgtgctcatacccaactcgatcaatcacccatgggtttagtatcctctatcttcgaagctactacataattttatcactggtatatgggtccgatagaccctaggactcacatgtgagacatagttacaatcggtgttgggcctatatatggccgccgctttctcttccttcctcagggcaagcggcgtcccgcatgctcaccacacctcgaggctgattcattgctagggatgcggttatgcttgcggcatcttaacatgggcaaaggtcattacccacaagaagtggcggctcatcgtccttatagatagagttggtcctcttagtgcggcatggcctcacatgatcttttggctaaaacaactacggtggcgtcaccatgacggtgacaacaacgactgggttagaggtgaactcgagttaggatggactagttatgtccgcacgatccgaagactgccacaatcagaacggtatctttagtggcgattgatgagtgtaaccggtaacgtcagaaatgacggtcggtgcgtcgtcattggcgagctggcttcgatagccatggtagtggcaagatccgacaagtgactgttttacacttcaattactcttcagtgatatttttcgctttggcttgacatcaatcatcggcgctgatgtgcacaaaaattgatttgaataatgatcggacgctgattttgagattctatattccgttttgtaatttgatttatatcgacggtgttatctatttctttagactaatgttctagctagttttcttattagctatcaagttatgatttgtaatccgcggatgcccgatctataaattctataataattaagtttagcttctttaaatgcttcggtccaacgaaaaatatctcgaggtaccgatatctcacggtaccaaatcgttttcgatcgttagatctaacaatatctatcctgtctagttagattcaatgattgaaaatgatttgacaccatgaggtaccgatatctcgagatactttttgcagtactggagtatatctcttattaaacaaactaattgtctcaaaatcctcacgaggaagaggaatccgacgttatggcccgtgagaaagatggcatcaatgcgcaccccccgcatcgcctcatgggctcccctcccctctcgctacacccccggaagcaccgacccatcgacccccagcacgtcacatgcgctttgacaacgatctgagatcgatcgatgtgccgccgcccgccggcggccgcaaccgcttgccggcgacaaaaaaaaccggcgatccccttttgaccttgccagtctccacatgtgcaggcaagtccgtgtgtgtgtataaactagttcagcacggaacgaactcacagcacagcacaatgtgtcattctgcctgctttttttagaatgatattttttatccggtctctacatccaaccatatatatatatatacaactcttttaaattgaaaacttaatctctcaaacaacctaatctaaaaattcactcatatgaagatttgaactcagaatcataagatgctacttagtcagtgcaaaattactatattttgatcaaagttaaaacgtctttgtaatctggaacggagggagtagaatatatgtgtcattctgcctgcctagcttgctagctccactgccgtgcggtgcatgcgaggtcggaccactcccactaccgcgtttcgcccaagttgcgacgagccgaacgaccaaacacaaacgctggatgctgcgattctaccgaattttcgcctgctttctcccgtgcgatctcacccgaattcctctctctctcgtctcgtccccgtttttttttacccgtctccacgaaccaaaaagaattcgaaaccaaaaaaaaaaaaaaaccgcagcgcgcgtcctctctctttataaccttcaagtgttcgtccactccctcctcagctagcagcagctctagcttattactaccaccaccactgtactaccccgcacgacacggcgcgacacggcgcgacgcgacgcgaggaggtgagcgcggatgccggcggacgcggcggcgaaggggatgaagctggagaggtacgcgagcggcgcgggcgcgatgctgctgctgcggcgggcggcgagcgggaaggtcgtgtcggcgtcgtcgcacctgctgttccgcgccaccgtgctcgccacgatggcgctcgtgttcctcttcacgttccactacccgtcgctgctgtcgcgctccttcacgctctcctccggcgccggcgccggcgaggggggagccgcggcgcacgcctcgcaccggagcttgctcatgtcgtcgtcgtcggcgtcggcgtcggcggcgtcggtgtacgggggcgcggcgtgggagaaggaggtgaggcggagcgcgaagccgaggaaggacggggggatagccgtgctggtgaccggcgcggcggggttcgtcggcacgcactgctcgctggcgctgagggcgcgcggcgacggcgtgctggggctcgacaacttcaacgcctactacgacccggagctgaagcgcgcgcggcagaggctcctcgccggccgcggcgtgctcgtgctcgacgccgacatcaacgacgcgctcctgctcgagaagctgttcgacctggtgccgttcacccacgtgctgcacctcgccgcgcaggccggcgtgcgctacgccatggaggcgccgcagacgtacgtggcgtccaacgtggccgggctcgtgaccgtcctcgaggtcgccgccaagcacgccgacccgcagccggcgatcgtctgggcgtcgtcgtcgtcggtgtacggcctcaacaccgacgcacccttctccgaggagcaccgcaccgaccggccggcgtcgctgtacgcggcgaccaagaaggccggcgaggccatcgcgcacacgtacaaccacatctacggcctctccatcaccggcctccgcttcttcaccgtgtacgggccatggggccgccccgacatggcctacttcttcttcgccaagagcatcgtctccggcgagcccatcacgctgttccgcgccgccgacggcgccgacgcgcgccgcgatttcacctacatcgacgacgtcgtcaagggctgcctcggcgcgctcgacacctccggcaagagcaccggctcctccaagtccggcaagaagtccggcccggcgccgctccgcgtctacaacctcggcaacacctcgccggtgccggtcacccgcatggtcgccatcctcgagaagctcctcggcaagaaggccaacaagcgcatcgtcgccatgcccagcaatggcgacgtgcccttcacccacgccaacgtcacccacgccgcccacgacttcggctaccgccccaccacctccctcgacgccggcctccgccacttcgtcgactggttcgccgactactacaagctcaagctcgacgtccccaagatcgccgccaaggtcgccggcgccggcaagccctcctcctcgtcggcctccaagaagaagaagaaggccgcggcgatgtcggcgtcatcatgatcgagcagcacaacaccatgagacaccatgcaagtgtgtattccatagctagttcttggaggctcttgtctgtataacattgtaagtgcttattgtttaagcccctattaatttcttttcttcttcttcttgaggtgtttaatttttagtgattagaaacaagggaataatggtggagaaataacactgttgttggtagataaatatgagaggggtatagagatgatgataaagatcaaaaacacttggaagccaggacagaaagaaagatgaagtcactggcttccttcgaatcaaaatgtctcttttttttcttgttcttttcttttacagtgtcatcacttgttctgttcttgttccacctgatgatgtaagccatatcaacatgctgttgctgatggaatccaatccaatccaatccacatcatgaagctaagctcagctgcaagcaagaaagaacttcacttctacacttctacttttatttctgaaatctgaatcatcacaatcttttaatagataaaaccatatctttctgtctacagaaacttgtgcagattcaggccctgactctgcatttcagtgaggctcatcaaccactgacatttactacttctgcagagtgtgtatgtatgtttgtgtgatcaatcactgaatcacatggctcttgattcgtccagcaatgaggcagcaggtagtggctggttggtgaggggatcatcagcatggtccagtctctaatttgctgctcatttttagcatctttgatgggcagcatgagcacatattcagtacaggccgctgctgctgcttgccgtttcagagttcggccactgtttgcgagattttgtgcttggagacttcgacgcaagtgtactacaaggaagaaaagagagtatttttcctgccgatttgtgcggtgtttttagcgtaaattcagtagaatgtcggcacgatgtcacgaggctacagttttcagaattttcggtgcgttttcaggcacagggttcagcaaatggatattaatcaagagtgccaggctatcttcacttcactcgttcgtagtgagtgagtgatgactgaatgaatgacaattgacaaccgactttttttgtttatggtgagtaacaatcatcttgttgtgatagttgatagagacactgcatattgtctgcaactgtgctttttttttgcagttttttcccagtaattagagatatagttttactctctcctttgttctgccgcagattataacctgaaaggaattttataatttaaattcatactcaattttaggggttttcttcatgattcatcactttggttgctctataagaatccctttatggtacaccgtactacattatactattagaaaatctacctaagattatttttaaaaatcaaattctttttggattataatctgcagctgaactaaacggggtcttttgaactttggattccttttataagccctatttattcgcactggcaatctgtccatgaatggccccctttctgaaccatccatcatgcattcatgctgctaagccttagtcctaggacgattcttgtccatttcctgcctttacaccacagctgcttctttgcatggggccatcagattccagtgatgttgttccattattctactactagatttgtgctacatgatccaaaaaaagagcagagaaaacatcattgtactctgtgaaaaattgtgtatatgctgcagattccagtgatgttgcatattctactatacttgacttttgctacagaatccaaaaatgagcagagaacacatcattgtactctgcgaaaaattgtacattctgcaggcaaaaatatggccttcttgtcncatttgcctttgtttcttctcctgattcaattggttgaacatgcagctcacagcaagaaagccaatgtgtgttcttttctaaggaaagcaagaaatacttcctctatatgagtttcttagaaaattattttaaatccatttttccgtttgtaccctcgaataatcgtcacaaaatcatttagctatttattagtgtggtgcttctgggattgtgctcgcctaaccagatatctcatatgccattttctaacgctgcatcggacaatattttctgactattagttttcagtacacatcattgaaccaaaactatatggtccagtttaaatcttgggaaataaatatgtcggcatctagattgttccaagctccaaacattgcattgaacacggatagtatataggaccagagagaatccatctcataaattatgcagaaagcaacaaataatataaattaagaattagagataggcctgtacttaacaagtctgaattgatgatgaacgaggtctgtctatacaacagtctggtgatcatgttctggagcagcatgaacagaatcatttgtgagcaggaaagcaccttggatctgaggcttgtgacttgtgagatcttggaagtgttgcattgcattgtgcaatgaataataggtcaaagttttcagctagtatttcaggtcatctgtttttttttttttttttggctaaagacaattgaactctgccattttacagctaaaaaataagttatagtaccaaactaattgttcagaaatctctgcactagtgcacttggtctgctatctgaagccagtgctatagtgttagtattatattagtactgcaagttggaagtctggtcccagtggctcaggtaagcttcacagtggagcaatctttgacttgcattggaatggcattagaccagaaaaaaattggacctaatccagattattggtctcccagtgcttcttcaccacttgcaaaaagtatgttactttaattaattccatcatgctgatgatctaagttgatgagcctccatttcaactcttgctgactattggtttagttgtagtaacatgcatgttcccatcattccagcttgcttcgtttactagttgatttctttgtgttcagtctttgtgcgagtctgttcaggaactggagtatctgcaaatctagcagcatgaattttcagctggattgtgatatgtgtgtgtggccatccgcctgacccactataatgaaaaattcagttatttttcagcaaatacagaaaagaaagaaaaaaaaggtccacggcgtcggtcatggccgtggtctgcatccacagtttcagagatgatagaaggcaacaaatctatttggaaatgacactctgacagtaacaaacagcgcctgcgggaagagaaaaacgccgcgggagtttttacggacaaataaagctttgatgaagtcttaaccgttgtgaattatttatggcctcgttatattccagttataccagatactccctctaacttaaacattttagaattttataaaaaaatataacaacatttatatcattaaattagtttcattacgcctagcattaaacatatattccgatagtttcttccaaaaaagtattgccaatttttctataactttgattaaaaaaaaagttgcagagaaaattgcgtcgtcgccgccacaacacctgggctccatctctctagtgggccgggctgagagcaccaggcttcaaccgggggaacaagttcacttagactcctttaagtagtggtcgaatctgattcatatctctgaaccacaataccggatatctcaaccccttaattatcaaaaccgatgcaatttgactccctcggtggttttggagggcggtttcgctgatgtggcggtgttgacttggtcttcatcctacgtggcgtttatgtggcactacaattaaaaaaatatatatggcggtgttgactggttttggtcttatggcatagagagaagctagagaggg

SEQ ID NO: 55675 - DNA, 11810 bp, Oryza sativa
  unsure (1)..(11810): unsure at all n locations
attcattgctaaattcactctctacaagatataaagataggtatgcttatataattttaattcttttgaagataattttagatataattttaatgttaggtgtagggttgaatgcatcacattttcagtcgtgtttatatgattctgttactaatattctctgatcctagttgacgaactgcatctttggttataagttgtaggatttaatcacatctgattcaatattgcctataaagataaggacgattcagataaatatctgtatgaatttactcgtcattgataactatactcaactttgctttgacaatctccaaatcttttaaagagaagtactgaagaaaatccccagatattgttatgcacggttattcattcatctggtctactcattctatgttcttgctgcaaaacatccagatgcactatacgtatgctgtacagagtatacatgtttatttccggttctttgctattctgtcatccttagcttataatatcatattgcacagtataacaacatgattttcccgaacgcatggaaatagcatttgttgattgaacatacctatttcaatttttgctgatccttactaatcactgtctggaaaaagatttatgcaatattcatataaagatcccatgtctcagtccaccaattttttcgagggaaattctcattccacctaccacagctacataccagtgtattttcttcttctgtatgtgatgcagcacatctttgcattgctttcgtacttccagtactactgttctcacattgctttgcatgcaggacattttttggtacattcattccttaatgccacttcgagatgctgctcgtgctgcttgtgtgtctcattcatttttacgatcttggagatgctatccctaccttatgttcagtgaggagctactccgattgcaggagagtgcatttagtgatgatgagagaacgagaaatctcatcagcaaagttaaccacattttacaaaatcactcaggcattggcgtgaagaaactagagcttgttttcttggatagtactgatgtggacttaagttatattgacagttggcttcacaaggctgtcacacgagggattgaagaactcaccctgatactgcctataaacagcaatgcagaatacagcttcccatgttcgcttttatctgatggtaatggtaactcgattcagtatcttcatctctctcgctgtgccatccgccccactgctgatcttggttgcctgagaacattgacaacgttgcatctatattccgtgcgaatcactgggtttgagctagagtaccttctttccaattcacccgcattggagtggttgataatgatggattgtaaagagatagttcagttgaagataccaagttgctgaagcggctccatactctttttgtgagtagatgtcaaatgctgaaagtggtagagagctatgctccaaatatcgccacctttcacttccggggtcatgttcatgcagtgcgaatgttgggtttactgcaagtaaaagaccttgagatgtcatgttcagatcactctagcattctctgctatgctctcaccaatcttttgtctattgtcccaaatgttgaaaaacttagaatatcatcacaaacacaggtaaactctgaagcattacataattatagagtagcaattgtacataaaattgtagacatctattaaaaaattacataaaactgtagacatccattaaaataaaataatacgagacatctttatgcagattgtcagtacacaaactgtaccagggaaatatcttcgcctcaagcacttgcatatatctcttaacaggtccccaaactttgattatctttctcttgtttcttttctcgatgcctctccttcactcgagactttcatcttgcatgtaagtaactagtttcatcttgtaaagacaagtagtatatatcatccataaatataaccatcttttgaagtgttctctctgttttacannataattttgatcctatatgtgcagatatgggacatatacataccactgggtcatatggggcatccttggactcttggagactctgaacagctgaggcagatgccaggacaccgccatgacagtctcaagaaattcgaggtcgtcggttcctgctacgcgaagggcttggtcgagctaacatgtcatatccttgagacgacatcgtcgctcgatcgtattaaactcgacacctgtggttatgttgggctttgtgcttccggcagtggcagatgttacccacattatacagaacaaatcatggaggcctgtaattcagtcttggctatcaggacatacatcatggggaaagttccacctacagtgaagtttgaacttgttgagccttgcagccgttgccctgtacagtagatgctaagttattaccggttaccatgcccatatgttttttttaaccatttttttaaaaccctacggattgccgacataacttgttgagaaaggatcattgcatcctagtcaatatctttaatatatttattcacccataaattactccagcacttgttgagcaattgttgtacaggttacatatttgttgtacagatctctagtcttaaaataagacatcactgaaaaactttacctctgagcaatggactgagcaactgttggacagctactttccaattcactcgtgttgaagtacaaaataagcagcagccttctcaatccaaaaggatataacaataacatggagttctgccgcctcagaagatgataagatagaaagcacctttctgtaaattaaataaattgtacactcaaatggaattaacttggtacagaaagaacggtggaactattcaaatactggttaatatcacaatattaatcgttttagaagaattaaatgaatatagagataacacatgtcactacagaaaaaaggcatcgttatcaaaaatagtggaacaataaagccaccatgtaagtctgaacatcagaacaggacagaatcatggaactaaaatgtccctaaagttgccgtagaacaattctagaatgttatcgtggcaaaatacagtgactatacggatcggggcagaaatttgcatcatattggggagaacatcagtataccagagaactggaaacatccagtctgtcctaatataactattagctggacattttattttattgtagcacaaaaagaactctgtactgaaacttacaatcaaacatgaagttatggtggtcacttgatgttaaattgttgatatgataatagtttttttttccttccatttcgtgagtgaaatacaagcagaaacatctaatgcaatgcaatctctgtataataacttcaaaagcttccacttacctggttttcagcaagcagatactacctccgtcctatataatataggaatataatataggaaggaggtagtatgattaaccattcatgttttgagctgggccacgatctgaagtatctgagagaagcttaaaattttcaaatttccaaactactgggaactaattcacagataatgaattaaacaagatattttcagggatcttcatgatcacaaggctgaaattagcgacttaaaaactgagtgcactgcaaataaatgacaactgatcaataaaggaagaacaatctgtacggaaccaacctgcaatcacactttcagaggtggaaactttagtgcgattttcaaatatatccagttagaactgagtagattggaaaatatccaatgtcaagttgtcgactaatattttatcagcctgtaatgaacaaaaaatcacatataaatatgttacctcatttagggaaagaacacactaccccccaaaagtcagatgcagcaactcgcaacttcttatattagacaagtacaacactaatagctagtggttttaagcatatagtacagtatattgaacaattgataactggaaaaaaaatgcatatcaactcttacacttggttccatgatgctatagagtcttcaacagagacatcagtgtgaagtgtaaacaacttgtcacctcttcagagtggaacacaatacatgatatgctacatagtaatgaaactaacattctgcataactcaaacatcacatccaacagaaagtgaactggtatagaagcatcaaattcaaacctgatgcaaataaaactcattcaatacactcaattattcttcaaaatgggtttcttataccatcactgttacagggaataaccaaactgttcttttccacaaaatactatgatactgtagaagctgcaagctaacataactttaacttgtgcatgaaaacaggaaatctcagtgaactcctcctaactattcattttgcaatttcattgtgacagttaagctcagcaccgcgcttcgaggtctagtttgctcatgaagattgctactggctcaccaggagaaggcggggtcttgtccagcatagaagcatgcacgccagctttagcacgagcagcctcatcagaagcagacaggacctctgcatgttcaaggcctacctgcctcttgatcagctccaagttctcctcgagaacactcatttcaccaaaaggaagcttcaaattcaaagcgtggggcccaacactcctcgcctcatcttttttcgacttgatgaaaggcatgcagagcttctggacttgtttgaagttagtttcctgtccgatggagcagttcttcaatgcttcattaatctcctcatcaggagcaaacaaacgtgcttggctatcaaatttagactggagaaccctcaaacattgctctttccatccataatagttctcattgacgtagaccagaccaacagtcagcttgttttgctcagatggaggaggtgcagttcccttcttgggtttcttggaaccagattcttgcttctggagcagcttcctgaatttaactatggagtcctgtaaatatttgttagcaattcttagtgtgggatctggggttccagcaattggccagcctgcctttattgcaaatccttccttcctcaggatgtttcgccacacatgctcagcatagtgtggacaaatgggggtaatgagcctagtctgcacctccatgaaccgccataataattcacgattcatgcctgctgctccacaagagagtctgtactcatctctagccaactgtaggtcatagaaccccaacttaagggcatctctgaacatgaaggcattgtagctcttctcagtttctatcaccgcaatgtttatctcgttggcaaacacatggtcagcataggtagagggaggcccagctctcagagaagattcagcggctataacctcttccatccatgcaatttcttttgtaagcctcaaaatagcagcatttgctgtttcaaagacaaagtttgcatcatccataccatcaccggcatcagcaagggcaaatctagtggcatcagaagagaattcttcaatggcctgtcgaagagttcggaaattccctgtggacttggacatcttctcagaattaagcataagatgtccattgcagcggaaaccacgaggccaatgatgctctggaagaagtgctgtatgattgtaaatgctgaaagtcagatggttttggataagatccttaccagagacacgaatatcaaatggataccagtactcaaattccagcttcattttgctcaagagggcaggagggatgtcactattgggtgctggaccatcacagaacacataatcccagacttcatctgtcatttgttctggtctgatagaagatatttccttgccatacatgttgccattttgcaaaaggtgagcgattgtgtaatatgccatgtagagggtggaatcagaaagagattctacaaggaactgctcatcccatggaatgcgagtacctaggccaaaagaacgagagcaggcccactggttcagccagcctaacgtgtgttcaaaaccattacgagtttcagctgagaatgtattcatcttctccaagcattgaactgccttctgcttccattcagtctcaccataagtaatgtaccattgatctgtgagagcaacaacacactcatcaccagatctcgacataactttcttctcaggctcgctatacaacactgctgtgccttcttccaaaagcttgttctttatcagtggcttcgcttcttgaacttttctgccattgaactcccctacaatcattgtcccatcagtaaaacctttcagatatgtcatcctttttgcttcagcaagcttctccttgtcattctgactcttaatcttaagatcgaggcacaccttctcagcagacttgtctccaaattcaggaatgttgattattggtacaaccttaaagggaagaacccattcatctttgacaccatacttctgtctcaaagctggctttgcgactaaatcctgtagtgccatgaaatcatctggagaatcacttgggacactagtcacaatgccagtacctttatctgttaagatagtaagcatgggaagtgcatatatgatctcattgaaggcaagaggggatttcagtggtaaaccaatcagatcacaaccagataactccattaagcaagttggtttttctgggacccttgatagattctgatatgcaagattaagagcagcccttgatgtaacaatgaagacatcagtgtcattgatctcaaaggccccatattttccatcaggcaatacccaacagtttgtctgcccatacattgtctcaggtctcaatgtggctgctgccaaataaacatttcttccttccatggtcttcaacttgggaggaaaaggtggaacaacttccattttaattaacacatattcttgtggctgtacaccttcaccagatgctcgatcatggtcagcacaaggttgaccatccaatggagagtagattgtgtacctcatatctttgacaaccttgcccattttcttcagctttctcatttgccaccggacaaatgcatcatagaaggggttcatgtcagtagttatgaatgacctcctccaatcacagcccagaccaaaggccttgaggtcctccttcgccaatggagggaagtaagttaaccagtggtaaggatcctgaaatttggcgatttcttcatctgataagccaaagcctctcatgatctcccactgaaacttctgcatgccaaccttcgaagcagccttagatttcttgctcttaaatttatctgggacaacagaagccgcattgtcagcctggctactatcagcaacttctgcacttgaatcatcctctacttcaggaaacgctggaggatatccatattgttgcgcctccctagagagtttatctgctgaggccttgatgggcattcccgtacagtggaaagcaaatggcaaaagaacatttgaaccacgaagcctctgatatgcagcaccaaactcaagtttagacaaggagaacgcatggcccaaatgtagcaagccattcatgtaaggatatggaaagttgccaaagaacttttccccagggcccggaggtttattcccaggttcagcctcaaaaaccttgctctcctcccaccatttttgagcatctgactggatcttgagtaaaatatctctccgagcaaaacttctgcctccatcaggatttgatgacattttcctaatcaatcaacaaaaaacaagtggttaaggctttttgtttaataaaattgaactcagtccagtacttaaacaatgtttctacacaaacaagaataactaaccaactcatcaagcacacataaaaaaataagtttttaatgaaccattgttatgcaataagatttgattgaagtcttgtgctaaacatacctacaactcatgacagggcaagtcattgatatgaagctattatgtgatctaggataacaggatcataaatttataaccaaacaaacatcttcaagaagcgaaggggggggagaaagatcagaaagaattagttaatttacacacttaatagcttgaagagaagaaaattcacactaactcaagtgttccataaacctaaagactaggtggatcatgcatcctatggatactacagcatatccacaattccacataataccaaggcagacaaatgatggaaagaagaaatccacctccaggaaataaagtgtgaaaaatacacttcctaccaacggctcaccataacaaaaggaaaattttaggggggttttttccctagaaatgctcatgtaaaactacacgaggaagtagatccccaacaatataacgcaacccagtgacataagcagagaatcaacatacactaaacttccactcttgatcagctacgacgattaactaaaaatcttatcggaaaaacgacgaaccacattgagtaatgagcactctgcccaaagccacacgaaccaatacggaaaataatcaatccaccccctatcaactaaaacggcatgataaaaactaaaatccccaacactgatgtgctaacccacccacccatccagacccctccccgacccgtctacacaaggagcagagcacaaaccgcacagcaaattgcatagcatcaacgagaaaacaaatttccgagcagcagctctgcaaagggggaggcgcgggggatgggatcgatcggccggtcggtacctgacgacggcggcggcggcggcggcggcgcgcaggcgggggagcagcagccgcagcctcagcccggagagcaagttgggagccagcagcagcaggaggaagaggagaaggcggcggcggcggattctttctgcaggggattaaagccgattagggcatatgcttgggaacgacgtgggctttgacggctttgtgaaactaatgggccgagcttcaagtgaagcctctaatgggccatgctcatagagggcctgtctgcgttcgttctcctaagttgggatagcattccctccgcacgaaaaatagagcgacctattttcttataattaattaaacatttatttttaaaaaaattattaatatgattttttaaaaaaacatctttcaatatataaacttttttttacaaaaaaactgtaccgtttagcagtttggaaagcgttgcgcggaaaacgagacggaggacttgggaacagctagaacgagcacagccttaagtatgtactccctccgtcccaaaataaatgcagttttgcactattcatgttcaacgtttgatcgttcgtcttatttaaaaattttgtatgattagtattttttattgctattagatgttaaaacataaatagtactttatgtgtgactaaatatttttaaatttttcacaaagttttcaaataagatgtacgatcaaacgttgggcacagatattatccagtcaagtccatcggaaattcgatgtcttaggtacggccaactccatttttcgtacacatgttttccaaactaacggtggtttctttaaaatagatatgaggaaagttgttttaaaaactatacagcatttaattatttttttaaaataaataaatacttaattaattatgtgctaatttattgttttgttttgtgtgccggaaagatcctattccaaagtcggatgagtaaggatcattggtctcgtaggtggtagctgatcgcgttgtaaggtgaatgactctggatcgaggctgaatctttgcatgaggagaatgattacaacagactcaatccgaactgttcatcttttttttatgacatcatgaatccatggtgctaatcctcacacttagggaggtacattgcaatttgcaatgctcattctgtgcctcccatttctacaacgatcttgcccgtggcatggccttccatgctcttagcccaagcctcctgtgctctgctcagagggtacttggaatctatggtggtcttgagcttcccttgcttggccatgtcgaccagccactccatctcctccttcttgggcatcaggatcagcggcacgagcctcttcttggagaaggtcaccctgtgcaggaacgacctgacggtggcggcgacccccggcgtgaggtcgaccacgacgccgccggcgtcggccagggcgtccctgaacaccggccacggcgccggcggcgcgcagtgcgccaccgcgtcgtacctcctgcccgacgggctccgcagcgcggcgccgtcgggggtcctgtagtcgagcgcctcgtcggcgccgaggccgtcgcggacgaaggcgaggttgcgggcgccgcaggtggccgtgacgtggaggccggcgagcttggcgagctgaacggcgtagtggcccacgccgcccgacgccgcggtgaccagcacgttcttggggccgccggcggcggcggcggcgtcggcgtccgcgtcgaacctgactccggccgccttcagctgctggagcgcggagcccgcggccgccggcaaggtggcgccatcggccgcggacacctcgggcggcctcgccaccgtgagcgacgccggcgccaccgcgtactcggcgagcccgccgcagttctgccacggcgagacagatcgtcaaggcgtgcgaatcgagacgaaatggcttacaacgctgaagaagataatatatagggtggaaactacgtattaaacttgcaaattaccgttaaatcaaaaaataggtgtatttgtccatgtcatcacgagtaaaaattttactcgcgggttcccaggttcacccatactcatggtaacatgaacgaatatcagacattaatttttcaatccaacgatagtttccactgtatttgtagtatggactaaatatttttccctgaagaagatgctcaccgggaagctcatggaaacgaccttgtctcccggcttgaagccgctcacgccgccgccgagctccaccacctcgccggatagatcaccaactgttcgaccatggcaagagttcatggattagtctgaactttaaaagtggcatctgttaacagttgctcagtaatcagtatgcatctcgttcaacattttcaatagcttcttctacaaaatcaatgagtagttagagtacttgatggtgatttacaggagtaaatatcaatgccattttgttcttgaggaaatactccatccgtttcttaataattgacattttttactttctcgttgaccattaactacctttaaattattagaccaaagtgaacataagttactacacgctacttcgagtatcttagccaactactactgccgcgttgttgagcatccgaccatttcccaatcacgccgttttcgtgatgtaatgaactccgaaaagcaatcaaagggaaggaaaaggacgaaaatgtacatgaaaatgaagtgaaaggtagccgaatacgaaagggaagcgaggaagaataatgtcctcatttgcacgtacagatagcgatcgcattcttcttcttcttttttttgcagtcttaaacatacttgtatggacaaatcttcagatttattaaaaagaaataaatgtatcttacgattttctcatggaaaaaaagcattaggcgtcacccatctttagccaactgaagtactgaattagcaactctttcatactgttatacggaagaaaaggttgtggcttgatttcttgtgtagctgaacatgtatcagtcaaaaaaattcagaagaagagcatagattgttgacacctgacaggagtacttacatatcaaaattgccaggcaaaactgaaattcagttactactccctccgttttacaatgtaagtcattctagcatt

SEQ ID NO: 55676 - DNA, 1711 bp, Oryza sativa
agaagtaattaagatgcagtacggtgagatacgcgactttcagccgtcaatttgttcaggtttgtatctgaatttctgaagccaatgtcctgcgactgggagaagacagatactggtactagtactatatctaacctggaatgaaggggaatttcttgggcaggaagaggcggagcatccccttctgaatcttccagtcgatggggttgatgctcgccgcctccatcttgatcagcaactccccttccttcggcgccgggatcggcacttccacatgctgaaaatttgaaaatccaccagcagcaatctcatcagaattcagaaacaaacacgcagcatatgttcagttcttgtgaactgtaattatcagttggtgatgctggttttttttaccttgaggccttctggtcctccgccgtacttatcgtactgcacagctctcatcgtctttggagcagcgtcggcagcggcagccatggctgagacggagagcacgcaacaccgagagagagagagagagagagaggagatggaaaagctggtgattttggtggtttgtgtggcgatgttgatgttgatatggttggtgtcgtggatggaagtgagccgcttctgtagcatagcaccggcaaatatcagcctcgcgacaacgaacccgcgctgtaaagtttgcctggttgattaccaatatattcctttcgttaaaaaaatactaacctggagtatataagataagatataacctagtataataaatctggatataaacatgatcaaattaaagttagtattttttggaacgagggaatatgcatctcgattgttcaccaccgtgggtgtccatttcgggttgctctgaaagcatgatagtatatggttccgagatgcatggattgtttgttatttgttcatgtcagactaaaaaatatataaataaagctgaatctgaaatcttgagtgcagcaggagattgttgcggatcaatgcatcgatggagttctaaaaacagaacaaaaaaacaccaataacaccaatggacctccggcagttgtcagagcatcaccaacagtctatctattctatctccaatcctatttttttgggattttggttttaaaaaactgatccaacatattcccaaaagagctctggacgttttggagttaccatctccaattttctcggtacgtgtatttgagggcgagagaacgactcccaatcccctccttccacgcatttctcccctccttccgtgtttctcctctccttcccgcgtcggggcgatctccttcggcgcacgggaaaggaaaaaaattagaatttctgttggtagtttaatagaagggcccacttttagttttggggattgaatttaggctatctcttggaggaatgggttttttaaccacctattttcagtttaggaaacccaaaaattaaattttggggatagattattggtagactgttggtgatgctctaaagttcgctatcaccaaaatacttcctccttccctaaatgtttgacgccgttgacttttttaaacatgtttgaccgtttgtcttattcaaaaaatttaagcaattattaattcttttcctatcatttgattcattgttaaatgtactactattactcaagtttttgaataatattcacaaaaatttttgaatgagacgaacggtcaaacatgtttaaaaaaatcaatgg

SEQ ID NO: 55677 - DNA, 1695 bp, Oryza sativa
ggtcaaacatgtttaaaaaaatcaatggcgtcaaacatttagggaatgagggagtaaatgaacaagccacttttcaagtgtcattttaaaatatataatttcctgatagtagggtcgcatggtcacaggtatgcgttcccaaggagtacggtggactcggtgtccctgacttagagaggatgggaattgctctaagggcgcgttggacctggttgcagcgagtttcaccagagaaaccttggctgggtctcaacatcccgtcctcgccgaaggagcgaagcttcgtcgccgcctccattttgtgctctgtggggaacggcgtgaaggccttgttctgggaggatagttggctgcagggagaatccatccgctgcaaggcgccggctctctatgctattatcccggctcgcattcgcaaaataagaatggtcacataagctctgtctgataggcggtggatcaaggacatctccggtgcccttggtattcaagccattcttgagtatttatcctagtggcaagacattcgtgcagtgcacctcatggaccagcccgatgtgctttcttggagatgggagggtcgggcgattactcttcccgatcggcttatcaagcgttgttcctagggagaacctggttccagtctgccccgatctggaaatctctcactccacctcgatgccggtacttcgtctggttagtggtgcttaacaagtgctggacgggtgatcgattgaggaggcgcgggctgccacaccccgatcgatgtgtcctctgcgatcaatgcgatgaaatcatcgattatctcctggtcgcttgcccagagtcccgccaactgtggtggatggcactgagggccattggacaaacaagttctctgccgatgaacgaagtctccttccacctctggctttgcgatagccgaaagagattgaccaaggcagctcggcatggtttcgacaccatcgcaactctcattgcctggacgatctggaaagagaggaataacagggttttcaatcagcagcaaaagacttgggcggaagtggcaagggcaatggccgccgaggcggaactctagagacttgcgcgagcagccattccggagttcttgccacagccaattgtcgagaggtcgcaacatcggttaggagaatagatctttttgggcaattgtattcctgcatcccgtccccttcacttcttgtattttctgtaattaaacttttttccatccttaatacaaagatgcgctctttgcgtattccattttttaatttcctgataaacttgtgaaacaaaggtgttctacaataaatcgtgggcaacagtgatcacatgattgaaacattaggttcaatctttcggaggtactcgtaaagatagagtgtgcgtgtgtgtttataggagtgagtgcacgcgtgtcatgaacgtttacgtttgtaccgtgtttctttaaaaaacattattttcatacaataacagttaaccgtgcgctgccactgaacatactgttccaacatccaacggtatctccctgcgtcgtgctcattcttcttctccgattttgacgacgaccttgccggtggcgtcgctcagcgggtggcacgagtcgacggcgggcttgagcttcccctgcctcgccatggccaccaggagctccatgtccgccttgctcggcgagaacatgaacgg

SEQ ID NO: 55678 - DNA, 21361 bp, Oryza sativa
ccgccactctgctcggataaatcacactcaaaaactgaactcaactcgatcgatcaaaagaagagaaaaaaaagagaaagaaatcaaacttctatcgtaccgggaaattgatggcgatgaccttgtcgccgagctcgaacctgcgcacgccgccgccgaccgccgcgacttttccggcgagatcgcacgctgctcgaccacgtatacacattagcgatcactagctcctgttattcttttagcttgctagctagtgcatcctactatataaaaaaaaaacaaatcctagctacgaatatagacacgcatatgtccaaattcatagctgttcttgaatcttaaaattttacttgctagctagtgcatactgcatactactatatatattaaaaaaagcgaatcctagctataaatctagacataactgttcttgaatcttgaaatcttaattgctagtacctggaattgatgggaacttccatggcaggaatggccggagcatccccttctgaatcttccagtcgatggggttgatgctcgccgcctccatcttgatcagcacctcgcctttcttcggcgacgggatcggcacctccacatgctgaacacaaacacatcagaaaaccagagaagcagaagctaagctgggagtgggagtgaaactcgcaggcgtatgtaaccttgagcccttcggctccgccgccgtagccgtcgtactggacggcgcgcatcgtcgtcgcggagggaggaggagacggcgtcgtggccatggccgccgacgcgcgcggtgtgtgcgtttggtgcgccaatgtcggcgtctgcgtctggatatgtacgcacgacggcgtccgacccgtggtggtggtggtggacgactggacgtgcaccgtccacgtcggaatctaaatagcatgtgcaccggagagggattgatgaacaatccactcgtttattgtaagttgaccaaaattaataagatgattaatacgaaatatagcgttccacagacagacaggttgaaaattcaacttgtataaattgcgagaatgctcaacgtcgggcgcgcgggggaggggaaaaaaatcggtcgctcccccctccccccatcacgtgcccacctggtcccaccacatatcccgtgtccccacctgtcacttatccatataaaacaaatcacctacatattttggaaaccatctattaaggaaatttggtttgttttttttcataaaaaaatgtttcacctagtgtattcgtactgtttcactatatataaacccaatgttgcagtgaagtgaaatattgcattgcaacaaaaaaacccacatatttttaaaaccccatattaagagaattcgttttattttttttccaccgaaaaatgtttcacctagtgtacttataatattttactatgtatggatcaaatgttgcagtgaactgaaatattctttcgctatttactggaacattgtttttatataagataaaacaacacccgatttaaacgagtgaaacattttcgatctacttagtgaaacaattccgatatatatagcggaacattgtgcaacattttaaaataattcaataataagcttaaaaaaattcgtcggaatatatccatgtgtggtcttgttttgaatatttaattgcaacgaatttaatggtgcaatcggatcatgatttggataagtaatttaagagaaaaatcagtttaaagtagttttgcacgtaaatcgggtgttgacggtagcgcccgatttttctccaaaccgatcgggcgcctgactcgtagactcatcctataaattatgacaaaattaacttaaaatatatgtatattagtacaagttgaatttaaaagttgcatgtttgtgtactaatttattacacactaaggacacataagagaaaacgagttgagggttgaaaactcacaaaaatcaaatctaaagtttaaactcaactttatttgaatagtaacgtgacactatttacctgaattttgtttttttctctcaaatgaagttgagtttggtgagaatttattttacatctacatttatctatattattttaaatgaacttacaaaacatattttttatgaattttcaaaacttttagacatgattttcacatttctaacacttgatatttctccttacacattaacctatcctgtccgttttttttttactatttagttgacatgaataatcgaatagatatctacccagatgattaaaagagttccgtgcacgttgacatacatttttcttgcaatgacttttactgaataatttaccgacggttggagagtttagattgggttcacctcatgtaaaattaggagtaaatttctcgaagatatttacgctgtgttaagatgcattcgtgaaaatttctacagtgtcacattggatatacggacacagtctaataacaaaacaaattacataattcgtcagtaaaccgcgagatgaatttattaaacctagttaatccattgttagcaaatatttaatgtagcacaatattatcaaataatggaacaatcaggcttaaaagattcgtattgtcgcaatttgtgcaattagttttttagcctatatttaatacttcattcaagcgttcgatatgacagggtgaaaaattttagtgtgagatctaaacatggccttaatttatcgtcataattaaatgaatataatccgtagtaataatcggcccaacaatccaaatgaagtaaaaaggagcccttcccaaggaaacaaaagcaatgataatcccctgggccatcctggactcctgatgttcggcgccaacacgatctcctcctcctccctcctcgtcgcaggatttgccaataaatagcaagagagatcgatagattagatcgaagtagaacagcggagaaggagagtaggagcgacggcgaccgcgcggagttgattcgattccgggtgtcgccgccgccggccatggggataacgctcgagatgaaccgggtcatgcccacccggcggaggcggcagcgccgtcgccgccggcgaaaccgacaccgctgtaagctaagctccctcggcctcctcctccggcttatataacttgttcagattgttcttttgcaacaaagcggccatgcccgtgatggtgtttctatccgggctagtatgtttctttgtaggatttctttaaaaaaaaacctgttttcttttcatcagggggttaaacctagtgcattggttggtaacaagattaagtgttcctcattgtttttgtttgagtaggctaggtatccaaactggcgtctttctgaacaaattttaatctacaatttattttctcatgattgggggggggggggattgtatgagatgtactccctcccgtcccataaaaaccgaatctagatgggatgtgatatattctatatgtccagattcatagtaataaaatgtgtcatatccaataggattggttttttatgagacggagatagtttttttttttataacaacatgagatagttgattcgttggtgaaagagtgatgcagcctatcatagcatggggcacttaactgaacatggcaaccagagctgaaacttgtgacttgggtttaccgaattgtgagggtgaggagaggagtggggaatttagggattgggaaagaaggatgtgatttttcactgattcgtctgctccaatgtattgctgttcagttggatactttggagtgcaggagatacacactttggggagactgcggtatttacaaaattttgcgcctgcgcactatgaattgttcttttctcttagattgctacaagttggaaactcaattggcattcaaaagctggataacagaagaaaattttgatttccctgtgcttgtttgtgtgcttcgatttgtccgcttccttctgttattgtttgaattaactataaccatgcatgatgtgcttgcagatagatcaattgctaaattgggtaaaaggaaattctcaccctcccaacaagatgatgattctcagggtgctaaaagaatgaaaaattcagggatgttgctttcaaaggtatgacatagaaaatgaatgatttacatttcaagggaatatcactatgactgctccaacacagattagtacacccgttacgcttgtttcattggtatgccatggtctaggtccactatttgctgtttattcttaccagaatcctctagatgcaagttgttcttagcctattccacatcgagcacattccatcttcattctactaaagaaagaacttttccccccaaaagcaagactcatatactatttacctacgaaggatatttacttgaattcgtcggaaattttcatactaatgtgcatttcattcttatatttcactcatgctacaatttttaggacaccatgccagaaggcctgcctaaattatatttcaacgaattacactgttagagcgaaacaattatatcgaatgcttaatttaggcaccacaattacattctaatgctcaatatgcctatgtcatgcagtgtacttgtgcaatcatgagtgaatacctggggtagagatagaatgataccccatatggttttgttctgctttttcacccaatcaaagtttatcacaatcacaatatccaaactttatcccatgatggtgtgtgcaggacatctggcgccgtatacattgcctgatgccaatgcgagatgcggctcgtgttgcatgtgtgtctcgtgcctttctaaattcctggttatgttatccaaacctcacctttaacaaggatacgctgggattggatgaacatgtttgtgagacagatttcatcagcaaagttgaccacattcttaaaagacactcgggcacttgtgtgaagacattcaagcttgaagtcccgtatgagctagatgtctgtgaccatgttgatcgttggcttcaatttgctattacaccagcgatcgaagaactcactcttacgctgtatggaactgctcaaaagtacaatttcccatgctcacttctatctgatgggatggcagattctattcggattcttgatcttggccattgcgccttctgtcccacaatcgaacctggttcatggagaagccttaaaaggctatgtttgtcttttgtgcgtatcacggaggatgatttagggtgccttcttttgaattcgttggctctcgaggggatggaactcaggcattgcgatgagatagttagcctgaagataccttgcacactgcagcagctcagctatattacggtttcagaatgcagcagggtgcgagttatagagaacaaagctccaaatgtatccagtttttactttactggaaacaaggtaaaactttcacttggagagtggttgcaagtgaagaaactaaatatgcgcagctcacgcattgtccgttatgcccgtgccactcttccatccatgatgccaaatgttgaaactctttccataggttcgctccgtgaggtatacaccaacactttagatgattatatagactagtttgttatccatattatagtactcataccttggagtttggttaatctgagacatctttatgcaggtgttcaacacaccaatgctacctaccaaattcccctacctgaagtacttgagtatttctctcattggattgaccaattcgccagcttatgattatctctctctagtttcctttcttgctgcttctcctttattggagactttcttcttggctgtaagatgctattcacttttcatttcatcctgcaaaactatctactttggtgaaagcactaattcaagtatattattacttttcatcttcagatatctcagcaacaagcagaacaggaatcgatatttggaagttcctcacttatgaggcagattccggagcaccgatatgagtacctcaagagtgtgacgatcaacggtttctgctccgcgaagagcatggttgagctaacatgtcatattcttgagaacgcagcatctcttgagcaccttactctgaacacgaaccttggcttggctaatcgttctgaacagagtcctggtattctcaaggaagtgcctaaagctctctcggctatccagaaatacatcgcagggaaagttccctctactgttagattaagtgttctggatgctagtgaatgaaacgctatagggcatcaattatcattttgtgaaccacgcgtccacgctcattttgtgcaactttttgatgaaccacgctctgtttactaaattattggggtcgttaaaagtttagttggagtatgctttcttggttacaatctttgtaagacttttgtggtgttcttataatatataaaatataactggtgggcgaatgcctgtcagttttcctggtcaaaaaaaaggtgagtgtttagttcttcagtaatttatcagcaacaaagcgggctgctaatagtgggtaactgtgctgtaaagttgtactgtaaaatatagattttgaatgacctggagttcggttggatgtgttgtgactacaatacttgtatgggtaaatttggctaaaatgttaaatgttgctcacttttgtacttccatttgataatgctgtgatctactgattgggtaacacggatgtgcagtaaggatttacaaattgcccattcatgaaaattagatttacataatgccaacaagaagcaacatgaacagtataacagatttaggacaaatgtggtaacttgtaatgtgcatgtatccaacaaaaatactaccacaaggccagaaacacaaatctgattccctgttagttcccccgcgaagctcccagttatacgatgattgagtggatttcacttgttagtcggtgtaagtttagttaaagacgtcacgttagtgtccgtgtgacatgccacatcgaatttcagaccaactaggataaccacataaaaccacaaaccaacaaggatctaaaaatataaccatatgcacaaggaacacaccatgcattttgtttttatatttttttaaatcctgcagggtgtatttgtattaaaggagaaggaaacactgtacaatagccttagtgcctaggaggttgcatcaagaaaggaaaaaaagaaagcgggtgaggcatgatgcagcttaaaaaaaaagagacgtgtgggtcttgtgactaggctaattacgtattgtcggttgcgctttcataattgtttggcattaggcattgaatgccctttgccctgcctgcatgccataaccaaatctcatcggtcactctatcaatgatttcgtgcggcagtgtctctatgtaactatgttccttaaaacctctctatttctctctttccaaatttcccaagagagtaggatgaggctcgatttgatgccctttcttttctccttagccatcgcacgaacggtttaagtccaccagttctcgagtagtgtcgtgtgaggccaattttgcggctgtagccgagggatgtctagccttgtcgatatggctttttttatttataaataaactaacaagtactggcagtatttactaccatgacaaccatgaattttttcttcttacaagagagagagggcttcgtgctatcgacatgttggcaaagagacggggtactttatattgatgtcctaatcgattgcccatattttctattaagataaaacagtttattaccataagaattaatttataggtaaaacttaaaaaatacatgaaaataccttaaaatcaactttaaaattaaaatttaaattttaacctttgttttgatttattaagacagccacatgggaggggactctgagaagataagaggaaaaaccgaaaaagaccagtattttcctggtcgagttgggtttcgtcacgctccgcttccccgacggcgcggcgccaacacgagatctccttctgctccgccccccgcgattcttcgggtgcgcgctctcgattcccttgcctcgatcgtcgcgcggcgccccgccatgggcatgctcctgctgagccggctcatgcccacccggcggccgcgccgtcgccggccacacaaatcccgccgcagtaagcgcttctaattgccctctcagttgttcccctcaaccctgaaactcattagcattataacgcaaaagtttggttaatggagacagatcgattggatttctctatgctcgtttgtgtgcttcgattttttatttttatttttgtttttattttcttctgttaatgcctgaatttatctgtaaccgcgcaggcggattgattgctaaatcggctaaaaggaagcgctcacactgccagcaagatgatgatgattctcagggtggtaaaaggatgagaaattcggtgccaacccttccagaggtatggcatgtaatgttgatataatcgaatagttatactgaaagtaaataccactatcactactctaacacagattggtacacctgctgtgcctaaagaacaaaagttatgaacagatgagcaaaactttcagtgctatatttacattatcaattatagtcttactgcattagtagctttgttttcttctagatatcgtggctttcgctctcgagctgcaatttgagtccttgataatatggaacaattttggagtaaacttcctagatctatctccctaattagcagtagctagagcatatcccttatttactcaaattcctcagaacttagagcttttcaaattaatatgtacagagggccttgctaatgtttttcagaaatctacagagggcaaatactacttaactaaattatattccaactaacaacactgtcaataaaagataactctatgcaatgtttcatttgcgtgccattgcattctaatgcatgcatagtacgcatatgtaatttagtgcacattgtgcaatcttgcacatagcacctgggttgaaaaagaatgatgccccatatggttctattttcccctctaatcaaataacccaatccattgaaactctatttttccccctctaatcaaataacccaatccattgaaactcacattgcaatgttgaaattttatcccatgatgcaggacatctggtgtcatatacattccctgatgccaatgcgagatgctgctcgtgttgcatgtgtgtctcgtgcctttcttagttcctggagatgtcatcccaacctcacctttaacgagcgtacactgggattagatgaatatgtttttgaaacagatttcatcagcaaagttgaccacattcttgaaaaacactctggcattggagtgaagacattcaaccttcaagtcccctatgagctagatgtgtgtgatcatgtcgatcattggcttcagtttgctattacaccacggattgaagaactcaatcttatgctgtatggaaccgtgcaagagtacaacttcccatgctcacttctatctgatgggattgcaaattatattcggtttcttgatcttggccattgcgccttccgtcccacagtcgagcttggttcatggagaagccttaaaaggctatgtttgtcttttgtgcatatcaccggggatgagttagggtgtgttctttctaatttgtttgctctggagtggttggaactcatatattgtgataagatagctagcctgaagataccttgcacactgcagcagctcagctaccttaaggtttcagaatgcagcaggatgcgagttatagagagcaaagctccaaaagtatccaatttttacttcactggatacaaggtaaaactttcacttggagaatggttgcgagtgaaggaactatgtatgctcagttcacaccttgtctgttatgcctgtgccaatcttccatccatgatgtcaaatcttgaaactctttctatatgttcactcgatgaggtattacacaccaacagtttagatgattatatagactattgttatgcatattatagtattcatgcattggactttgattaatccgatacatctttatgcaggtggtcaacacaccaatgctaactaccaaattcctctacctgaagtacttgagtatttctctctctggattgactgtttcgccgtcttatgattatttttctctggtttcctttcttgatgcttctcctttcttggagactttcttcttggctgtaagattccgttcactgttcatttcatcctgtaaaactatctagtgactatggcaaaagcatcaattgatgtatattatttttctcatctctagatatctaaggaacaaatgaagcgtgaatcgaaattcagagattcctcacatatgaggcagattcaagaacaccgtcatgagcacctcaaaagcgtgacgattattggtttctgctccgcgaagagcttggttgagctaacatgtcatatcctcgagaacgcagtatcacttgagtgccttacactgaacacaacccttggctttgctagccgttctgaacacagtcctggtacatgctttccaatgggcaaggctgttctcatgggagtacctaaggctctctcagctatccagacatacattgtggggaaagttccctccacagttagattaaatgttatggaaccatgcaacctgtgcaatggtattgggcattaggtgttatccgaattgtccattgtgtaactcttctgatgaaccattctctgtttcctaaattatcagactcgttaaatgctaaattgtgtagttatcaacacgagtggtttgttctccagtaatttttcagtaacagagtggtctgctaatagggtgtattgctaaactgctaaagtgtgcgctgtaagttgttagtaaaaatatagagttatcctgaaggttggatgtgttgtgttgtgcctacaaaattagtatgggtaaatttggctgaatttttttcgtgaatacgcaaggagtgcatttttgtattaaggagtaaaaagtctatacaacagaacctaagagcagcaggggacaggagaactggacacgggggaactaaagcctaatctcaggggacaggagaactggacacgggggaactaaagcctaatctcagggtgcgacctaagagctcctagctactagaggcgaatcgtcggtacagcagcgttggctaaccgccacaacgccgcctcattagccattcctctggccacctgcacccaacttctttgttgctggttgaagactcggttgttttgttctttccaaatagaccatgtcgcaagtgctacgatggtgtcaaagccacgccgaaggggttttgcaatctgctccctgctgtcgcacaaccaaacgtggaaagagtcttcattaatgggcaagcattcaggatgccctatggctgagagaagcatccacaagagttggcacgattcggggcaaccgaccaagatatgatcaatactttcctcttgttgatcgcagagaacgcaaaggtttggatgaggaaaacctttgggtcacagtctatcaaccgtccagcaacgcttgaggcgaccaaccagaggaaatattgacaacgcaagcgacctccagattagcaccgactgaaataggatccgaccgagaaacagggcttgataggctgaactagaggagtaaacaccggagctctcccacttccgaacgaaacgatctggccgatcctcaagctggaacgactgcaccctcgaccaaagaaggaggtagtctaggatggggagtcctactcggcgcgtgtgcgccaagggcgcacacgacccccctccttttccacgctaaggcagttagtaatctattagtataattacatttagagataaatgacggtagtagttagaattttttttgtgagatttttttcaattaacaaattcaaaatgaaatttatatctaaagtcaaattttcaaaattttaaacccatatttgaaaactttcaactcgaaatttgaattttttaagtcaaattatgaaaactttcaacttttcatgttaaatctgaaaaactttcaactcaactttgaaaacttttaacccagatttgaaaactttcaactcgagatttgaaaactttcaacccagatttaaaaacttttaactcgagatttgaaaactttcaactcagattttgaaaactttcaacctagatttgaaaactttcaactcgagatttaaaaactttcaactcaaaatttaaatttgagagaaaaattttggaaactttcaactcagattcgaaaactttcaactcgagatttgaaattttcaaatccagatttgaaaattttcaagtcaagatttaaaaactttcaaatcaataacatttgaaaaaacacgtgtgctaaagatttaaaaaagtaatctgaaaaaaactgcaaaaaaggaaaaaaaacgcgaaaaagaaaacggaaaaaccggcatgaaggaggggaaaagaaaaaaggtgaaaaaaagggaaaaaccggcgtgtggggaggtgacagctggcgcgtgcgcgaattagcaaatccggtctaggatagcctgtgtcctcagggcaccctggatatcatggatccatcttctgttgagcagaccttccaccaccattctgcggcaccagacgcgcactggaacacagtcatacaaagccaacgcaagcgagcgaatgcacgagccatccagccagcgatcttcccaaaaccaaatcaaatccccattgcccacctgacaggaaatcgaggctgcaacaaagataagttccttctgtcaactcgggatggacagaccttgccaaggtttatcctcagcagtgcgctgcgaccagatcccacgagagcgaagagccactcccatgagttccaagttagcacacccaggctgccataatcagttggggagcaaaccttggcccaggtgaccctgcaatgtccacctcgaggggaggccctgcccccccaaaggaagccatgtcaaaatttgtcgatccctttgatcacccattttggaggatcaatggtgatgagaaagtagatgtgaattgagctcagtaccgatttaaccatggtaatgtgcccaatcggtgccatctgttcagcctttcaaagaggtaagcggttggccactttgtcgacaaggggttggagatctttcctttcttagctcgaagatggatagaggcagccccaaatatttgcacgggaacaaagcaacaggacaaggaagttccctcaccaccgaactgagaatttcctcggagcattgaatcggcagagcagtgcatttggcaaaggttgcctttaggctagaggcttccccgaaggtgttcaagatctcgccttgatctcttccactgaaggttggataaaagcgaccacatttggctgaaatgttagatgttgctaccgatgtgggtcttgctccgttgcattttttgtacttactacatctgataatgctgcaatcttctcattgggtggtacaatgaagattgctaaaaagaccctccatttttggctgcaatctatttgcaactgctgcctttactatttcaatatgactgactaataattgatcgaaatctatcaggactgtcaatgcattactgatcactgataatatatatgtggtccttcaacctcggggtttagagggccttgggaggcgaggcggcggggacgctaccggagccgtgggaatggaagctcagcgatggcgaatatgacggcagaagagagagggggagacgtatctcacctacgccattgacggcttttttttagccgggccaaaggttggacccaaggaaggacttggagtcaatggttttaagaaggaagaggtaaatatttcccctggtgagcgcgctcgacaagggtcgaacccgggccagcggggtgcatgccagcgacccctgccactgcgctactagcgcatctcgttgacggctttcggccggccaccgaggccgagcgtggtgcagggcggcgccggcgagcattcgtgcggttgtgcgtggggaggtgtaatggcaatctcgaggccatactggccgtctaaaaaattgacttgagttttttttttctgccacgagaattagacccttcgaacaatgataaataattcaacgaaaacaggttaagatgttaccattctttaaactgcagttacgagtcgatgttatgctatcattcaacgaaaacaagtttgtatttgatatactcctttttttcattagctaaacgagcaaatcttacagaagtactgcaaggaaatgaatacagtaaaatccagtgatgtgatgttgcaacaatatattaccatcaatttctatcgcaagtggagtttaattaggcagctagctaacatctcaggtattaaccaaagatttatttgtggacgaagacactaacttatgaaaaaaaaaacacaaactggaactacaatactcccaaatgccaatcagaactaacattagagtcatcagaacttgtcctactctagcttcagtcacaaccttgagatcttcttcaaataaatacgatgtgcgaagaacatagcacttcaaaacctcaccaaggaaaaaaaaacatagcacttcaaaaagggaatttagtagattcttgtccagacaatttttttttatgaaattgtcaaaccaacttcatttcaagatttacaaactgccggcagcaagcaatggagaacagtataatagatttgggacaaatgtggacatgtggtaatttgtaatgtgcatgcatccaacaaaaatactgccaaaggttagaagcataactgagtccctgcacagatcaccagcaaacgccccaatttacttttgcaacttcacaatgaaaacaaattttgagccacttactcatagcaaagggcattgatctgcaattaaaggatgatgagcctaaaccatggaaacagctagatcaacaaacatattcttaaaccacacaattgcccttaaatgttacagtaatacagctacagacactgctgcgttaattaactttcaacaggattcacattttgataaataaaaccaactgctacaagtaaagtttctgggttaattagcagttattcataagggtaggaatggacacacttccatcaaaatcattaaccgagtatgacaacttttggatgcaagcagagtgctaactgctaagaagttgtaatcagggcgtgatgttttcataggagaaaacatatcctccattgctggagtacaaaactggattaccttccaaacttttcccataagacataacaaaaacccatgaacccttcccaacagatcattatttaacgaaccccagcagattagtatttagcatgacaagaaaatggaattcagtagctgcgaatggggcacacaagaacaagctggtccaatggcgtattcactgatcctaattaagaggcacaacctgggggtcaaagctactacaacaatgcactaccactaacaaccatatatgctccaatgcatctacacctttcagtcagtattggtcacaagtgagacaatgcttatcacaattaccaattttcagtatagtatggaactatcaatcagaagttgacaagcttatgtgatctccccatagcaataggatacaatgtagtgaatcatatgaagccaatgctgattattgcttgtgcaactaaaaatgcagaaaaaaaaaggtaaaagctatctactgctgttcgattagacatctgtacgattccacgggggcggcaattgcagtgttattgttcaacatcaggtcaggggcgatggggatcagggtgacgtactcaatcctcgtcgatgaggcgatcaccggccgcggcgtgatctcgcgaggtgatcaggcgggggcgcgcgcgcgaggtcgatgcggtgagtcctcatggtggcgatgcgggagggaacggtggcctgcaggtttttgaggagccaaccatcgccgcgggttcccttgaagacatggctgacatgtcgccggagaaccagcgctagcgccttcgacttgcggcgcgcgtagcctccgatgaggcggccgacgcggtggatgctctgggcgcagcggcgaagctcccggttggcgtctgggtcgcggaggtcgttgaggaggagcgggatgacaccctcgctcacgacggcgaggagggcgtcgagcttggacaggttctccacgaggcggaggccgacgatcttacacccatggtcggacgacgcggactcgagaaggtggaggagcgcgggcgcgtgcttgagctcgcgaacggcgagcaccttcaccgcgtgcgggtgcggctcgacattgctgaagaagacgggctcgaagtccgcgaaggtggagaccgcgacggagaggacggaggcagaggtggtcggcatgggggagcgtcatccggagtctggatcttcgtcgcgacgctgggggcgcgcgcgggcgcgaccgcgagcgaggcggcggcgctcatctccatcgcgactgcggcgacagaggaggtcttcgtggcgatgctggaggcgtgcgcaggcgcgtcggcgacggaggaggaggaggcgcgcgcgggcgagacgacggcgcgcgaggtctcggcctccccgagagaggcggcgccgctcttcttcttcatcgcgtcgaggtgtgggaatggcggagaggacgcggtggtgagacgcgacgcgagtggatgacgtggctatgggtgggcgttgcgagccggcattttatagccggtagggagccgtgctggagaagaaattctggaaaggagaaatcaaaatttgaatttcgcaaggggatcacgagaatattgagcagttggcccaagtgagcggttacagctaggcctcagcccaaccgtgctgggcaagaatgtctccagtggcccattttggggcaaaaaattgagtaaattgcgttctgggccacattttattatctaagtttcactttggccacctttaaaccttctatctttacaatttaaaataggtaaatttgcagtttggatcacccccaaacgattttttcagtacacatcaatgaccttaaacacatcggctctggtatacgggttaactcatccatgcatggtcgatatatttgccaaaaagaaagttagatatggcgagaaaagatgttcagggtaatccaaaccataacaatgctaaatttacccgatccatattgaaaagataggtttaaaggtggtccaaagtaaaatttgggtaataaaagatggtcaaagtgtaatttactcaaaattaagcgtgggcttctatagggggctcgtgggccgggccttggctatttgcaacctctgcggtctgtacgagttcggtatcttccttctcgtctcgcctctccagccgcgacggcgccggcctccgccgcgccgcattcttcctcctccggcggcggcgcagaccgaagccgagatcgcgcgcgggtggatgccctggatctctaccccctccccgacctcgcgcctcgatcttcgtaggtaggagaggggcagggaggagagaggtgggccgcctcggggtgctctcgatttcctcggctcgatcccgcgtatgccgccatggccctgctcgcgctgaaccggctcatctccatccggcgggagcgccgtcgccggcgaaacaaagcccgcagtaagcgctttcccctcggcctctctgcacttcatctctccggtgcgttgtgtgtgatgtgctgctcggactttttttgggagattgcggccagtatttttccagaatggaaaattggattggtttggtgaattgtttctctaaaattggaagaatttggtttggtgaattcatcagcattctcgcgcaaaagttggataaggaaacattttggatttctatatgactcgtttgtgaggttgaatctgttgttctcttctgttaatgtctgaaattatctattacaatgcatgatatgcagaaggaggatcaattactaaatcggtgagaaggaagtactcaccctgccaacaagatgattcccagggtggtaaaatgatgacaaattcaggggtaactcttccagaggtactgcactgcatacactgttttttttaaaaaaaaaaatctatgaattaattggaacatttcaaaatactactatgcattccattcttaagtatgtgcccttgctagtgtccttttaagactctaaagaggaccagagacctacctaaactatattaaactaccaacactgttaaaggaaaacagctctacgcaatgcttaatttatgcgccattctaatgcacaacatgcctatctaatgcaacgcaccttgagaaatcatgtgcagtactcctggggttgaaaaaaaatgatacgccatatggttctattcatgtttctctctaatcaaagtagccatttaggtttataattgcaatgttgaaatgttatcccatgatggtgtctgcaggacatctggagttatatactttccctgatgccaatgcgagatgctgcccgtgctgcatgtttgtttcgtgccttcctacgatcctggagatgtcatcccaacctcacctttaacgaagatgcactaggattgaatgataatgcttgtgaaacagatttcaccagcaaagttgaccacatccttaaaaaccactcgggcattggtgtgaagagattcaagctttcaatccactgcaagttagataactgtgattatgtcgatagttggcttcagtttgccattacaccagggattgaagaaatcacagttatgctgtctggaaacaagccacagttcaacttcccatgctcacttttctctgacaagattgcatactcaattcggtgtcttgagcttggcaattgtgcctttcatcccacaattgaacttggcccattaagaaacctcaaaaggctgcatctgtcttgtgttcgtatttcaggggatgagttagcatgcctcctttccaactcgtttgttttggagcagttggaactcaagtactgcaaaaagatagtcagccttaagatgccttgtgtgctgcagcggcttaactgcctgaacgttttggaatgcaagagggttcaggtgatagagagcaaagcccctaacctctccagtttttcctttagtggaaacaaggtaaaactctcacttgtggaatcatcgcaagtgaagaatctatacatgtgcagttcaaacatcatatgttatgctcgttcagatcttccatccattgtgccaaatgttgaaactcttgccgtagcttcacactgcgaggtataaactaaactttcattattatagactatgcaaaatgtacagtatatacattggttatacctttgagtgactattctgagatatctttatgcagatggtcgacacaccaatgctaccaaccaaacttctgtacctcaagcatctgactatttctctttttgcatggaccttttctcgagcctatgactatttttctctggtttcattttttgatgcttctcctttgttggaggtattcgtcttggatgtaaggctctgtgcaacgttcccttcatccacaaaaatatatgttaccacggtagaagtactgattcaagtatatgtcttttttcatcttcagatatatcaggaaagcatggagcatgaatcaatctttgagagttcctcacatctaagacagatgccagaatatcaccatgaacacctcaagtccgtgacgatcagcggcttctgctccgcgaagagcttggtcgagctaacatgccatattgttgagaacacaacgtcacttgagcgccttgaattggacaccactcatggcaatgctaggtgttctgaagacagttctgatgaatgctttcctgtgagccaggtgtttctcacagaatcccctagagcagtcttggctatcagaggatacatcgaggggaaaattcccaccaatgtgaagttaaatgtgttggaaccatgcagccggtgccatgctggtggtggttaggtattatctaatcctaattactagccattgtgtaactttttgatgaaccataaccatttgttttctaagttatcacagtagttattaaatgtttgactctctgtagtcagtagcacaaaccaagtttatctaaggccctgtttagatcacctgacagaacttttcaccctttcacatcgaatatttggatacatatatggaatattaaatataaacgaaaaaataactaattacacagatcgcgtataaattgcgagacatcttttaagcctaattgccccatgatttgacaatgtggtgctacagtaaacatttgctaatgacggattaattaggcttaataaattcgtcttacagttacaggcggaatctgtaatttgttttattattagtctacgtttaatatttcaaatgtgtgtccgtatatccgatataacacgccaaaactttacaccaatagatctaaacacgccctaagtgctagtcagtagtgatcaccatagaccaagtacgagtatttgaatgacattggttgcatcggttgataagccatagaaaaataaacaagacaatggtgaacaataattagggtggggtctttatattttattcttagctgtttaaaagccaaaggttaaagaaaacaaataataccaaatttagtttgaaaacttaaattttgatgattgtggcttataagctaacaaacaaacaaacgatgagagtcaataaaagactcaagcagtacatctatacatgcacagttgcacgctacaaaatcgtatcttattctggtcttccaggccacaaatccgtcgagctcacactcactgttcgtctcccatctcgacgatgatcttgccggtggcgtgccccgccatgctcctggcccagccctcctccgccctgctcagcgggtggcctgggggatcaccgccctgagcttcccttccgccaccatgccggcgacgagctccatgtcctccttcgtcggcgacacgaacagcggcaccagcctcttcctggagaaggtcaccctctgccgcagcgccgtggcgaaggccgcggcgcccggcgtgaggtcgacgaccacgccggcgtcggcgagcaccggcgcgaacgcggaccacgggagccccgccaccgccgcgcagtgcaccacggcgtcgtacctccgccccgaggggctccgcagcgccgcgccctccggggtggcgtagtcgagcaccttgtcggcgccgaggccgccgacgaggccggcgttgcgcgcgccgcaagtcgccgtgacgcggtgcccggcggcgcttgtcagctgcaccgcgaagtggccgacgccgccggacgccgcggtgaccagcacg

SEQ ID NO: 55679 - DNA, 12372 bp, Oryza sativa
  unsure (1)..(12372): unsure at all n locations
aaactgttcgaccatccatgaatgcatcagtgattaatcaacaattgaccatttcaattagcagttggtgtgctatgccaatgccatgcatgttttgatcttggattactactacctgggatgaaggggaacttgttgggcatgaacgggcgagcgacacctttctggaacttccagtcgacctggttgatgctgccggcctccatcttgatcagcacctcgcctttcttcggcgtcgggatcggtacctccacatgctgaagcagtagcacccacggtacaaaccaacacaatcagacataatcacatatgcttgatgcattgcttaatagctaaccatggacgttaattgaacgaatcattgtataccttgagtgcttgagctccaccgccgtacttgtcgtactgcacggcgcgcatcctccgagaagaagtggccatggcccttgcccagaggtgaaaccggttacagaaattcctaaccgactgagcctcgttttcgtacgaggggtaccgttctgcgactgagaagagggaatcgggggcaatttgcgacagtagctgccaggcgcggccgtacttatggcagcggcggatcgaactagtctaccatcgagagatagatggagagaggccatgggatcggatcgcattggcagtagcctttgtttgaccggcggcttggctcctcgccgaggcgaggcggcggcggacgtggccgcgctccgcaccgcacgccggtacactgcagtagtaaactagtagtagtactttactgcggcttaggcattgacgacaattcagtcgggccagtgtgtagacaactcaacatgaaaatttcaaaataggagaaagtccacgtaacccaacgacgggtcaagtttcgttcgttggcgtccctgaaccgtagaatcaggtaaaaattacgtttcaacaattcaacttctaaaaaggatacaaattaagtcactcgatactattaacagcggtttcggctagcacgacatctacatggcttgctgacttgattttaattccatgtgacgtttatgtgcacttacataacaatagaagcaaaaaaaatatcaatggaatccacatggtgcctcctcactctctcgcctcttatctcccttcacccatctcccctcccgtctttctccggaaatgcttcctattagacgtctgacgcaacaaacaaaaattagacgggcaaactactacctccctatccactccatacatccatacatattataatgatcttcaaaataattttttcttatgatttacttatccaatctgtgatatgatcacaccattatatttgttataattaaatctttataacaagatatcacatcattacattccaatgaaagaaaaatgtatgtttcagtccgttaagtttaatgtttcagacgcagtagcaatatgtttcaacgtgagttttcattgtgtttcatagaaaagttaaatgtttcaataactgatttttttttgtttcaccacgtataactcaatgcttcgcgctgaaaaaatatgagacacatatgcctccactctctctctcgtaccattttattgactttctccccacaccatacatgcatacaactatttagtaatcttaaaaagaatcttccaaactacttatttgatgagcgattcgatcacaccgttgaattcgttataattaaatctttataacaagatatcacgtgattatattctgatgaaagaaaaacatgtgtttcaaacaataaaaacgtaatgtttcatacgtgatagaaatatgtttcaccatatgactttattgtgtttcacagaatttttatatgttttagaggctggattttttgtttcaccatgtataacttaatgttgcaccaacggtcaactgaaacatttatccgtccgattttttttacaacatcggacgttcgatttgtagctctctgcatctctctctatctctctctctctcatgtggccaatgacattggaatgcgaaggtggtgcggcggcagcccgatatgctctttccatcggcaggcctcgttgggctcctcatctggctaaaccgcttggatcttccctgggaacctcgataaccctataattgaggaaagcgagaaaagggaacgagatggtgtggatgctgtaggcttggtgggaacgagaaagctcaaaattgctctcgatgccacggagagatttgatttgtactaattttaaaagttcgtggacgttctatagcctgttttatagttgagagatgcgaatgaaactcaagacacgtagttgaggacgtgaagtcgacctttccctctaaaatagtactccatccgtcctagaatatgtaaggtactttgatcgaatgggacacatcctagctgttcagatttgtagtattaagatgagtctcattcggtgaatgtaccttatattttaggatgaaagaagtatgaacgagttaacaacgcaaaatgggctttatttcattcggactttacaccatgggctcattccaaccataaagaaggaccggaaaaagtacattgaaggtccctcaacttgtcatcgagttacaaaatcgtccccaaccgtaaaaccagatatccggcgtcccttaactaatcaaaaccggtcacaattggtcttttggtggttttgacaccagttttgtcttacgtgacagctgagtcagcgtgggacccacatatcagaatgccacgtcatctctgtcctccctgttctcttctctcttgcctgctgagcgcgagcgcgaggctgtactggactgcaggcgagcagaggtgggggaagacgtcggcgccgcgggggaagcaaccgctcctggagcacctcgagggaggaggggagctcgacggcctcgagctcgccggcggggtcggaggagagcggcgcctccgtactccggcggcggcgcggccgccttcgaggagagcggcgcctccgtcgcccccatcgccgttgacctcgcccccatcgtcaagtccctccgcggcctcgacgtcgactgccaggacctcccccgcgccgggctgcggggcgtcgacggggcgatgtggaagaggaggaggacggcgccgcagtttttctcttgcaatcttttctctcagtttgatgtcatacgcagttggctctacatttagggattccttttttgtatgaagtgaaactatctgttccccgtttaccaggttcattccgagtgctctgatcatgaggtttcagttgaaactactaagagccagaagcatcatctcaagaaggtataggtacaatagagatttcgttcctaaaatctgtttgtatactattgttctgcggtttgaatgaagtaaatatgctcagcagtttgttgcagatcaagcataatgatgtgatggagcctggcatgagaattcaccttcctgtgtcagtggcagagggcgagattagagatgagattgagaaggcctgtcatccacaaggtaatcaatttagtgtattttttggagcttactgtttttaatttacatcattcagagtcataattgtatgcaaaattttgaaatttcaggattctgctatacttgtgcttaacaagcccacgaaagtgcccatgaagggaaatttgccagtacataacagcatggatgtgcttgcagcagcagctctgttatatggaaatgaagaaggttcaaaattggtgagctcaagagtctgttcatcataggtcagcatgtataaccataagcttgcactgaagatttttctcgatggattttgtgttttgaccacaggttcatcggcagcgggcgtccctcctcctcgctactgctgagcggggtagagaccggcgcgggggtggtggccggggacctcgccctgcgagtgacccccatcccggcgcacaagatggctccgctccagggcctgcgcggcgaccgtaacggcgaggagggcgacgacggctagaggagagaaaaggaagaaggagacctgaccagtgggcccagcctatttattattattatttttggatgaaactgccacgtaatcgccacgtagtatgaacacctagtcaaaggagccacgtaggcgccaagtcagccaaaaccggtaacaataccaccgagggatctattttgcaccagtttttgggttgagggatgattttgtaattcggtgacaagatggaggacctccggtgtacttttttccaagaaagaccatatgtcctcaaaacccttaacaggccggacaaacagaaggccaatcgatctcgcctacaagcccagcaacgttgccactcgcccccacgtagacgcgtgagacaacatccaccgacgcgtgatcaagtcgtcgcccttcctgctgtcgtgcgtgcgtgcgtcgtgcggcagcggaccgcgtcgatggcgcagtcgtcggtgtttggttgcggtgtccgtccgtgtgcagtgcagccaaaatgacgtgcgcgtcagggttcacaatttcagtggactgattcatcgaatacataaaccactcagatttttaggttagattaaaaaaattgaactgaattttaaaattttgatagaatttattcagattttattggtttttgtcggtttatcaatggattcagcgaaaatccaatgatacttatggtgagcggattttgatccgatatcagaattgtgaaccctatagccacgcacattctaaaggaggaaggatggatcaaaattgtgaaccctatagccacgcacactctaaaggaggaaggatgaggcgagggggtgatttggttcgacgagaaaaggcaggaggacgagggattgtgcgtttcttctcgctttcctctctttagctgcatcatgttattcctcctactagctactccctccgtccaataatataagggattttgaatttttatttgtattgtttgaccactggtattattcaaaaaatttgtgtaaatatacaacaaaaaattatgcttaaaatacttgtggagtaatataatgtaagtccaaaaaaaaaaataaataantaaatttaaatttttttgaataagaagagtggtcaaacagtacaaataaaaactcaaatcccttatattataggacggttagagtaacagtgctactgccaaaagccaaaaggataaagaaacaaaagcgatggaaacttcctacacatatatgctcgttgcacattctctcttcatctaggttgcgttcgagcgcaggagaaagagagaaagattgttttgtttttcgcgcgcacgcttactgaattactaaacggtgtgtgttttgcaaaaaatttctatagaaaagttgatttaaaaaatcatattaatttattcttaaagtttaaaataattaatactcaattaatcatgtgctaatggctcaccttattttacgtatcttcccaacctcctcaatccccttctcctcaaacacacccctagtacacaacactgtcaagtgtctaacacaacacatgaagtagagtactctttattctttgcacggttttatgacaggtcgcatctaattaaaacaatccttaaaaataaaggagaaaaggccctagtgaaaaaaagagacaaaaacaataggtcgattgcaaagccaccttcaccaaatgaccaaagtgaacttctcccccaaaacggaggatccaatgacccctgaaacgaaaaaaaaaaagtaggcaaaaaaaaaaacagaggatccaatgcacaaaagcagagaaggcaatgggcaacggccaatgccacaggtaaaaatatacaaatccacaggctttccctgtaattttctcccatatcgcctttctcctcgcaagcatgtgtctcctccccactttgcacttggcatttgcaccccagctttgcctctacctcactagtagtagtaaaaaaacgttaattacattgtttactcgaaagcccacaggattaaccgcttaacccaatgcaaccgttgtcaaggctaaccctaaacactttaatttaaaactcctacttaaaaccccccttccagaagacatcccgctccagtttcccacgccaccgtcgaacaccttcacccatggcgtccatggccgccctcctcgtcgtcgtcttcctcgccggctgccacggtgagcgccgccgcccaccacctccgccttctcgtgttcttacttgagatatggctaaatgttttttttaatttttttttggctgggagtgggggtagtggtggcgcaggggaggagcaccgcggcggcgcatggcatcggggtgaactacgggagggtggcggacgacatcccgccgccggcgaggtcggtggagctcctccgggcggtgggggccgggtcggtgaagatctacgacgcgaactcgagcgtgctccgcgcgctggcggggacgcgcatgcgggtgtcgatcatggtgcccaacgagatcatcccggggctcgccgcctccgccgccgccgcggacaggtgggtggcggagaatctggtgccctactacccggagacgcgggtcaagtacctcctcgtcggcaacgagctcctctccgactactccatcgccaactccacctggccccgcatcgtgccggccatggagaacctccacgtgagcctccggaggaggaggatcagcagcgtcaagatcagcaccacgctcgccatggacgcgctcacgtcggggtcgttcccgcggccgccgtccgccgcggcgttccgccccgacatcgccggcgacgtcgtgcgcccgctgctccggttcttgaacgggacgaactcgtactacttcgtcgacgcctacccgtacttcgtctgggccggcaacaacgacaccgtcccgctcgagtacgcgctcttccagggcggcggcggcggcggccgctacgttgatccgggcacggggctcacatacaccaacatgctcgacgaaatgctcgacgccgtggtgcacgcgatggcgaagctggggtacgggggcgtgaagctgggcatcgcggagaccggctggcccaacggcggcgactacgagcagatcggctgcaacgcccacaacgccgccatctacaacaggaacctcgcggcgcggatggcgaggagccccggcacgccggcgcggcccggcgcgaagatgccggtgttcgtgttctcgctctacaacgaggacctcaagccggggcccggcacggagcggcactgggggctgtactacgccaacggcacggcggtgtacccggttgacctcgccggagcgcggccgctccggtcgtacccgctgctgccgccgccggagaacgacgcgccgtacaagggccccgtgtggtgcgtgctcgccggccgccgcggcgagaagctgaacgagacggcggtgggcgacgcgctggcgtacgcgtgcgggcaggggaacgggacgtgcgacgccatccagcccggcggggagtgcttccggccgaacaccacggcggcgcacgccagctacgccttcaactcgtactggcagcagctgaggaagaccggtgcgacgtgctacttcaacaacctcgccgaggagaccaccaaagatccaagtaagcctgaaaaatatctggaaaattttactccatttttgctcagatttcgattgatacatgcaaatgcaatttatgatttccatctttagtgatctaggttgatggatgaatttactttggatgctggttctttagaaattagaattctgtaaggtctagaatagatgtggcgttttgctggtgagggaataaaggcgatgtctttatggcattggtgatgaactcgtgaaagctggtcaagcttgcaattttttgtgagcattacagcactaggcgatgtcttctcgtttagttgtcttttctgatgattgggttgatgaaaacaaataatcttacgtatctcctgggattaggtttgattatttaaatgacttctgaagtcagtgtcaactggagaaggatgaaatttctaggacagtaggattacaagtgcattgtcaataagaaactatttgctggaatcagattacaggtgcccaggatataattgtacctgataatattaatcaacagcacttcagttgacccaatacattatgatctcgatcccgattggttttgatttttgaatgttactaatttaagcatatctaatgctagtgttttcagataggttcatatttagaatttgggttaccgtagcttgtgtagtcctataattggaactcctcgctaggattttggaacatacatttggtacttaatttaaatgataaagtataattttaaagaatgaaatttctgaaccatgttgaacaatgagcatatgttaaacactactgtagaagctaattcatttgttcatgctaatataataccccaaaattccccattagtcatttgcgtagtgcatatacagtagaaggcatctttattaggatctatttatgatgtttgtctctccctggctcacttccaaaagattttcagtctgcacatttgttctgaaagattcattcagacgaatggagctgactgcttggctgtcattactgcggacaaagtatgatccgtgggttgccttccatccaaatgccacagtacatgctcgcatgcttgtgaacttggaccatatattgatttggtcaaaagactcaaacccacctgcacatttcgcatagccttgagtaaggccaactgcaagcctgcaacctgcatccctgcaaagcatacacagnnnnnnnnnnngcatctgcagggaactgttcttagacagctggacatttgggagtggggaaaaatgctgagacactgcctctttatttttctcctttacaacgtacttcctctgctgacaaatatttggcgtttagaacaagggttggtcaagcttctggaactttggccatgaataatttctcaaatgcttagttttgccttcaaaagtactatcataatattataatatcattagattttataaacttgttatgatataaaattgattatcaaagtttcaaaagttcgaccaaatcttatcctaaacgtcaaatatatgtgacatgatgagtattctctagcaagttctctgtgtgcagaagaaaatagtcatttcattcatgacagtgtaagcattttaggtgggacgtcagtgtaatgctccctttcatagctaaacatccttggacactagctcgtgtatgtatgatcttcttctgttctttagcatctcacttagcttataacttggtaaaagtagccttggtggatgttgctttcgactcaaaagaaaggtcctttgctaactcaactaggagaaatcaggataccaaatctgctaatggtgcactattatctgttactcttgggcacgcactttaccattttctgcaagcacaagcaacttattcggtgtatcttaatatgcttctattttacacttcagtggttaacctgccgtgctgattaagtgattagttcgaatcactgattttgttgtgtgtgttttttgcaggccacggatcatgcaaattccacagttctttggactaactgattgcatgggaggacaatatgaaaatgaacaacattgttctcgatttattttatttttgtcaaacctgattagatttagacccaggaagttaggtagttgagtacttctgtatctgctcatcgtctacaaaacctgtgaactgtgatgtaacagcgaaatttgccgtctgtttttctgtggcttaatcagtagaagaagatctgtggcttaattagaacgaaattttcagaactgaaccacctgcctctgcatgggcctcacatgggccatacatgggcctgcacctgcctctgcaaccgagctaggagtagcagttctgccacacggcccgtctacaaggatggtgttgtactgtgtcactcatccttcgagttttagttttttttttgtaatatcttttaatagtttgcacatcatctacagaaatattttgatgtacgcaagttatttaaaaagaatcttttatattttcaaacaaaaagaatctttgagtgtaacacttctcttaagaacaagtactactagtaactatagcaaggccaaaaaagacaaatcaattcagttaaaattgccaagctgaatttcagtagtacatgtgatcggtgtttcagccaaaaaaaaacatggaatattcatgccctttcctttgtcacactggccactacgattggttcaacaaggacatgagcagaatagggccatttacatcggcgagtgactcagctcacacagcgactgttactgctctgtccgtgcgctgcagagagatcacgcacatttacatctcaaagacctttttttttccttctctgtgcctctaactgcactgtactgcttgtcagttactcgacagcaacatccaccgattttttttcggttttcatgaaaaaaaaacgcttcaaaaccaatggctccatgtaaaatctggtcaaattttgtatttaaaaaacagtttgatttttataaaaactttactaggaaacgagcggtttctattctcgagccggcttggaagtgcagttttttagtgaaaactggttggtttttgtcggttttataaaccctaactgccaccctatgatgatctatccatctctgaatctcactctcacgaccaaagttttttgttgttgtcgtcacagctggaagaaaatgtgattaaaaaagagagagaaaaacagccgacgaaagaagcagcttctgattgcagagataactaccactacaagaacaaactaatggtgaggatatggttggctttgcttggcgtaggtgttaagattcagagattcctccgaccatgcgagagatctatctttgctactgcctaattgcctatagtggccggtataatgaccaagggggttacctgtccacttcacttaccataagctgcaaaatgcaatggctgcaattgcatcactacgtcttacaaacgtacttattgcgttctgaaataattggcacttatactattcaagtttattttttcttttttctataaaatttataaatgttgaaaatatgttattctatcaaagtgtgtaatatcataaattcaacacggctgtaatcaacggtgtcggttattcgatattggagggggtattcttgtagttttttttttagataatgagttcgcaaacatgcattgcttgagatggagataatcatgagatggtgaattggtgatgactgatgactggtgatttgggtttatgttttcttaaaagaaaaattggataaccacctcagccacttcaactgctagctaagctagacaatagacagatgtagagatggatagatgtgtagccatagatagcttcttaaagctccaacacacttatacctgcaacaagaaaagagcacaaattacttgcaagtgagctaaagtccggtagctagctagctagataccaacacacacatttgctgccgtagcttactagattatggtggtgttcaacgagattagtgtggtgttggttgggaactacctttctcaggattagagagccatcatttttgttctgtgattccaggtcagtgagcagttaagcattaattgaaaaaaaaagaagagttggacattgacagtttgacacattgttgttattattatctaatgactcctgcagaaatagagcacactgcacccattccggaaaatctcatggtacctttgtcattaatcatgctgagcacagcacacatggctgcactgattgccctgtgaaaattcctactcctggctactacccctgctcctgatccaatcaagacgatgattaaatcagatcaaagtttgtgcttttccagcaaaaacacagctactgcaaagatagatttcaaagccatttatctgaaaagttgcaaagaaaaaggggtacaagtgccatgaactagttcatgatgggccagcagcagtggatatcatgagaaatagatggcgctctcaaaattgcaaatcaatcaagtgccatttttaagcaacacgtcaaactgtgcaatgagtaatctgcaggccaaacaagctcatttgctctagatgaactcccaatgcaaattaccaacacaacaacaggcaaacacaaatttcagaatccaagattattccactaatccataaaataatgcaccactgaacctcacattttgcaaagaatttagtactcactaattctagtatattaaaactcctaattaagttatcctgactccattggaaagagtgaaaagcacatcaaaaacctcagcgaacaaaaagaa

SEQ ID NO: 55680 - DNA, 15557 bp, Oryza sativa
  unsure (1)..(15557): unsure at all n locations
cctctaaaaggaggaggagtttagtagtaacctctttcttcttccatccatcgccgccgccgccgccgccgcattcgccgccgtcgagtcgtcgtcgtcgccggtcaccgccgccattggcgagaagcggagaaggggaggggagtgggggggcatatcaatggagggggaggagggaggaaggggaaggaggcactgagcggggggcacctctgccacgtgtgcgggtaccagtaccccaacgcgaaccctagcgcgaagctccgccgctcccaccggaagaactgcgggaaggcgccggccgcggacgagcgggaggagggggaggaggtggacgccgacatggagcgcaatgcgggggaggggctcctgccaggtacggtttatatttggtgtgcttctccttggattgggttgtctcgggttcttgggtttttgatggtttcgcgcgttcgtgttcgctgcagttagagcaggaggaggtgagtcggaggggaatgcaggctctccatcgctcggatctgcgagaggagatgctgatttggtggaggtgaaggagattgcaggtataatctctagtattttttttcatcggtaattttctttcttgctttctcgtttaccgctcaatctatctcgtgtatcttgctggtaatttttctttgttgccttttcgtttaccgctcaatctcgtgtgctatattaaattcgaggttttcgtgtggggttcgttgcaattatccttgattttgcctgcttgcattgtgagatgtgagagctgacaaaatcgatgatagatcgcgatgattgctgctaactaaatccgcaatctttcataagctttgcttctgctgcgtgcaacgttgtgctttttgttgtcttgcttggtttgttgctagagaggctgaaaaaggcaaaaagtatggctgccttttgctcatcagtcccccccttggagagggacaggaaactcacatggcatagtgagatggtactgttctggggtactggagtaaaggtccgtgtggttcttggttagcattaaagctgaaagcattggtactttcttgttttctttggagttggagagatacttgtgtgagaatgatgtagaaatagttggagtgaattgtttttctgacttgcaaactgtagatctgaactttgctgagtcacttggtgttgagtgttaaataaagtagtaaagctaatcactgagattcaagtgttccttccaccgtctagcacctagattatctctccgtgtttcacggcaagttggtggcttggtaatgttagtcagcagtaagaagcctttgcttgtctttgtggtcatatacttcatcggattctttctcgaaactggcagtcagacaaggtgaactgatttgttggtttcttggtacatctttcatgctaaatatccgacatatctgtcattactcttgttggtaggtaagatagcttagaagctgtcttcctacacatggtcttacaccacatgctatcctagtgacatgtgcgtttggtttgctatgctgaattgtttagtctccttatgtggatgcatgtctcttgaaattttggttgtatccttattataatactgtgaagtcatctacttggacagatcattcagggtgttgacatgagtttctgtaatttattacctaattgttgtgactagtccatgtttttttaaaggtctgtggccatgctgttatgtagtatcgtccattaattctggagtcattatgctgctaagtttctaatgactgcaatcccattatactatttacagcaaactcgtctttcaattgttttatgggcccgattttcagggttagtcctctatatcaatataaagttagctagggcaaacttgtgcagcagttacttaagactgtgttattaatcaaattatgaattaggcgtgtacagtcttctgtgaatagtaaattatgaaataggtgtgtacagtctttccaccttttgcggtgattttttattgtcttctgtgaaacctctcattttgctcctattagcaaataatgacagtggaaagagtgctactgtggaaatactaaatatattaggaaataaacctacgcaataaaaatagcttttatgggtcttatttacactctttagtttctgttagtaataactccctatgtccacaagctaattttggtgcacatcaggaatttacagacattttctcccaataacctagtatagctcacgttattaacttattagaacatatccttttccacaataacttagcatgagttcttaacatttcctgttacttcgtctagtcttttgtatccttccatgcttttattggaaacacctttaatggttactgatttattatgctgacaatcctagtaaaatattaatgcttttgagttgtttttgatcattcctgccatcctttgtttcactaataagtgttcttttccacgttacttattatttcatgttttagttcatctaacaatgtgttggtttgattctttaatagaacatgcttctccaaacgttaccggagttcaagtcatcactggttactgcagtgaagctggtgtgattaattgcgcaagtcattctgatgaaatttcaaaagaaggtatgaaaactaacttatgaaggccttgcaccaatgaagtcaaaattaagttgcagaacattactctgaaatttcaccacttgcagttggacgtccggctgaacgagaagatagtcttgatgagtaccaggacgcgtctccttttcttcatcaaccagattctgaagttggtgcagcagtagcacataagtcagatttttctattgaagaaattaagaatttggatagtgtttcaccagcagcaagtgtagcagcaaatgaaatttctgtggaaatggatggagtatcgaaagatcagttatcaggacaacccaatatgactaatttatctggtgaatccatagttggaaaagaagttgagcctactgtgatgcttgagagttcagatgaattctcagttaatgttcacagtgataatacatatattgttgacagcaaacctgataagacatctgagtttattggtgatgtgaatggttcaacttcatttatttctgacctaacatcccaatctacaagtcccataatggttgaaagcttgatggaagatagcatggatgctctgcacatcatatctgaagtatcaccaagtttggaagaaaaagcaggatcagccaatgctgaatctgtaacagaaaattccagaattgactttgtgcaaactgaagatcaactgaagctcaccaatgctgtaaataccttgacagattgctcttcacagtacaagtgtgttaaagatactttagatgcccagctgcctgttgagaatccgttcctgggtaattcagtatgttctttagatggtcatcagagtgaccatgttgttactaatatggatagcatgtggggttctgatgatgaagatatttgtagtgaaggcatcaaagcgaagggcagtgagttgggtttttcttgtgaggagaacccacaacatgtcgagttggttgataaagcagatgaaaatccttctgtagagaagcctaatggattatcagaagaggtggtctgcagcaaagagattggccctgaggttcctattataggccaggtctctgcaagtcagcatgttgccttactaatggatcaagtgtccacaaagaatccgttcattctagatgataccaggagcgacgacttatttgagcttccaactgagaattaccattcggaagcacaaaatgttgctgaatcaaagctgcaagttgactttacacctctgccattggatcagctgataattgtggaccaaactagcattgctgaaggccagcaatttgtcatctcaggttaggattgttttaccgtggattatgtacaagccagtaattctatttctgctgtatgttttttaatgtcgttaattcattgctgaaatttaatgcgtccaggctatatatgctttagtctagcttttatttgacagcctgtacatgtttgtttggtttttaaagaaaatcggtaaaaatgctaagctgtggagggaatttatctaaaatgtcacgtggttaaggtgttcaggcaaatgatattctgctttagtgccttacatggatataaagaagttaaatcaacagcggtagattcttaaattatatgtactacttcctgcataaatgctcactcacgagtcatgacgatggcttcacttgcttgctggaattcacagtagacttttaaatcctaatcttgttagcagtattttcttggggatggctactgtacaaacaacttttatcatagttttcctctctttgcatggcacatgttgccttgttatcacctctggagagaatagtggataatggtaaaatgattgtgaatacagagctagttgctctgtattgtcatatgttaaaatcgtttcaattctccctattccaatgttactgtatgactttcttctagcagacgttactagttttgattacatggtatcagtcactgaaatttgttgctcatttctggcaggtgatcgtgtaccagctatctcaagtacctgtggaaatgaacctgcagttggcacagaggatgtgtctgtcagtagcacttctgatcctgcgaagaacatttccttgcatgatgcctcagtgaacaatagcagacaggaagacggggagcctacaagtggcatcaattttgtgccatctgaagtatttcttccagcagagtttagcacaatgcctacttctcaggatatcaatgctctcaagaatgatggtaacgagaagacgccacttgaagacataagcaccaaggatatgactgcatcacttagtgaagataatgttgaagaaaagaaagagaccgaaggcactagtgtgaaggagatgaattcaatactgaaagcagacaatgttgaagaagagaagttgactgatgacacgagtgcagagaggaatgcaatgcagcacatagatgacgctgaaaagaagcaggctgctgacactgtttcgagggaaacgagtgctctacaaaacatagaagaaagggaaaacgttgaaggtactggtgctaagggagtgccagcagtagggagcttggaaaatgctgatgcggagaatcagactgaagacaccagtgcaaagacagaatgtaaatcagataatgctgacaacaagaagcagagttacgacacaagcacagaggagatgaatgccaagaatcaagctcaagatacttcctcaaaggagatgaacaccatacaaaacacatctaatgctgaagaaaagaaccaaactgaagacccagctgtccaggagggaaacaagcagaaggaaggcatctctcccacagtagcgaagcagagttcagaaagagttcatgtccctctcaaggtgctcctagccgaggcgagtgtggagacgaaagaaaagaaaaccactgccaaggagcgtgttttgtcattcaggcgccgagtatcgaaggacgactcatcgtcggccaagtccgggtccccaaaacctggtgctgatgacaacaaattctggagctccccagcaagattgcccgagaacaatgctgagaagaaatccaaagcaaggaagcagccatggatgccgttcatttgctgtcactcggtgcactaagcctgccatccatcttcagcagcacaaagcttctccaagctgctgctatacaccatgtgcatgttgcatcttgagttattattgatagcactagtagtagtaacagtagtaaagggcttggctatgctacgatgctctttctagtatttgcattggtctacatttgccgctgtaactaaagctccccacatcttttgtgtagatagtccatgcaagtaagattgtttggtaatgtcgagctgatacttgctgatctgcattgatgttcagactttgtgaatcatgtgcgattttgatgttcatagtaaacttgctcgtgaatggatgtggattcagccctgtgcgctgcattggatcttagacactgtttgaaacaaattttttttcttttaactagaaaaaagcccatgcgttgtaacaggtaaaatctatttatatcttattatggttatatgggctatgtttagatccaaagtttggatctaaacttcagtccttttccatcacatcaacctgtcatacacacaacttttcagtcacatcatcttcaatttcaaccaaaatccaaactttgggctcaactaaacacatccatggtttagtttaaatcttattatggttatatggtttagttaagatgaaattgactgctggaattcgtttggatatatatatatttttagaaaatcatgagctgcagttaggagtccgtttgtctaaagttagcacgtgagttttcttatacgactcattctgtattaaattggaattcacttggatatatatatatttttagaaaatcatgagctgcagttaggagtccgtttgtctaaagttagtatgcgagttttcttatacgactctttttgtattttcaaaagagaacgaacttaaaaaccgactcaaatacttaaaaactgactcaaatatggatatgtattttcaaaagcgaacaaattgaaaaaccgacttaaatacggatatgtattttcaaaagcgaacgaaataaaaaccgacttatatatggatgacgtaccaaagtacaggtaaaacatcttcaatttttataatagtaacgacttatgcgagaattgagcaactttctggcatacttgtacgaaaattttgtatagcaaatttgtgcgttccattccacaaaacttgactacgccatgttattatctgattcagattttggaatcacttttttcttggcaacttttaataataaactttgtagtagtaattcgtccatcaatttcagtcttttttttttcagtctccgtcgtctcactcaaatgacgcctacgttgtgatacagtgcggcccaaacagtcttacatattcatggagtgatatattttatattaatttatgttgttaaatttttgttttattttttgataactatttatatacttcctccgtttcattttaagtgcagctgtagttttctgtgtccgacgtttaaccgtttatcttatttgaaattcttttaggcaaaatttgcttgtatttttgttgttattagatgataagacataaatagtactttatgtataacttatttttttaaaaaaattttaaataatacgaacgattaaatattagacacggaaaccgcgactgcaaaatgggacggggagtaacatgcaagcgagtggacctaaaagtgaacttattcctattcggattgccgtgcgggccaatcagatagagtttcggcttcggctttgttcccgcgaccgtgatcgattccgagtcggcgcgggagatatccatcccagtataaatcttacgagcggcgggcgctcctcctcctccacagatcgcttagggttcgcgttgcaaatcaatcaatcaaggcgcgtgaatttctgggacgctcttcatcgatcgatccatccatccgtcagcatgtcggcgatcctcatctgtagcgtggctgcagcgtctgcttcagccaatacgtcggcggcgatgaggaggacgcgccgcgcgcgagatggcggtggcgcgccgccgccgccgccggccgggtactccgcggcggccacggcggcgagtgttccggcgtctctcctgttgattctggggtcgtgtttggtggcggcgtgcatattgttgtgatcgcgcgacggcgacgtgaagcctctttggcggtggcgcgcggcgtggcgttcacgactaattttgatcggaatttaagtagtagtttctgggattgattgtttctcccatttttattccttttgttactgctaagttttatatatgtcggaacaagcaataggaagattaatgtctatatttaatcaagatatattgtttttttttctgatttatattaatataggaaatattaatgacctagagtgagtgcgcgcttaaaaaaatacgaataacagggaatgatctaatatcgaataattaaaaaggttagacctcgaagaaatcaagtgtggagctagctatccgtgggcgtttctcagagtgtgtgcttacacattgatgaattggtcgaagaaatcaagtgtgcgtcgatgcgatgattctgacgtcgctagtagtaaacttgctcatgaatgtggattaattttggcatcttgcgttgcctagcttggaacacgagatgttttaacgatgcaaattcccgtgttagatgatgcctactaatctgttccgaccctgtttctgaatagctgggccgagtggcccactctatgtacataaaaatctctcttaactatgttctacatggttaagcttctgacgttgcttttaaatcgactatatttctaaatggttcagccggctctgtttctaaatggttggttgagccacggatgaagaagctgcctattaatctcccgacttctggcagcgttcgtttatccaacaaactgttggatgaaattttggattatcgtggcacgttttttaaactgttaaacggtgcgttttgtgtaaaaactttctatatgaaagttgctataaaatatcatattaatccatttttcaagttttgtaataattaaaacttaattaatcatacgttagtatcacctcgttttacgtgaaacgtttaatttttatctttatttttcatcttccggagattcaaacaaatcgactcgaaataatggttgagccgtggatgaagaagaacaacgacgcattcgctaagtttcgagtagtttcctggtgattactgattaattgttgttctttcccttttcttttgattctgattatatatatcgaaataaagaaatattattgtactgcatggatatagatgagtttgacgcacatgcatcacttgctcagagtaaaaaactaattctgaaatgtttgctcgatcaacgtctgctgcacggcttattgcgtggctgtgaacgtccgcaccgccagtttggtggtgatgaggcacccacgagcatttgcgcttcgtcgacagtttcgcggccacgttgtccaaggttccggtgtattgttacacggttgtggcggcttatttcgccgtggcagcggtattggcgcggtggccattgctcaatgatcgttgaagtaggaattaagtatagccaattgctagctttaaaaattaatatatcatatatgatctctctaaatatcttattcatagggctgatcggaactgctggctgctgcagccatcacggctatggccctttttggctgctgctgctgcagctgatttttagctctcgcagccgtagctgctgcagcagccagcactgccgatcacgctcaatagttttatataaattatatatcgcaccattaatactttggtctacgtattacactcacgtaatatcttgaagctcaggttgtagctagatataaatttataactcgtttttcttctcacctcttctctcttattcacatgtgtgtaaacctatactggctagtacagtacttgctcttagattcattgagcgtgtgatgctctctctacgatagcgaaggcgacacaagccgcaacgcaggcgacggccttgggctcgctgcacagaaccgaccgcgacggcccatgtactcctacagtctcgcaggttctcggcccaatcgagacgttcgcgtgggccgtgattttcccggcccactcgcggcggcccatctcaccgagcccaccgcctagggttctcgcgccgccataagaaccccttcattccccacccagccgccgcccgccgcaggggttcgcgaaggtaacgtgcgctccggctcgccgccgcgtggttttccggtgacgttctcctcccccccccgtatccctaacgcggctgtttttcgcgtgcagatggcggtgccgttgctgacgaagaagatcgtgaagaagcgggtgaagcagttcaagaggccgcacagcgaccgctacatcggcctcaaggtttgcatcctccccttcctcaaatccctcgctcgcccctcccaggatgcaagatgcgctgctgctacgcgcgagccggatgcatttttttaacggtgtttctgatggtataatgcattctagagtgatgttgaaatatgatcatccgatgcttaggaaaacagtttatatgcctctaatttgtaattgtagcttaggcaaggctactctcaaatgagacgaggatgtttgttgatatctctcgctactagctaaattgattctgtctaaagtctagacatgatggctaatcatgtaaagctaagatttacacatgtagcttgagcattgtgctgtctttgtatgcctaaagacaatggattccgaataaaaaggccatctaatgcaggcttactcatttacatgaaactttcgaattgagataaaaaaattgaattggtcgtgtttttgatttttatgtttgatgttcagagtgaaaggaaatgatggcttagtaaaaggtctgagtgagaaaacattttcttagtgaacattgggggtaaaggaagagggccctagctcttgcactagtgtagcattgtggctctcgcaacctcttctacagcaattacttcattgctttgtgaagtgggttggatcaaaaggcgtgggcttcattctgagtatgaatgcttgcctagacttctccctacattttttcccgatgttcacttaagaaaatcctgttttttgcatgataacaatccttatgtctgatcctttcagcgaacaacttttgcagttgcatatattagtgggtgaacttctcaagtgcaggacttaagttcttattatcgtgttacatatgaagttccttatatgaactgtcatttggatgtactctccaaagttgcataattgatagtcattagtatttagttatgataatcatttatgttgtaatccccatcgtgtgcacagtataccactcaaacaactttgttttaaaatgaactgcttctagaaccaaaaggctagctgcttatagttgtattctgtgtttaactaacaaattatggatgtgtgaaatgataggttcataggataggctagcttttaggattttggcatgctgatgatttgtttctaacttgaatacacttctccgcttatttcttttgtgtgctgccttgcttaaatttggtgttctttttacttccctatatgtagacaagctggcgcaggccaaagggtatcgactcccgtgtcaggagaaagttcaagggatgcactttgatgcctaatattggctatggttctgacaagaagacgaggcattaccttcccaacaaattcaagaagtttgtcgtccacaatgtctctgagctggagttacttatgatgcacaacaggtaacacatgctgccgattcaatttagtgactgaagttgagaagtgaatattctgaagttctatgctatgctgtccactcttacaaaccttgctaatggttaggattaattcttgttattgcacatttcatacaaacaggacatactgtgctgagatcgctcacaatgtctcaacgaagaagcgcaaggagatcgtggagcgtgctgcacagcttgatatcgtggtcaccaacaagcttgccaggcttcgcagccaggaggacgagtaaattgttacgctggttgagctgttttttggtcgcgttgtttgtaggaggaacattaccctgcttcgagaagttcacctaatcgttgtgtaattttctcatgtaaacgtccttaggatttcagtaatgagctgtgctcctataattatttactgtactcgacttaccttttcccatgtacactgatatcggcagtcagatgagaaaattgcatgctttgggcactatagttctacatttttactgctctctgatgaagcactaatagaggataaataatctcttgtgatcgtcgaggacctgctgaatgcgcatcgcattgctgcgaacctgcgatgtttggaacatgaataatcgttgatgggctctatatttcctccgcattcctttgtaaattgtaagagactacaagtcataatttgccattctatgatgtataaattgacactgtaaaatgtaaattgcagatctcaacgcttaaatttattcaattgagttatgattatgaaaaaagagatgtaatcatactttttgccgttaaatgcttcggaagttcggatcggtcgaccgagccatcgggctctcatgcaaccacctgcaccctattatcttgcaatcccttttatctatgcatgtatgcatctagcaatatttaaaatatttttttctcctaatctatttatttcatctatgatcgatcaaaccattttatttatggcaattaaaaactttgcatcaagacatcacacgattttattctaataaaaggacataagtttggaacaattataacccatcaattcatagcgatttgttttaacatctattttcactatgttttagattttctttttaaatgtttcaatgcctgttttcttcatcacgtagaggttaatattttattcgatgatcaataaaacatttgaccaccaattttttttcaaaggaaatgggacgatcatttgtagttttctcctagtttgtcacgtcggattttgtaaaaaactgtttctactacgtgtataaatatttttccttgaatcaaatcaaactactctgacaacaactagttcatactctgcatctaacgaacattaaaacccaaatcaaaacagcccaagagattcaggaagaataataataataaaaaaaaaggccatgctgccgctctataaacaaacagtcacccttcgccctcctcgcggaaaatcctagaaacagaaagaaatcgcactcatggcgaagccgcagcttcttctggtcgtcgccgccgccgcactgctactcgtcggtaagtagcctcgatccatggccatggggggcgcccctcaccccctacgcagcgacatctctgatccgatctgagcctgactcctcctcgcctcgtcttgcagttgcagcctccgccaagaaatccggcgacgtgacggagctccagatcggcgtcaaggtaacccgctcctcccagggggattaccctgccctctcgcctgtgtttccaggcgttggttctcttgcgctcaaagactgtttgtattcttgcttgggctggatcggctctagttgactgacgcaagaattgtttgtttagaatttcggattttattgggtcgaggggcgcgtgcttcgtgcgtattagatcatgtcgctgtatcgcgaattgtacgggaattagtttttggtggaaacaatttgtgaggggtggtgttgtgaggcgggcgagtttgcctgattcaactggattcacatctgaatctatagttctttcttcttttttttttcattggaatgcaaaatgttctgaagaaagcggaaaattgaggctcttttgtggaattgattgggcaggtgttaccttgggttttgatcaaggttttccttcgggaagtttagccttctattactgtatttcctgtacattttaattgctatcaaaattagttcatggagaaatgaatctctgcgtgaataattgcttcagggcttttaggttccgtagttctaatatcccatttgccatcgagtaaagctacttaacaaatcgtaggaggaactacaaactaatactcccttcgtttctaaatatttgacgttcgttgacttttttaaatatgtttgaccgttcgtcttattcaaaaaatttaagtaattattattttttcctatcatttgattcattgttaaatatacctatatctatacatatagttttacatatttcacaaaagcttttgaataagatgaacggtcaaacatgtgctaaaaagcaacggtgtcaaatatttagatatgaatggagtattacatagtaccttcctgtaagggacagggcgtcttgaacatatgacctcggacataaatttattctctaccataggataatctgaaatattggtgttacgctgccatttcttataggaaaaaaaataaaacaaaaatctagcttgccccacgcagcatatcttcagaattagtacagccttgccaaggaaagaacattgtaattgtcaccacattggtccaaaaatatgcattttatttattttgatgctctagagaaaacggtagccttttacaaaataaatggctctttcaagaagctggatctcaaatttgtgtgccatatagaatttagatagtttaaatatcatatgctactttcattttgatatatttattttattgggctcatatagtcatatatttgtgttgtgaccttgtttcacttgcagcacaagccagaatcctgcagcattcaagctcacaaaggcgacagagttaaagttcactaccgtgtaagtttgatattctgctgtatggcctgttttgtttttatttactggcatcactttatttatgaagcctgtagttcacttggcctctgtcatccatttacagggaaaacttactgatggaacagattttgattctagctatgaaagaggtgacccaatcgaatttgagttgggcactggccaagtgatcaaaggtaatagtaatggtcccaatcaatagctagctactcatttaattttagtattgtttaaaatttcaatgctccattgtctatctaaaaatttcaatactccatttgtagggtgggatcagggcattctgggcatgtgcgttggcgagaagaggaagctgaagatcccttcaaagctcggttatggtgctcaagggtcaccgccgaccatccctggtatgtcgttttgtagttcttgtctcttgagtttatgccgctgtcaagttagaatggtacatccttttcaagagaagttgtgtataataaaaatagtttatcatacaacagcacatggccacattgtctgagggagctgctgcaatgctatattttttctagtcgggactttttcactacatatgtaatatatctgatctgatctggtgttgttatgttccggcctgcaggtggagcgactctcattttcgataccgagcttgttgctgtcaatggcgagccagccagcaaatccgatgaggacgatgatgacagcgagctttagatagccaggatggttcacatcttacgcgccaaaacaaagtctagttgtcgaatcaaatagtgagtagtgaaatgcaatgcatttcaaattcaggaccccatagagaaatcaactctctttttttttcaccatgaccttatctgctattttatnnnnnnnnnnnnnnnnnnnnnnnnnnnnnnnnnnnnnnnnnnnnnnnnnnnnnnnnnnnnnnnnnnnnnnnnnn

SEQ ID NO: 55681 - DNA, 933 bp, Oryza sativa
ccgtcacataggtgccaagtcagtaaaacctccctttaagaccgttgagggagtcaagttgtaccggttttaatagttgggagtcaaattgtaattcaggggtacgaattagattggaccactattaagggagtcaaagtgaacttattcctcgaccgggagaccccagcccagcccatattagccaccgggggccggggcctggaagccttagccctcgctcgccgggcgtctccgtcacgaacaagcgccgccgccgccgccgccgctcgccggtgctacggaagacgcggccgcttcttattcggaggcggcgaggagagggagaggggcttcatctgctgctgcttcggctaggagcctaggacgccatggcttcctctccgacgacaggtacgacgaactcgacgagctcccctcttcttgacttctttgcgcagcatgtctacctcagattgaaccaaaattcacaaaaactccagaaaaaaaaaatcgctagctttcggctcaactagtgagaacgaagcttacggcacaaatccattagcttccagctgcagattgtgaacttttcaaatcgcttagattgaagactatcaactcatatctttgtccttccaagaccgagtttaaagcttccagatggattaatttaacttctacattgcaattttcatgccatgcttgcattccattattattagtttatttttggggttcttatgatagtgtgatgtatttttagatggattaactgagtcagtggccaaaaggaagggctctccttgccaacaagatgatgattgccaagatgacaaacgaataagatcaggtgcagaccttctagaggtataaattactatagtgcaaagcctacatgcatgtgaattagttgtggctcgaataggaatttgtaggtaggagtaatgtggt

SEQ ID NO: 55682 - DNA, 6113 bp, Oryza sativa
tgactcttgagaagcgttttttctcaaacggctgaacagtacactttttaaaaaggaataagttcctgaagaaaaaatacttttaaaaaaaattaactaatatttaatttatcatgttagttgttctgttacattcgaacagtcttattagaatgcgcttgcaggcagatctcatttcttgcattcccagcaaggaatgcagacatgcagtacacatctgaacgaaaaaaaagggctcaaaacaaacaatcacgattagcacacaatttgcattgccctccgttaacgccatggttctggtttttggaggctaaacaacagctacagatgtacaccatacttttctttcggccgcccgggttcataccaatttctctgacatgttacctcgcataccaatttgacaaacgatgtagtactgcactgcagccaaatacaacagctaagactcatccacatagtttcatcatggtatgaaatgttgcttccgatgcatgatccttctccagggagcaacacctccagcgattgctatggaagcatcaattatctgtgccgaagtagcggtcaccgtactctcccaaccctgggattaccctgtattcctcgctcaacccggtgtcgatctcggaggttacaatcttcagcctcggaaatcgcttgcagacgcactgaattccctcaggagcctgtttacaaataaaggtagacagatccagttaaaactaaaatagggcggagagcaacagaacagttagtttagtatgttaatggatttaccgagataagattgagaaatatgattcgctcctctggaacaccttttcttatcagaagctcaatagcttgatttgctgagttacctacggagtacaaaacaacgatgaaggacactcagttataaagtagtgtcagatactggcgctatgaataaaattgcagatggcctaaagctggtggagcatctagccaaacattgcagcagcagcagtctttgattgttcattcattcagaacataatcatggactaatgattcatacttgccttatacttttttaaaaaaaatcaaggtgttcccaacagggaaaccaataggcaataatatcttccaatgtccagaaaagcttctggataaatgcaagatatataagtgcaggcatgcatagcaaaggcaatgtcgtccatgatcagtggttcacaagtcagttagcttaagttccaacaaatgaatgaaaatacatatagagagaccatgcaaaactgacctgtaccaagcactggatccaaaagaagaacatgccgttcagcaatatccatgggcagtttatggtatataagctgcaatggcaaagtgaataataactattcaaactatatgaactaagtcattctgaggatcctttttcaataatcattaatcataaaatctatgtacttacttgctgtccattgtctccaacacgatgtattagaatcttgccaatttttattcctttacaacaagcacgcaatgcattctccatactttcaccactgcaatacaatgatacatgttaatgaaaagatgttgaaatatcttctgtaatactaatatttcacgacattacggaagaatgacaggaaaaaagtaatttggagttaaaaattgggacatgatgcatggtaccatgaagatcgataaatgcactagtctgacctagaaaaaaatgttacagaacacataacatacataaaggaagaggttccaaaatccaatacaaaacaaagtataatgtaaaattctactaataacaaataatcttgagttctaaggtagcatctcaacacaaggatccagaaaattgctgttggacagagtcaattcagtatgcagccatccttcaaaatgcacctgccaatgttgtctgcttgaatttttagtttgctaattacttcatcatttcataacgtaccttcggacaatagacactccacagagcttcttgcaaaattcaactcccatataaatggaccctagacccagaagaaacaaattatacatgcatgagttgatgttctgaaaaaggaaagcattgtagagctagctaatttcaaatactaaatgcatagaggtacggcatgcagagtatcatgtagcaaacttgttgggaagttctaggtatgctgtttttctatttgcactaaatcagacccctaaaaacctgtttgcagccaaccataaattgctactcctacgtcgaagggaaaatttcagaagcatatgaaagtagctaattccaaaggtctgcagcagcagaattaattaagtaatggttctccataacaacgagtcccagctgcaggccacatctgcagcatcaatcctaaatttttttctcaacaaatttttgggtgattttagagaattgttatgtagcacactagtcaaatttgaatcagttgtcttacaactatgaacaattaaaaaaactccttttcgtaggtggattcacaccagttcagaacttatgatataaaacaatattagcattagcaaccagaatgaaaccgtgcaccccctgcatcacagtgggatggagccgttttgatggcaggatgggttatgtgcgctctcttttcagtcttttgtaggaataatttgtaacactgttaaacaactgaaaaagaatgaaaccaaaaatatgtggtaccatttgaaaatacctgttggagtaataatctgcttttctgtaaatggcaaatgccccagtccgtgctcaactacctgacatggcatttccataccaatagcaaatgagttgaatcaattcaaaatctggatcttttaaaaaaaaattatgaagttaaagagaagttataaaagctatatatacaaaagtagtaccaaacggatcaaccgatctgaataaaagacaaagtcaggtgtagtgatgtccctgtcacgaatcagagtatgcattcctcggatctgttgaattcaccatgaaaagtagaagaatattatgaaatttagcaaagaaaagcataaagtttaaagataagtgcaaataatctaacctggaatgttgtttgaaccacataaacatgtggatagattttgcacaagtcatgctgaccaagcttagtacgaatatgttgaacaatcaggtcaattgccacatgattatcacctcctcgtggtatgatcacgtcggcatattttttcgaagggagaacaaaatcatcaaatgctggcttcacaaacctgccatactacagatgccaacagaatttcaaattatatatgtagaaaaattgaaatcagaaaggtaaaaagacaaaaatctgtttacaaagcacaagaacaatattaatataaaaacgcaaaataaaacaagttgaagtacctgctcaagcaccgagctaacatctctacctctttcaactgtatcacgccttattcgtcgagctagcctaatatcagcatctgattggatgcatcatgggcacccaaaaaagaagtgaacaaatattccagctaataacaggaagcagttcaaggcaaacccaacataataatgaaaatgagaaacctgtgtccacaaaaattttcatgtccatcagattgcgaactctttgatcatggaagactaaaatgccctctaatataatgacatctgatgcattgacctagcaaaacaaaattttatcagtcatttaataagcaacattgcagtttattcgcttaactgttaataaggaatcatgaaaatacatcaagaaaaattaacaaatgtgcacagtaacattcgaaacaaaatgcaatgttgtcaattttcttttttttcatgtacaaagggcatatatcagctataaatggtcatatcattgcagagagattaggggggaaagcaacaactattcaatgttattcaaaaggccaatgacttgaaacctagattaaaagctcacagaactacctttctaaagctttcagaggaccgtcggtgattcttaaaatcatatataggaacatttacaggctgtgcccgttttagctgccccatgcattccagaagctgctctgtgtcaaatgcatctgcaagcaaagatatttttgttcacattagaaacaaaagaatgccaactcaggctctgatcactaaaacagggagtgtaattccatccaaacgacaagtcaagtaccagggtgatcaaagttgtaatcttgggcatgtgcagattcttcagcagttaacccacggtagaaggaatcctgcaagttaaaacccaaatgaaatttactggctcttcaaagcatttctggtggagcgagacgacactaagacttgtcaggaaaaaaactgaagtaactaatgacgcatcatttacaggtggactattggttgaaagatcaactaaccaatgtggcatatgggttgtcacacagacaccaagaagataatttcccaaataaattggactaacggtttctggatttataaacatgagaagaacatcaaagggggtggagccaggacggagctgtggacaatacacatttagctgtgttttgctattccatggaaaacatggttgtgccacatttctgctaactataaatattttgagttgcatttatcacaaactgatattcccatcctctagatcatgtggtgcctgaatggatgcccccaaacatccagttaccgtaagtgacctaaatgcattcatgctagaggtagcacaacttgaggtaacattcaggcatatcccagaaaaactgatcagacatcaagttacccgtgtccattcatgccatgttttccattcatataaaatataaggttgtgaacagtttcattgcttagtttcacagctgtaatatgagcattaggtgcaatgaattgcaagaaagatgaatgcatagagacactcatctagcagaatagatctaaacagattacttttccaaaaagtagtagggaaatggcagaagcacgttagtaagctggttaaaggacacatcaaacctactcgaaaatttcctaatcctgatcactatcagtccatgatttagcacatatgccgcattatgcaaccccagagttcagctaagctagtaacacagatcaatgtgaaactatagaagaaaatgatggcacacacacctggttgacgagcacgacacggtggtcgtgcagctgctggatgatcatgtcgcacaccgtcgtcttccccgacgccgtcccacccgaaaccccttgaaaaatccaagagaaatcctcgcaaacagaggctaaaccaagcaaaaaacaatgccgacgaggaagggctcgaattagttactaccgatgacgaagggctgcctgagcgcggatggcgacacaagctccgcggcgtcggcggcgacgccgttggcgtagacggcgccgttggagtgggcggccgccgccgcggccgccttggcggaggaaggggaggacggggcggagggggaggagaggcggagcgcctcgaggcggagtccgctgaagtgcgcccccaccgccgagtccatgacgtcgtccaccgccttctccggcatgatctccccgccgccgccgccgccgatcgatctcgctgccttcgcgggttttggtcgggatcttctcgctcgcctctcactctctctcgatcggtttttaaaacgaaaataaaaaaaaaaagaaatgtagtttgggaatttcggataagtagtaatttgatggggaaaatgggccgggttttgtggtggggccgatggttgcatggacctggtgtttgtacaccgggtgtatgacaggtggggccggatgtgaaggtgtatgaaagctgggtctagggtggttgggatggggaagcgtacggttcagtggacaggggacatgaggcacagatgcttcctagcctggagctccactatttggaccacctggctgtcattgatctgtctcactcgagggagttactgcctccgtcccacagtaaataaagttttattttttttcttgcaacgttaatacaaatataaaaaaaaagttatacttaaaatacttttatgataaatcaagtcacaaataaaataaataataattttatattttttaaata

SEQ ID NO: 55683 - DNA, 5218 bp, Oryza sativa
ttcgttctaagatataaggattttttattttacacacaattactaagacagtgggtagaattaaaagaagaaaattatgatgggttgaaaaacaaaggtaagtgggaattaaacggtggaaggttgtaattgaatgaaaagtgattgttaataaagaagttatattttgagataaattttgaatgctagaagtagttataattttgagacgaaaggattcgatttctgcaaaactcatttgaatttggtggtttttttttcatataaatttgtcaaaagtttaaagggtaaacatggaacgatgaattcgtacaagtctgatgtcacatatttatgcagatgctccagccttggagatagatagatcgatagataaaccatgggattcacaatgtcttattccctctgaacagtatgggatgggattcatgtaaacctcgtgttaggaatcggatccaaaccgaaacacccagcgaccacatatgaagacaaagactgacaaattcagggcaggatgcaaatcatgcaaagtatcattaagctttacttgtgacttgtccatcaaaaacggacccaagagttttaacatttagtaacactggaatcagtgccaactgccaagggcacattttattatctctcaacagctcacgtagtgcaatctggggatctctgtaaagaagacgtgcagagtggccctagtttacaatagaaaccgagtacaaaaccacagatcagcttttgttctgagatccttcaacgctcttccttagtgccgatatgacctctcctggttcagctgctccaaatattgagcttccagcgacaatgcagttagccccagcagatgcagccacatcaatggtggaaggacccagaccaccatcaacctaaaacaaaaaacaaaaacgaatatgttttgataaaatggaactaaatagcccccgagcgtctgtacgattaaatcagtgtgctttagacaagaatcataaataacattgcaccacactacactgtgaagaacatattgtacctcgatgtcaagggatgggtacttctttctcagggcacgcacctaacgcaccatgtttcaaaatgatcagaatagttgtaaaacatagatacacaaaaatacagtataaactataaacaatcaggaatactaaatggcacttgatgcagtaataataccttttccatcatttctggcataaacttctgaccaccaaagccaggttcaactgtcataacaagaaccaattcaacaggattttctgcctccacctgaagaatttgttatcaatagaacaattgatgatgcgtgaaactcacagagcaagatatgcccacagccttaactagcattgtcagaaatcagtttcagataagtgagagtgaagttgctagccaacaatatgattataatgaattcaataggaaaaaaaggttaggcagtaaattgctagctccttatcacaagtatcttgagacctgatcattattttgttaaacaaatgtctcttgatcttcgatgcaggtcatgctgcagaaaacagacatgtaatgctggatatagtgaacgggaagttagctatgcctgaacatgggaagaacaggatttgcttatttaccaatcaaagaaataacatgcaaaatatattgccactagagtggtacagaatatacagcaaccaggactggtacatgatcaccgttcaagagttaagattcagaactacagagggaatatgcctggatactgagaacaggataactataaatgaaacaaattgcgcagctcgagtgtaaatgaacataagcttactcccagtttgagcacttattggatatgttaagaaaggcatttatgtcataattatgaactgcgtgtggaaatagagcatgggatctagagaagttatattgagcaattaccaggggaaaaacttcctccacaggagtgcctggcctcaatgatacacccggtcgcataccctttgctttgatactttggatgagttcttgccaattgtctgcaccaggtttttcgtaagacaaggaaaaccattaactgcttctcaacaattatatatttacctctggatacttctatatggaatgtgaaacctgaggcaccagcttttgctaatggttctacataatccgaaggattggtcaccataagatggcagtccaaatatgccctagaaaatttcagaatggtgagcattataggtacatataggaacaagagttaacaaggtgagtaaaagagcaccaccatacttggtgtgcttcctcaagctctgaatcactggagctccaatagtaagattaggaacaaagtgcctgcatatgtgaattagttctttagcactacaacaccaccacttcaatcgccattgatctatcatattctggtgtttgcaatacataaactcacccgtcctgcaagagcatatggagaaagaaaccataggtcagcaaaagccaagcttcgcattttcgattcataatcaataacacacaatcctcttgaaaaggaaaaaaagaagtgaaacgtgatcaccagagaaatcaggattaactgaaattgtcaccatgaaaaccaggctgttagaatgaagagacagaaactaacgcacacataacattctctcatagtctttgctctgaacatctatgagctatgctacactaactttccagtaagacatgaaacaggatatgtcgaacaaaaggtcattttgaacaaatattatcagattcctgcgatttagcacatatataagtgcatggtaactccaagctaaagctcaatcctaaccctgaccaaatcatcctacaaaccaaagggcacgcacggtcaaaagatttgggggggaaaccggatactactagagccactgctttcgcgcggatcagaaggtggggggcgaggcgagagggggatcgcacacgttaccatgatgtccatgtggagccagtcggcgccgaggcggaccatgcggtcggcctccgcggcgaggttggcgaagtccgacgagagcatcgacggcgctatcttcgccgccgccgccgccgccatgcctcctgcttgacctgctcccgaaccaattccgatagtgttgggtggtggtgtgtttggggggcggcgcgagtagaagtgcggtaggtgacgttcttcgggtaatcggcggccgctgggaatgggaaacgaagaggttcggtcgtgtgtatggcccacttgtcagtggcagggattgttttcacgaattattatctattttaataataaatttaatagtttaaataaagaactttaaagaaaagcttataacagtgagaaagtttgagtttagactttagagacgtgtaccagataattcatcacaataagtcaataacaatacgatgaattaacccagaagaacatgattaggctgaattaaaacaaagtactcaaagcaggcacggctggtcgctactcgctagttgccagcgtaaaagtagatcagcaagtagagcggcgatttatttttgtccgtcctgaaacacatgccttcccaatccgtccaaaaataaacgaaccaccattctaaaataaataaacaaacctagtcaataaacatatcgaatatcgagcaaacacaagcacagttcaacatatcgaccattgtgatatttctgacaataaatatgttcggtctcatttgcatcaaggcagcgattagttcaacaaagcaggttgggagaatcctggtacagaatagaagcaagaaagcacaggcgtttctatcaagttcagggcatgattccctggcgtatcagggagaatgttcgaagcaaatttgttgatgcaaatttgcggtaactgaagaacataatcgtcgatctagtccttcctcaggtcgatgtactctcgcttcgtcccagctttgttgatgacaactatctccagcttatcaccctgcaatatttgcatgcttcgagcgtcagtaaagtggcaaatacgacggtgtgaaacacattactgatgggattgcagtactgagatggtgaaacatacagtgtagatgtccctctcagttgccgatgcaaacacatccttcactaaatcgaccgcctctgtctccgacaaaggtgtgacggcatcctgcatgcatcagaaatattcttaggactagtggagctattcaaatcagcagttgagcacttatttctgggtggcacataaacttgcatgtcaaatcaaccagatgatcacatgacatgatcaatcataatgcacatgccaggtaacaaactagtaaaacttcagtgccttactcttgcagggagtaatagtggactaggtgattttagttggttgtccagcactggcatgatcaaagcagatcctgttccctgtgcactgtagccagtcctctcataggacccaactgcatcataggtgaaaacacatcctttccctgtgaaaataagatatgtgtttattagctattagagaaatatatatgcttcaacaaacacataaaacataaattggaaaaggagaaaaaacataaataaaaatctgcaccttaccttcactatcaagcccaccaagtacattgaaagcataatatgggaagaatcgcttgtagtacagagtgttggagagcagttgtgccatggcagggcagctcatccttttattgtgctggtgctggtacagctacaaaaacaaatgggcagcaataatttagatagcaatactgggagcatcctgaacattcagaagtgcatatttgcattagcttgaacacttccaagtgtataaaactataaacttctttactaacaaataatgccaataaattgcagcctagccagcttaacagagttcctgacgaaagggaagtttgatttgtgaaactaacagctgaccagctaggaggctgcgtagagaagcaaacagaaggaacaaaagaaaaaatatatatttctgacgcaagatgcaagtcaatcagttcatctgcctttagtatcaaaaattatactagcagcattaagtgcacaataaacaactatcatttcttgtattgatataacaacaaaaggtctaaacgaaagtacaaccctgttacagtggagaagttatggctcgggaacttaccaattctctggcagccaagttcttgtgcagagctttgatatcaccttggaagccggaaga

SEQ ID NO: 55684 - DNA, 1899 bp, Oryza sativa
  unsure (1)..(1899): unsure at all n locations
gtcttacattgtgaaacggagggagtaacacgcagtggcatgattaaaggtgctcagtaacttccatgcaagcagataataaatttagaagaaagtaacctatagcacctcaaaaatatatcggtgtaatcacaaactaaccatgccaaataaaagaagtgcagcgtattatcaccagtagacttaataaactaattgggtattagagaagtgcagcgtattatcaccagtagacttaataaactaattgtgtattatcacgtagttaacagtagggaacaataaaagcttttctgaacatgtttctataacaagtttgaaactacagaagaaactcaagtagttccaggagaaagtaatatcacatggtatggttctattggaccagattcagactagaattgagaacatggaaaaggctcaactaaatgaagtcatcaatgttaagttatacttgtatgtagttatgtagtgtacagtaagtgctatctacccttttcacaaaaccatgcttatggagactacattaggtaaaatcgccactcactcttggcaagattatgtgctaaaaacagaggtaccacccaaaagaaaatcgattttcaaaatcactgaacaaaggtaagccgaggtcaccaagcatggtaaaacaatcccaaaagacaaacaacatcagcaatttaaaacgacaagctttcatttcctcagcctatgttcatatcccagtgaatcattcgaacaaaccattcctatagatgaatgaaatagtgtacataaatgttctaacactgcctatcgaacaccctaagacaagggcaacactaaactcaaacaaaatatgagcatacactaggagttaaacccacgagcacgactacccaacaatgtctctgttctatggatcaagaaaatttactgattacatatcgtaccttaattgcaatactgtaaaaccatgttgtgtacagactgcacgagttaaaaaatagttgccctaaaattactacaatcaagaccttacgacaagtaaaccctactttatctccccaaaccaccccccaagaatccagccaccaaaccctagctaaatcaaccaaagccatcaccaaatcatcccccatcccaccaaccaattcgactcccaagcgcatcacaaacccacacagccctcccaatcaacaaaccctaagcccaaagcgggcagatcgggggccgcgattcggccgggacttacagctcgcagatcttggagtggtcgcgcgtgagaatgttgtatccgacggaaaggcgggtatcggcggccaccacgcagtagtctgcgccggcgatggccaagcacgtcctgtaggtatacacacaccaactacaacccgcggccgttgtcagcgagagccggaggaaaccacggcggcgggcggggatcgagtatgggggcttacccgccgttgttctcgtagacccagtcgccgcgccttgacatggnnngattggggagttaggttgttggtggtggtgggttgattgattgggatgtggtggaggagttgttggagtgtaggaggaggaggagagagagtattggaaaggaaatgctttggtgagttggggtttttttcacccttgatccgactttcatgaggccatgggctttggcctaaatttgtattgggtttggatatggattgggcatgggtcgggcagtggtttttaatgggctttttagcgaggccgctttccatggtgacggttgcgattgcatttatattgttttgggttgaaatgcgaggccccccccccccccaccccaccccgcgtttgaaacgaggaaattcagtttgggattcgatacaaaggccggcggtttgggagagcaccgaaatttggtcgatgaaattcgag

SEQ ID NO: 55685 - DNA, 2263 bp, Oryza sativa
atgtttccgtgccgtctgtttggttgccgtatgttcgggcatagtcagcgccgtttttttgacaaattgacccttttggaaaacttatttcgaaactaacccctgccaaaaacttcaaccaaaaataggccgtcgcctcagcgccaaacacattggcgctgacgttggccgtgtcaacgccaacgggactggcgctgacattgtgccaccgtggcggccgggccgatccccagctgacgtggcagctacctcagcgccaaccggactggcgctgaggtgggacttggccgcaacccccaaggcccagaccagcaagccttctggatggcttgcgggctaggacctcagcgccagccataatggcgctgaccatgggacactcagtgccagcccacctggcgctgaggtgggacttggccgcaacccccaaggcccagaccagcaagcctgctggatggcttgcgggctgggacctcagcgccagccataatggcgctgatagtgggacactcagcgccagcccacctggcgctgaggtgggacttggccgcaacccccaaggcctagaccagcaagcctgctggatggcttgcgggctgggacctcagcgccagtcataatggcgctgactgttggaaactcagcgccagcccacctggcgctgaggtgggacttggccgtttcggccgtggcccagcccagcaagccttctggatggctgggctgggacctcagcgccaggtgcactggcgctgagtttggacatgtcagcgccatttagcatggcgctgacgtcccagccctgctaaactttagcaaaactttgcacacaacagaggcaaacatcaaatcacagaaatttacaggcagtaatatatccagagaaccatacaaaacatacatccatccatcaatcccaacatcattccatacatccatagaatccatcaatacatccatatatgaagtccagtatatataagaaataaaaacatcccatcgatcctcgtctatacatccagtcgagtccatacatccagtccatacatccatcgaaccatgcatcaagtccatccatctatccatccatccattgaaccatgcactcacctcttcctacctctagtgcgaggacgaggcacgtcgggggtgtacctccagtcctgcgaaggagcccgccggcgtcatggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacattgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggat

SEQ ID NO: 55686 - DNA, 12093 bp, Oryza sativa
  unsure (1)..(12093): unsure at all n locations
nnnnnnnnnnnnnnnnnnnnnnnnnnnnnnnnnnnnnnnnnacacgctgtaaatgaacggaatgaagatcaatagatcatccgttaggtcgccttcggttttgaacaagccctacaaggtggtcaaagaaattctattcttttatttaccattgattggctatctgttgatgcttttattattcaaccaaactggtggaggagccaaggtcacagtaatcttattaaaggtggtacttatagaacttccatttttatcggtacatgtgagtgtgagctaatgtattccatgatgaaatgcattccatagcattaggattggatgctacagggaggtagatctcggctgtgtcatgtattccatgatgcaaagtcgatgttggctattgtctcggagttttaaatagatcgaagattattagaatagaatgtaatggtgtagcttctttgggcatgatgtacaagaacttttaactcaactgatttaagcgaaggatgtatatcttttactccattaaatgtatgttaacgtgccttgcacgtgcacgctaactagtgaatttgaaatgtgccactacataccccttctaaccattataaaaattttcttgaccaaaataccccttctgctttcttcttccttccctcaccataggagtaacttgcttgctgccttgccatggtcgagctcaggctgcccaacttgcttgcttgattacgttgacaacgacgacgttggcagtagcttagttagagctagtagctagctaggcaatgagcgtgaggagcccgtcgctagatgtcgacggcagcggcgctgagagtatatttgggtcgggtggcatcggcgggttcgcggctatagtgttggagcctccgtcggcgtgctcctcattgtctccaccgccgcactcaccatctacttatgtagcagcacgtccatgccgtggccgccactagcccacccatctccgagacttgtcctcctcgatcacgccgcggcgatgacgtcgaggccggcatcgacgacgcgacgttggaggcgttcacggccgtggtctacagtgaggctagaaaggctgcaacagcattgcggcggcgacgcagacatgctgcctcgtatgcctagagaactacggcgatgctgacgttctctgcgtgctgccgaacagcggcaacctgttccagctgacgccgctcgtcaaggtgacgccgctgtctcttggcattgctctatcgtgaatggaaaagagagatgaggggaaggaagaaggaagaaaaagggtattttggtcaagacaattttgataatgcttcgaaggggtatgcaatggcacatatcaaatttctgtaaaatcgcaatggtatggtttaaatttcatgaatagtattgacatatttctaaacggataaattaataatggcatggatccaattaacccttcattcaagtactggtttatatctctatttaatatcttttcggatgaaagaaatcgttagaattgcttgctgacatattggtaaagttaaaaaatatggaaaaggaaatttgacttgcctaaaattctgttttattgttaagtcacgaaacatatcacagcaagagtacataaaagacacgaaacagaataacatatgaaaacactagttcaggatggcttttgcgggaaaggcagatcacctcgttctatgtcatagcctgaaaataatttttgttttgcgaactttttttattttgggaactaaacatcgttctatatgatagcataaatttttattttgggactaaacaatgtatttttattttgaactaacaaggcatttgccatccatttttactattctactgtatgatgctttcttataactttaggacattttctttcaatttttattagaactttagggccttttctcgccaggttacctttaataaaaaagattagtttactttgttatccatttttactattatactgttgtaaattctgaagaatcatgaagataaaattaatactgtttttctctattcagttcaaagggaaatattcagttcaatgtttttctctattaagttcaaagggcaatattcagttcaatgtttgttattttttaagtctgatgtgaatgaaaacatactcaagagcattacattatctctctttatagtttttttatttttttataaataattatagcaattaacattatttttttcgttatttatatcctcttttctatactaagtcattttaatattttcctaatttaaatttttgtatcattaaccaatttcaatgaaaaatatattgatatccacaataacaaacaaaatactatactcatatgataaattaaagttatataacataacataagacatatgctctcgtatatagtaaaaccacaactcatttgagagcaatgtttatagtgcattatgatcattagattcattacacatgtctattttatgactttagctagcattgaatattatctatatttattatcagttaagagatttatatattatgttagggagaaaatatctcttttctaaaaactagttaagcaacatcgatgtcatggtaattactcatctaaaaattattactaactaatatttttactatgtttcagcaagtaatactaactcatgtaaaattaataaataatacttcagcatgtgcagatgaactagctagtagtgtttagttgcaacatatggtggctagtgctggcaataacattatcgaaaatagaggaatttaatgtgtgaggtattattcatgacaatgtttattttttagataaatgataaaaagtttggtgttcatttatttttaaaaaagagtatatgtagaatattcctttcaatgctacgcatcaaacttcactcttcacctcctccttcaatccaccctgccactcgcctacataccaccctctcatctaccgcgatcatccgttcgagatgcccgttgtcgagagctctaccgactacactgtctccatagctgtagcgtttgtggtggccaagggggcaccgactagcaggagatgctggaactggagtacatggctttcaaactcaaccccatggtagaggatgtcacgccctgataaatccatcccgaattaagaatcactttttaaaaggaataatattaaagagagaatctattctataccactgagtttgttcgagttcaacaattcgccattgacattatctttttctataacataccgacgactttatcaattgttctacaatacaccattagtttaggccttctttttaaaaatacccacaatacctctagtgagatataagattaacaattgatttatcttattagaagtttaaaaaattatgaaaattttaatgtggacccactacacaacatggaactttgtatacatgtttcaagttttttctggtatatttagtttttagaaaaaaaatatcttatgtggtatatgagagaaaatttgcttatacgagagatgtagtatatgaaagatgatttatattaaaaacatcaataaaaatattttatatagcatataacagataagttatattttctaatatatatatatatatatatatatatatatatatatatatatatatatataaaaacttgaaacttctatacaaacttccatgttgtgtaaggatgctacataaaagttttcatatttttttaaaacttctaattggataaatcaattgttgaacttgtatgtccataagggtattttaggtatttttaaaaagaatgtccagcctaatggcgtagtgtagaacaattgataaagtcatcgatatattatagaaggagacaatgtcgatggaaaatcgttgaactcgaacaatatagaatagattctctcattcattgttaaaagtctaagagaaatctcaaacactaaaatacatctaagaaaaattggaattctgcttggagtatttttagtaaattctccttcttctaaaatatctcctcaatttttacttgaattttcagagcacaagaaataatttaaatgcaacaaaaaccaatttcagagttaattaaaaatgaaaaacctaaaaataattctctcttctcttagggccatttttggcccaaagtccttgtctccctcagcccgtgggcgaagtcttcttctctctctcgggccgacctcctctcctccggcccatccttttcctcaagccggcccaccctccttccctctctcccttgggccgcctcggtccagctcctcccctcctcgctcggcccagctggccacgtcgtcttcctccagttgccgcctgtcccatcccggccgaaccctaccgccggcatgccgatctccctccccactcattctcctcctaattgaataccaaaaatcagttcctatcctcctcatcaattcccccacgttctccctcttaattcggccttgattcctgaatttactcttcgatgaactgccgccattgatggcagcccggcgagtactccggccgttcctctcctctccccggtcaatcccctcctcctccccggactataaaaaggagtcccgaccccctcctctctccccacataccactgccctcccccacctctctctagggatgtaagtggatagtcttgctacccgtataaaaacctatttgttagttcatttttcatatggtagtacaaaatttagaaaaaaaaatgaactagaagtgagataagcgggctaaaaaaaacccgcttgcccgccccgcttgcatccctacctctctccctggccgccgcgccgccttcttttcacgtcgctaccgttgcgcaactctgaccgcccctcgccggcggtcgggacgtcctcggagcccggcgtcgccaccatccgcttcgcagcgacctcctcttccccggcctcgcctccgttccgcccgaggccagctggtgcgccggggacgccgacgtccaaaacatcgttatcctccagctttggcaagccctccccgtcgagctgggcgctgccagcccgtgctgtcgctgccgacggtctcgcctcactgtgcttgtccccggcatccccttccctaagcccgaagctcgctggaagcctgttctcgccggcgaacagtgaggacaccatcgtcttcttcctccagcagccccctcccttctcaccggagcgcggcctcactgcgcccgctgctgtcagctgaacctcgtcgccctctccctcggctgcaccttctcttcaagcgaagacccttggaacgtcaccccgtcactgtcgccttcctccggtcgccgttcctgcccagatgaagtgttgcccgtcatcatcgtcgtcaagtccgcagcaccaagtcctccagcgtccgcctcttcgtcaagcccgaagatcattggagccatcccctcgtcgtcgacccgttcgtctccgtcaccctcctccgttcgtcgtcgccgtgccatggtcgtcgccggttgtcatcgttgttcccttcccatgtcgtgcccgtggtgagaacctcttcccttgctaccttatcctcgtcctccccatgtggtcgccgcgtggattgcccacgtgtgtagctcacgtggtagtcccggctgccaattgctcgatcatttctttcttcgagcgatattccattgcgcataatttaatagtataataataataataattaaataactcagaaatatccactttaattgcacttaaaattcggatggttgtttctcggccatgcgagctcctaattgacccgtttaaattgtttaatttttgttataacttaaaagaacccatgtttgttgtttttttgtgttgtcttcatttctttcttagagttgtagccctgctttgttgttttgttgttcgtgtagttgtcgtcgtttcggaagttctcgaagtgcagatcaagtcgtcagtagaccttctcttcgagcaaggcaagtcataccatattcgttgaatatattgaatcccattattgcaaaaacttatgttgttttacttctatatgcatcattaaaatgagattcgctcgaattctactctcacgcagcgggtattcgctacaatgccattttggctatttgttgcatttacaaatcatttttaaggcaaccatgctgacgccgctgccgaccggcaaacgtgccgccgcctccccaacctagcacgcgacctctccacgaaccgagctgcacctcctcccctgaccgcgccacccaaaccttaggccacaccggctgcgccgccacccgcggctcgtctcctcgctaagccgcgctgtagcaaccggctgccgcctgctcaacattttaaggagggggaagggcaggggcgcaaatggcgggggtagagaggtggcgcaccgcgctaggaggcggcggcggcaccttagcctagtcgccttctctcctctcgctcgctcgtgagtgcgtgttgttggtccagagagtgagatgcgtggatatgtggtttggttcaaccacaaccaggggcaaaactgttcgagaaataattgttttgatgaaaaatgttttgcaaatacaacaaacaaccaaaatagtatagtagcgaatgcgcactgcttgagagtggcattcgagtaaaacctattttaacgatggtattctagcgaagtcggttcttaaggatcacccatatacaaaattctctagtggcagtcgaatacagtttgggcgtttcctgattcagtcgtcatgtaatggcattatggcagctacaccccttttcatgttcggatcggcgtagaaatagattcaattttcgctggagttccgatcagcgtggagacgaaccggaatctgatgcagttcttgctcgcgtcggcgtggaggttggatccataaataccggaaggtcagattgtttgcaagcctaatattcccttgccgatttatagaagaacaagtattctgaacaagtattaatggaaacggccgcaggagcaggccctggttggcctgagctgccgatggacatgttgttggagattctgcggctgctcgagtgcccagatgtgatgcgctgtgccgccgtttgcacggcttggcgcgcggcgtaccgcgacttgcgtcgccgtggcattgcagccagccgccagaccccctgcttaatctatagatcggctgctgctggcctgaacgccattggcatgtacagcctttctgaccagaggccctacacgatccccatccctgaccccatcagcgagcagcactggttcggctcctccaacggttggctgataacagctgactgccggtctgacatcatactgctcaaccccatcaccggccgccggatcgctcttcctccggcgaccaccatgcagcatgtcacgctggtcctgaacgaggagggattcttgacaagtacgaggtctccttctacgattggagggatccaagcaaagagcacagcgagcccgacacatactccctggaagaataccgtcgctatatgtacactaagttagtgttgtcttcagatccgtcttcagatgatgactgcatcgccatgctcatccatcagccatatgatcagctctcttttgccaaggtcggaggcaatagttggaattggctcgcagtcgattatactttcgttgactgtatctaccatgacggatggttctacgcggtaacttccatgggagtaattcatgccttcaatcttcatgggccttccgttgtgcacaaaacaatctttccgaggatccaagacaataatatgcaccaggaatacatcgttcaggctccatgggggggccttcttcggatctacagaacagtagacatccttgaaaaagagcaacgacacaaccaagtagttcgtacattggggttcagagtgtacagggtcagtttggatgagcagaagcttgtgaggatgacaggaattggtgaacacgctctctttgttgggcacaatgcttcggtttgcctttctgttaaggaccatcccactttgatgccgaatcatgtttacttcactgatgacgattttgaaacagttttttctttcaaaagttctcgtcgtgatgtaggagtgtgcaacatagagaataacactgtcacaaaagtggtatatcctgaactttggatatattcactgcctcccatttggtttactcctagtctcataggataagtgtgcattcagttatcttaataaatacagatgtttaccaagctttcattgatatagtctctataaaccaccctttcttatgatttcacattttgttattcgaattgttattatcagtgtgacagtgttatcaacggtgttataaactaccttttgattactaactccgctcatcttagttttctaatgtaatacaaacccatctgtaataggtttgtcactaacttctccagctttgctgtgcattttttatgccagcatgcttttccagctattttggtatgtgtgaattacttcggttaatttatctatggttgtgactccgtcatgtttgatgaacccaaaagagttttgttaataactattgaaaattacatggatcattctaatttttgcctagtatgttagttgcaagatatgcttcatgagatcccagtcatagttattaattgttctgaaagaagctctcacatattaaaagatgatgacattattttcttttctgaagacaagcctcttgttttaggaaaaaatatgaattatccctccaaactatcacggtcgatcgaattacctccatgaactcgacagcgtggcaaaaaaatattttacaaaataatggacccacatgtaagtctctatatctcctctctttctcttctactccctctgtttcacaatgtaagtcattctagcatttcccatattcatattgatgtcaatgaatatatatatatatatatatatatatagattcattaatatcaatatgaatgtgggaaatgctagaataacttatattgtgaaacggaggaagtacctccatctctacctacacagggcggcggcggagagtggaaaccttgtcgccgtccgccctgacatcgtcaggggaggcgtcgactgctcgctagtgaccgccgaacttccaggtccatgacaaccacatgtccatgtcgtgggaccacatcaaggcgtcccagctcgccggcttcgacgtcgtggtcaacaccttcaccgcgctatagaaacgctacggcgacaagttcagccatgtcgatgcgcgccttgcctacttcatcggcctcgttagccagccatcgcacgttgcagccgtgcaccgcagcaacgagggtggagatggagacgttgagaaaaactgcctccacagcgctaccgcgcaggcccaagcatcatacggcggaggtgtttatctccaccgtgcaagtgaagtcattgtcggagaagagggaggagaacccacccgcgacctggacagggaagcggtccctgccatggcatgcgcacgcgcgtggtacgctgcgacgttgccgctcctgacggctagctcagaaagctgatccgggccgttgtacacccgcctgagctgacctggcgcggcggacggccagcagaaaagcgcgagtgccccaacttgcaacgcgtcgatgaacgcccctcccccgctagacacctgggagaacctcacgaacggcgcgaagcgacagcggcagcagaggagttggttgcgagggcgcagtacacggtggagatcccctccgtgacggtgtaggccgtggggctggcagcgacgacaagtgtggaggatgaggcgtgggcgatgaggtggagcggcgcaaggaggagacaggtcattggatgaggtgggcggcgacggcgatggtagggaggctggtggagacgaggcgtcagcggcaaggagatcgatgggggccgggcgacgagtcctttagatccgccctccgtgccctcgcctcgcacgtcgcccaccgccgtggccttccgcccacctctcccgccgtcgacggcgtcctctacttcaccagtgcccatgtgacgaggtcggggaagaggggaaagagagaggcgagagagtctcatgggtaggccccactatgttttttaaagaaaaatgctgaccgaattgccagcgtacgccgtgtaggacaaaactactccggattgggttgagggggcttattcgtccggtacagactgttcagggtttaaaatgtctggttttatggtttaaggggtaattcggactgatatgatagtttatggggtaattcatactttttcccttgttttattacttcttatgcagctttgcgcacatgtgaaagcattgtgattttcgtcacgcctttaacttgcacttccagtacattcttgttccattgtgttcagtcaatacctcactcagcatatggcagcatgcaggatatgcataattattcaactaaacttcagagacatctcaaattttacaacatgttttcagcatgattttgaagaccataaactaatctcccccattattttggtcctgaaaacctatcaggaagaaagatgtaagcaacaaattattaactaaaaaagatttacgatgtcacaggtaagaaatcagtaagtagagttgagaaatgtgagatacactataactggttaagggcatctcagggaacgaaattgataatacaaacaaaagctttataggtcaggtgaactccataactggttgcatcatggacatgcatatgtagttaaaagagttgcagatttagaatcaactgttatgtattcataatgaaatggggctagaaaaggcgaactctgaagaaacttgacaaaattacaaagaaaacaagaaagaggctggagtagttcaatatgcaaaagctaaaggatgaaccgtgtttacttatagatctggctggatactccgtccattaagatggtaggttctaacagtactctctcttattcatatataccagcataaatggaagtaatagatgactaaatgttttacatttcctaattcccatgcttaaagtaattgattaacttgcattccgaactgtacctgttttcatgagattgggcatcatccatataggaggcaaccaacttttccaaggttcagggctaaccacatttgatagagagttattttccaagctgtaaattccaacatcccgtcgcttatgtctaaactcaagtagccatagatactcatcgtcggtaatatagacatgatttggcatcaacatatggcaatccttcacaggaaggcaggaggaagtattatgcccaataaacagcgcataatcacctatgcctgtcagtttgacaagcttctgttcaccaatatcagccttgtatactacaatgtcagatgtatatagctctgtttcttctatttcaggattcccattgcgcggaattattgtcatcctgtttactattaggatatcgccccatggagattgaactatatacatctgttcataccctagtgttagcatatctttaagaattcttttgtgtacgacagatggcccattcagattgaaggcatccactgctcctaaaacactgacggtgtaaaaccatcccttatgatagatgcaatcagtataaaacaaaccaataggaatccaattccaatgatcttctcctactcttgcaaacgagagctgtgaatacggttgatggatgagcatgacaatgcagtcacctgaagatggattggacgacaacattgccttgtaatagacttcacgatactcaggcaaatcaaattcatatggtgtttcctccactcttggaatcttgccattatagtatggcatctcatacttgtcgagaaccccatcttgattgaatataggcttgatatgctccatggtcgtcaccggcggcaatgcaatctgttcgccagtgattggattaagaaggatcagattagacttatcatcagcagtgacaatctagccatgagatgagccgatccaggtccggttgctgatgggagggtcagggagcgggattgtgtactccctccgctccaagagac

SEQ ID NO: 55687 - DNA, 1178 bp, Oryza sativa
aaagtgcgttggtatagagagagatgaggaggaggatttgggtaaggatgctcaccagaatgcggcggaagcatagggacaaccgacggcgccattactcgcgggagggatggatggggatcggcgcaggcagctgcgggcgtcggagtcggagccgacgccgagcggaacgggaaaaagaaacaccgcccgcactcgatttcctctattttttttttctttttttcgactactagagaaaaaaggttgataaaagagagcatatggtcaataaaagctgagtgagacagtattgtggaaaatctgaaaagcaaaatataacaaaaacaaaaaggcgtgtatgtgtgttggtatttctacagatagaagaatccataagtacatggatgtaccgatgtagcacttcctctacggagtattccaaggttatcgaatcatagggaacgtgtgtggtcaaatcttccttcggtttatcgaggacaccaagcagatgataggccaggatatagaggattttctagtgagaaacagactttaatcctaatgcaatacttcatgcactagcaacccgctgttcccagatgtcgctctactacgtacccggacagggaggacttgggtgatcttgaggcctgtcaccacctctatacctacctcaaacacatactgtgggatacgcagcaattactggataacaattgactaaacaccacgtctaaacaattaatatctactttaatgtttataactcaccaaaacaatcactatatttcagttgattatagtgaacaataatcccgtatgttacttaggaactaaccaagagataattctcacaagataaatctaaattactcaagaagaatattatattgaattcagagtaataatcagaataaaagaaataggagaagattaccgacaactctggaattcttctgacttcttctactctactctcttcctattctagtatacaatatagtacaatagagcctcttataattcatctcaagcttggaagtgtgtgagtgaagtgagggagtgatgtctttatatagaggtaggtatgacggttggcgaaggagaaatgtccaaagtgccctccaaccgtcattagggatgcatctggaacgtccacgccaaaccccacatccaacggtcgagatggtggttcg

SEQ ID NO: 55688 - DNA, 49795 bp, Oryza sativa
ggtattttgggctgcttctctgatgttttgatgaagtttataacccatccttgtatgtatacataattctcctcactttagtctagatttcctcccaacatcggggtttatcacctgcatacaaatatacaccaacacttatggaatttgtgagattaagcatctatcactatgttggatgttttattatctgaactttatgtagatgttggcggtatagaatcgacatttaacagttgccaacaatgtgaagattggaaaaatatatatatgaatttttaagtagatactccctcatgtattttatatacgtatggcctttcgtcttattaaaaaattaattattatttattttgttataaattgatttatcatcaaagattcttcaagcattactttatatatttattttagtttatatttgtttaaataatactatgggattaactatatatttatcgtcaatttttttttaaaaaaatgacagatataaatatagtacaatcgtgatgtaattacatataagttgtatgtaacttttaaaaatcccgaggtaatatgttgccaaatcccctaacacgtgcgtggggtgtacttttctgctacctccctggcatgaattttaaagcaaatagaacggttcaaaattatattatagttacatgctagttatagttacactagaatggtactatatttacagttgtcaaatttttaattatcgacaaatatatagtaaaatagtaagaggaatgattaaaatatgtctaaagttaatggcgtcgtatattaaaaaccggggagagtgtatttaaaaccatatataagaatatatagggataaggaagagatagatatttatcccaagttgacagatgaagctgtagataaacattactatatatcaaatattaattcacataaataaaggaaataaaaacaaaaaaaatattaactcaaggttatacgctgttccgatcaatataataatataatatggtggtttcaaaatatttctagatttgatcacttacattttgatcaaatttattctgctttagtatcatgttgctcactttgcatagtgccagtccatgtttttcttctaatttattagtttccgttttttccgtggagtatatttttttactttgccagagcctacagtaaaaataaaagaaacagaaaaattaatagaaaaataaaaagaataggaataggaaaggtcggtttccatgttttggaattcatctctgatccgctgaggaagtgtgcagggtttacgcctgcttttggtaatcgtcttgatcgttatgatcctttggagttaagactagggttttgtcgtacacctggtctctttcaatcttgggaagtctggaaatcaaagaggaagtttagtccgggtcggtttccttgggatgcaaaagggatatttccaatctcgtttgatctccgctataaagttgtggtattcggcaggccagtaatacaatacaaagttctccaaggttttcccctcctggttgcaatttagggtttctacctcataagctcaaaggacgatccatggcggttgctgacggtgggggtgataaagggattgtcactttgatgatcacccacccgaagctgatcggcggtgacgtgggtgtacctgtgggatcggtagatttgggggaacaagagtcgatgcaagcgtcggtggttaaaacagggcttgtgatggattctgataccggggtgtccatgggaccagagatttttacagaaggagaggtgcttgaagaggaggaagatgtgattgaggtggttctggaggaagatgaagttcagaaagcaggatagtggacagttctcgcaaggttccgaatcaggtggctttgttcgaggatatgcggagggcgtcgagattccattcggacatgagctacaagtcgctaagggataacatgtttatcataacctttactgtagaaggtgattatgagtttgtcatccaaggggggccatggatacacagaggagatgctcttctagtggccagttttgatggattaacaagcctatcgtctgttccactagagtttgtacctatttgggtcaggatttatgacttcccacttgtgctgatgacaaaagccagggtgaatcgtatggtagcaaactggggcgtgttcgtgaggtggatgttggtgacgatgggaggaataggcatgacatcttcagaataagggtggatcttttggttaagcgacctttaaagttgaagctggccataaaaatctctgtccaaggcaaggaggtaacacgaaagtttgatctccgttatgagagggttccacacttctgttttatctgtggtttcattggtcactcggataaagagtgtgtgaaacgtactgcaaatgaagatcacccttttcagttttatgcggaactgcgttactcccctctaaaaccttttgagaggaaggtgtgcaggtgttatgaaaatagatgcacaacggagacacagatttttacgtggaaaacccttgcgtgaaaaaactacgggcgccgaccggcaatgatcactatagaggagttgattataaacgtaggggaataacaatgggaacgtcaccccttcccgtacggtttacaagagtatatataggagataatagaaagacacctaataggatagacatgaagtcctagtaggaaattcatccgaatatattgtgggcccaaaattcagatcaaatatttaacaatctccaccttgagacgaattttctcttgtagcataaaaacatcaatcaccgaacatacctcatgtaggtaaaatcaccgcgcgtcaaatagtctctaggactatactgtaacaccaaccaagcttgagcaaagttcaaacttagtagcaggaattggctttgtcatcatatcagttggattatcattagtacttattttgcataccttgacatcaccttcagtaatcacacttcgaataaagtgatatctcatatcaatgtgctttgttctctcatggaaaatttgatcctttgtaaggcatgttgcactttaactatcacaaaatatatcaatgcaagacgtaactccacaaagctcggtgtacaaacctttaagccaaatagcttctttacaagcttcagaaatagccatatactctgcttcagtagtagataaggcaacagttgcttgcaaacttgccttctaactaacaacacatcccccaatagtgaaaacataacctgtgagcgatcttctcctatccaaatctctagcaaaatctgaatccacataatcaacaagtccatctctagatcttccaaactccaaacaagcactagatgtaccacgtaggtatatgaaaatacactgaacagctttccaatgctctttgtcaggattagccatgtatctactgacaacactcaatgtgtcgacgggggatacccgtagaccggatatagagggtattggggtccgttggtacgaggatctacgtagtacggcatcaagcaaacaaaagacaaggattatactggttcaggccctttggtaggtaatagccctaatccagttgatatgggattatatgatggaaaccacagattacaatgggaatagcagaactccatgataccgatgagaccgtagtcgagttggtccgactagatctcccggtgacttggctcccgcgggctccggctccataggctgtggtgggtgtgttggcggtgatattcgatgccttaggtcctgcccagggggtcccttatataccgcgggtcagttgatctccaagtagtactcggagatatcggacctctcacgatatggtaaagacctagtcttgtccgagtagaactccttccatccgtagataccatccctatcacgtgatagatttccttaatgtatacggaaactatccatatacgcgcgggtataccgtatcagtatacaacgtacatccaaggatagagggtataccatatccgtaaccctgacacaatgcatgtgataagtcaggacgagaacataccatggcatacataagtgaaccaaatgcaattgaatatggaaatctagacatgtactcaatatcataatctgactatggaaatctgaagataatctggaatgtgcagctcaaggagtactcactggttttgcatcatgcatattgaaacgacaaagaactttttcaatataacctttctgactaagatataacttgctagaatgtctttctctagtaatttccataccgagaattttcttcgctgcacccaaatccttcatctcaaattcactactcaattgtgccttcaactttgctatctctgatttgtcttttgcagcaatcaacatatcatcaacataaagaagcaaatatatagctgaaccatcaacaattttgagacaaacacagctatcataattggatcttctaaacttttgagaaagcatgaaagagtcaaatctcttataccactgtctaggtggctgcttcaacccataaagagatttcttcaacctacagactatgttctcttttccaggaacaacaaaaccttcaggttgctccatataaatgtcctcttctaactccccatgtaaaaatgtagtcttaacatccatttgctttagttcataatcatgcattgtaacaatattgagtaaagtgcgaattgaattatgcttcacaacaggggaaaagacatcattgaaatcaattcctgaaatctggctataacctttagcaactaacattgctttgtatcttgcctaatcacttggagatataccttcctttcttgtgaagatccacttgcaacagataggtttcttctcctttggcaacttcaccaattcccaagtatgattcttttcaagttatccatctattgtaatcatcagaaacaatagcctcagaatatgtagaatgttttgcattaccttcaatttattctgccacactcaaagtataagcaactatgttcacttctttaatataaacttacgaggagacacaaattaacatgctcagaatttcagatagaacattgagaggcattttgtagcattaatacaaaccacataatgctagcagtgaacatgtacaccgtggtgattttcatcatcacaaaatttagaagagccaccttacaatccgactggatgagtgtcaagcatgcaaggaatgtcaaaagcaagaaacattgtaggcatcaagatgtttgactccgtcagaagcacttagttggcagaggtgatcctatcaggattcaggacatacaccaaactgaacgaactatattttcttttgattaatatattttcaaacactcaatcaaactctgtagtacgttccagaaatatttggtttgcacttcttcatcatttaagcagcaaatgctacactacaaccaaaccaagtagtaccaaattaaacaacatttgctcacctggtgaggggggaaacgatgagctcgacattggggaggtagagatttggactgaggggaagcatcacctgtatgtagaagaggagttgccctggattggggagaccgtgcactggacggatggccggtggtgccctgaacggaggacggcgaggtgggcgatgatttgcggcggccccgagcggtggagacggcggagagagacccgagagacggcggaggcgagggatccgggtggagggcgcggtgatttgccggtgggtggggaggcggtgctcgttcctgacgcggaggggagggatgcagacgaggcgcagcgattgcggaagagagggagatgcgggagaggatgcggatcctgacgcactgtcgcgccgatgcggaggaggcgcggtgattgcggcgagagagacagagagaggggggctgtgggagaggatgaggagcgacatgcgcgcatccgggacgttggatccaaattcttccgatgagtttcgaccgttggatatgtgatatgatgaatgatgaatgagtaaaaccatttattcaactatagggtagatatattttccggttctcttgtctttgtcctgtagtttccaacactcagagatatcatgtccatctctcttgcaatatttgcatgacttatacctgcctctggactttgatctcccatgatagatacttgaacttttatctcttgatttgctgtttgtgttcttctcctgttgcctacgccaaacaaccaagccttctgcttgtgaatttgaatcttcagagggtaccatcttcttcatcttttctttggcatgcaaagcaccataaacttctttcaaagttagattatcacggctataaagaatagtatccctgaagtttgcatatgagctaggcaatgaacacaatagaataaggccaaaatcctcttcatcatactttacctccatagactcaaggtcagcaacaatttccttgaatgtggagagatggtccatcacagacccatcatcttgcgacttgtgcaaaaataatttttgcttcaggtgcatcttactggtcagatccttagtcatgcatatctattctagcttcaaccacagcctagcggctgtcttctccttaagcacctcctgcaaaatattgttagatagatgaagatgaatatataacatagccttacgatcccttttcttcttatcatcagaccaatcctgtgtccttttgttatatccagaaagcgcatcatcgaggtcttgttgtgcaagaatggctcgcatcttcacttgccaaagtgagaatcttgtgtcttggtccagaagtggtagatcatatttcaaactcaccatgagaattaatcctgaatttactggtaagaaatttaggtaaaccttgcaaaaacgtgaacctctggtgcactttccgtgtgcacgtagcgaagtatgtagatcaactaggtacacaagcttggtagccatagaaattttcctctggaaaaatcaagctctcggttgatttgtttttttcacctcaggaaccatgcgctggtagagatggccttcttctgctgctgctttaaccctgcgctgcttctgtccgactccgatggcaatttcgacgagaccgacgaacgatatgcgccgccgccaccgcgaatcaaattgatctcccctattggaaaaacatgccggtgactgggattagcagattgatctccaatgctctgataccacttgttataaaaatagatgcacaacggagacatgaatttttatgtggaaaacccttgcgggaaaaaaccatgggcgccgactggcaatgatcactatagaagagttgattacaaacgtaggggaataacaataggaacgtcaccccttctcgtacggcttacaagagtatattaggagataatagaaagacacctaataggatagacatggagtcctactaggaaattaatctgaatatattgtgggcccgaaattcggatcacatatttaacagcagggtcaaggctaccccatctgaagggcccgtaacttgttcttttgggggagctgggagcgctagttcttcgtcttcaaggaggaagcaaggagatcatggggctaaggagatcccggctagagtggatgctcatgatggttttgatgtaagagaaagtgcaggagataagaagatagatgaacaattggctaaacatactcagaacctcaaggtagatacaaagcagaagcaaccgagttcgacacatggggaggaacctgtacttcagggtgaaggggttgtgaaatcaactactgctatatcggaatctgagatgattccaactataaagaacattgaccagcaggtttcctctggcgatgggtcatcagaggatatgattagggataaccgtaaaagaagtcaagtgcaaggggtgcgcagaaggctggccgtgtcaagcaagcgctgctagagtatcagcaaacggtggagagtggtggcaactcctctttagaaccggtgagcgcttctcgggctttgaagcggatcaggaaatcggttgaggggacaggtaggagtgatatggaggcaaccagccctggggctgctggtcaactgacgggacctgtgagagggtttcgtcaggagcaatgagttgcctagtttggaactgtcgtggtatagggaacgctacaatagttcgtgatctttgtgccttggtgaaagaggcgggttcccacattgtgtccttaagagaaactagacaaaaagtggaaaaggttagatgtttgcgttcaagattgggacttaaaggttttgtgggtgtcaatagtgaggggatgagtggggggcttgctttgttttggcataagtcagtttgtatggaagttaatgttttgaacgaaaggtttattgatgcttatgtgcgattggtcagtgatggtccggtgtggcatgtaacttttgtatatggtgaaccgagagtggaacatagacattgcatgtgggatttgttgaaggcaattaaacaatcatctcctctgccatggttagttttgggagattttaatgtggcactctggcaatttgagcacttttctgctaagaggaggggtgaatctcatatgcaagcgtttcaggatgttttgcaaacttgtcaattgtttgaccatggtttttcaagagttccctttacttatgataatagaagagaaggacgtagtaatgttcgggtgcgccttgatcgtgccctggctgatgagagctggagggacatctttagcgattcccaggttgttcacttgacatcaccgtgttcagaccgtaaccccatattgttaaggttctcctcggaacaagacaaggcctaccggaagaagtgcttgcattatgagatttgctaggaacgagaagctacatcagaggaaataatcaaggagtcttgggacgacacaggccaaaaattacatccaggtgatattaacgttactctgtctaaggtcatggggacccttcggacatggagtaaggtgaagtttaagaatgttggaaaggaacttgaaaaaacaaggaagcaacttgcagggttgatagagaggaatgcagacaggaaggaaattagacaagctactgatcgtatgaatgaattgttatatagagaagagatgctgtggttgcaaagatcctgaattaattggttaaaggaaggagaccgtaatacaaatttcttcaatagtagaatggtctggagggctaagaagaatagaatcacaaaaatccgagttaatgatggtactgtttacagtacgacaaaagaaatggagcaacttgctacagaatatttaaaaacatctatactgcagacccgtctttggaccattccagggtttcacggttatttcaacagaaggttacttctgaaatgaatgtagcgttgtgtaaagattttactgaggatgaaatatcagatgtgctatttcagattggccctttgaaggctcctggaccggatggttccctataagattctatcggagaaactgggcacatatcaaggctgatgtggtgaatgctgtgaaggagttgtttcaatcgggacatatgccggaggggatcaatgagacttctattgttctaataccaacggtaaatcaaccagtcgacttgaaagatttcaggccaattagtttgtgtaatgttatctacaaaattgtttcaaaatgcttggtgaacagacttaggccgattctggatgagttgatttcagtgaatcaaagcgcctttgtgccgggacggatgatcacgaacaatgcacttcttgccttcgaatgctttcaccgcatccagaagaatagacaacctaataaggcaacatgcgcttacaagctggatctatcgaaagcttatgatcgtgtagattggaagttcttggagcaggcaatgtacaagttgtgttttgctcaccggtgggtaagttggattatgacgtgtatatccacggtgaggtttgcagtcaaatttcatggaacccttctgaacacatttgctccaactcgagggttgcggcaaggagatccgttgtcaccctttctcttccttttcttttcatggttgataggttgtctttactgatggatgaaaaaatttatcaaggagcgatcactccggtgaaggtctgccggagtgcgccaggcatttcacatctgctttttgcagacgacacaattctgtttttccaagcagagaatggacaagcaaagattataaaggaggtgctagctaactatgctacaggaactggataactcattaatccggctaagtgctctattatgtttggtgattcttgccctttagattgccaagaggctatcataacaaccctgcaaattgggagaaggggttttgaggataaatatttggggtttcttacacctgaaggaagaatgcacaaagggaaattttaaagtttgcaagagaaaatctggaagaggattatgttgtggggagagaacttcttgtccagcggtaggaaggaaatcatgcttaaaaatgccattcaagcaattccagtgtatgtgatgagtctcttcaagctgcctgcttctgtttgtgatgatcttaacaaaatttcacgtaattgttcgtggggagtcgataaagggaaaaggagaacccattagaaattttggaatcatgtcacgagacccaaacaatctggtggtttaggcttaaaggattttagattgttcaattaggctctattagctagacaggcttggcgactgatagactgtctagacagcttatgtgtgagagtgttaaaagcaaagtatctccttaatagatacaagcttcggtggtaatgtttcgccagggtggagatcaataattcatggtttggagttgcttaagaaaggaattgtctggcgagtcggtgatgggcgttcaatccgtatctagcgagattcgtggttaccgcagaatcacacacgaagtcatataatagtgaaaaggaactacagagagagatggatgttcggatttgatttccgaaacagggacctaggatgagcaactagtgaatcataccattctaccagttgatgctgaattgatcctgaaaatctggttgtcatctcgtactgaaaaggattttttggcctggcatccagataaatgaggcatcttctcggtgagaagtgcttatagcctagctctgttgttggcaagcgaggagtgtagctctagctcttcggaagtgagtgttaacaaagtgtggaaccaaatctggagctgcaatgttcctcaaaaggtcaaaatattttatgaagagcagccactaattgtttctaaagagacggtaagcaacactgcataaagctaaatggtatgcaatttatgctcaattccctcatatggttttattgtttctctacgatggtggaaagattgatggccaagctcaactccctcatttattgtttctttatgatggtggaaagattgatggccagtgaagggccaggctaggagtggtaagtttttgtgagatacatgaccatttaatgttgttcaatgtttgttatctttaaactctgatgtgaatgaagacatactcaagagcattaccttatctctctctatagttttttattatgatttttttataaataattatagcaattaacattgttttttcgttatttatatcatcttttctatactaagtcattttaatatttttctaatttaaatttctgtaacattaaccgatttcaaagaaaaatacattcatatccacaataacaaacaaaatgttatactcatatgataaatttgaagtcatgtaacataacataagacatatgctctcgtatgtactaaaaccacatctcatttgagagcaatgtttatagtgcattatgttcattagattcataacaaatgtctattttatgactttatgtagcattgaatattatcaacctgaggccaacaatggaagaaaatttggaggacaaagatgcatcaatttgccagcctgtgctaggttcatctgcatctgatgggtgtatttccatctcaggtaatgctggaaattaggattacttctctattactacctggaaattaggattacttctctatccaaaacattgaagtcgtctgactccggaacttatttaatttttcataccctttttttgcgccttgcatgctttctataagctgatgatatttctatgtactgctttttatttaaacagttcagaaaaaaagtgggcgaaatatttatttagtttataccatgctaaatggttcttcaaacagttcacagcaaaaatgctcagcacactctaccatgtgcatataccatgatttgttttttttccgtgtacatgttccaccaattccgtaaattgggcaacctatgctacttagatagatcttaataaatcccttggtttgaatgcctacttttttttttgtttctcacgtgccatgcatggatgcgaaatgtgcagatggttttgctgccggctgataaaccattgcagcattaggagaggctatctactatcaaatctgcataacatatatagtacatgctaaactgctcatgggccaacgatgactcatatatatatttgacggaagtttacatgaagatttgaaaattttctttcccattcatttttcaaagcttaggcactcatgaggtgcggctttagctttggactgcgcaatatggagcccagtctatttggagaatgagcttgggccaccttatttgagaacttttagggtataatatattaccagtatatactggcagtatataaaagggcatattagaaatttgatagaaaataaaacaacaaatttttggttcaaattgaatctaattgagagtacccggtcctggatcttattgtgcactaggggaggagcatcctgagcgctatttgatgacaaagcacgtgacgatagcacaatttgatgatagaataacgaagaaaagacaaaattaccctttcaaactttatactgcaatctaattaaataaaaaattaaatcaatctacaccgttagatcatatatacttgcagtatatactatgagtatattgtaccctaaaaatcctcccttatttaggccagctcttttgtctacctgaggcaaattaaatgtgttttggctaatttttggttccggatggtatttgcatctcgtcagtgattgtgatgatactgaccaaaatgtattcgccaagagattaattgtagtgcaatgttttacgttatacgagttgttcaatcaaaatgagtcctatgaacactactgatatacttcctccattccaaaatgttttaaaaaaagaaatagagggagtattaggctctcgaaaggctctcattttgttgaatcgttgttcgtcgtagatagtactcctatataacaacttatgtggtactgttctgaataaaaatgtgcttctggtgatgtttcatttggactttggacttttctcaatcttaaggttggactttaggaagttgaggcccaagacatattttcagtcttcagtttggactatctagagctggccagcagcggtcagagaaattcctgttcatgcctgccaaccagttatcgttatttttctgaacacgatcagtcagctccataattaagcacatcgtcctcgtcgttttgcataattttttttcaaaaagattagtacttggtcaattatgtcatcttatattctatatagtagcggcaggcataatgcttcatctgatctgacaaaggcagccatgctgacaaaggccatctgatctagagatcgcagcggccatggacccatcacccatggttacagttcgcctccttttgcgatcattgattcttctgttctcaggaaggaattctttattttcctataagactttatttgtttaatctcttgtctaaagatatttgagtgagatttgttgagaataatttcacgcagtgtgaaattaatccctcaacattttaatccctcttataagaaataaccgaacaagacataagtaaaagacataagtaagttaaggaataatggttgattccatttagagcctattcgttttggacgaatttcaacaaaaggaaatagaaaaagtggaggaatagaaatgcattcacgcttcaatccatacgaatttttccataaggtttgtggatgaaaaatttcctttgttttctcttgacaacttgtacgaaatgaaaattttcctgtggttttcttatatctacattcctatgaaccgaatgatattcataggaattaattcttagggatccaaatcctttgtaattcctccaaaatgaatagggcctaaagtagcatatgatcaaaacaccccccacctatacaagctctgtttacgaaggatatgaagctacgtctactctgttcgtgaaaggatgccttagctttgcccctcattcgtgaaaataattttcatcttttcgaaggccaacaaaaacaggggcaatgcaagtttctagtagcctcaattgatgtccgcaacggtgctagactgctagccatgtggagcggtggacctagaaactgcgttttgcatttcataggaacatgcggataaatttaggaatgatagagctgagaccttgagtaatgacttggttttcacaggattatttatcaaaactttgtctagaaaatctaaaacatcaaagttccactacgatgctctttactgctagtagaaagcaatttgaaccattaatcctattccatcgaagggttcacatctatttatattaccaccttagtttacggtagtagaagtatgaagggtattattataaaaaaagtgcaaaaagctataatcgtcatttagcagtgactaaacattgtttttctttctttttttgattttttaggtggaatatgagtgatgccaatacaatggataaccacatatattgatctagccatgaaaaaaaatatgaataaccaaattacccctaatcactgtcttagtaaattactgatttaccctggataaccacgtatattgatctagccatgaaaaaaatatgaataaccaaattacccctaatcactgtcttagtaaattactgatttacccttaatagtgagcaattcagatcatttttactggtagtggtagtataatactagcaatagagagaaccagaagcatcgctcaacatcatctatttaagaacaaaatcaacattgtaaaacattataaaaaaaagaatggaagtagcagtttatttatgaacactgttataactactagtctaaatgaatatctacactgtttggggtagctgaaaaattgttagaaaaattgtagctataataaactccctcaaacatggctagaatatgtcggtacccacttagacaattccagacccaattaatgatttggcattctaattccatctcttttccggtgtcatttcccaccatatcgttgataataatctacgagaagcgcttgggcttaaccagtaaattttgagtttcgaaacgtgaccacctgtaatcctctccttcattcttcttccctcttctctgtctttatttttcacccatccccgtgtgcagccgcgcagcacaaagagcccacaatgcctattgggcgggtgccagcaaggggtggaactcagcgaagcgctgaggacttgatgaggacatcctctactattacccgttagcaaaaacacaaaagtcggacggcaaccgtgtgagcctctgaataatcccaccttacttagcttgggaggaggaagccaccttaaaagggagagcgacccttcctctattggactagtcttttagggagattgggcctttccccgagtgggtgtgtctaagaactgttggggtccgggcaaccttaatttgttaggcctcggccaaccccacctgggccggattgttatcatttggtatcagagcgcagttgtaggtaatttatcttcccataaccagaaaattgccacacaaaaaatatttattctttacctagacaatttgagccgttgcattgttctattagattttgctttattgaattctagattgcatcgtcatgttgagtgctggtttagttttagatttaatttttagttttgagtattgcatctgttcatcacttaggtctagtgttcatcactcgtgtcgagtgctggtttagttttagatttaatttttagttttgagtattgcatctgttcatcacttatgtctagggttcatcattcgtgtcgagtgctggtttagttttagatttattttttagttttgagtattgcttctgttcatcacttaggtgtagggttcatcactcaagtcggtgtgagttgtgcgtcagttttgggtccagtttttcatctcgtcgattgttgtcgggaccttgaaaaattaaatcgtcttgtcgttgggtttccgtttttgtggtttggagaagtttacatcgagtggttttggacttgttcagttgttagggtttcctgttgacttagccttaacatgattgccattggccgagaagagtattaagcgattgattttggagatgatagatcggtttagctgttgtagtgggactatcgtttggtcaaatcgatctgtacttatcccctataaaaaaaaggaacgagatcaacagccaaagccgactcgaagtcctggggcatgttggatctccacgccacttttgctttgatgaagagaagattctgttgtctgcaagagagagaatttgcataaggttaaaaccgatacatcagtttgcagttaatagaattgacaaaggaaatattcttacttgagggacagcttcagggaaaaggtttgtcaagtacatggaagccgattgatggaataaatgtttcttccactctatccacgatcggtcaaaagctgcacttctcaacatcctaaatttgatattgttgatgctgcaaaggtggtcctggtagatttagcagctgatccatcataagcaatgatgtgatctctcctctactttggatcttgtcggcaaagaataggctgatcggcagctgacctatgccgaattgtcttgcagcacatgttggatgataaaattcataggtcatcttgatgttcttgccctgatgaatgccgacaggaatgatgcaaggtctgatagctgctgaaaatacctccctggatttgtcatatttttcggagttgacctcatcaaaccaaaaatcttctggtagctcaaaaacactatgtccttcatatgcaaaccagattcttgcattcttggggaacccatcatagaagttgttgaaccactctccaaagggctcagccgatagtttggatgcaatattaaccgatgctgcttctccgaaggacctacatcggcgtgtggtgctggtttctccatcatcatcagtgatcggctcgaatcttggaaattctgcattggctaatggcggccgatcgataaccttcctagtgtgcaagtttagccaaatttgcaataaccaccatggaccccctgtgccgatttactttccagaagctatcttggttacgacagtgttcaaggtttggtacagatatcctagcaaatactttccaagaggaaattgtttcttatctatcaggtttcggctacccgttgccagtttgtagttggaccacagtttggactacagaataggaattttttgagccacatcataaggaaagctgcatgttcccttgaagaaactggcccagttcccatgttcttcgcgtcataacctaaccaaccacctatggtcctagtcttgaactcatgattaagttgggcatccaagcaagacaggttagccgatgaggtgacatctagactagtgatcatgatgatatctaagaagattggggtcatcggtccttgagagaaaaggaaagtattcatggctgtagaccagaagtaagtggcggctgatatcataggttcatccttcgccatatttgttgcagttagggcttaggcctgggatatgctgatttcttcccagtgagttgatttgctagccgataccctcttgtaccaagcaggccaactgttttcagccgatagccaagacttgaaggtgtttttccaacaactgagatctgggttggcaaatcggaagggaatgtggttggtctcaccattaatgaactctgtgggatctaagtcaccgattggtccgaggaaaaactgaaacttatcggttatgctagggattgcaacttggtgggtgagatgctataaaggaggaaaatcagggattgagtgagagaagaaccaaatctgcgaggtaaagaagggatttagcctatggatacttacctcaacgtattcggcggccgatgagctcggtggactagcggaagttgacattgtcattggcggaagttggagtcgccggaaatcatctctggatcgctgaaactatcgagggtgttgccgaagagctcgaggaagaagattggggaaagttttggctagagcggttaaaacggaaatgacgctgtgaaacgagaagagcggtggttactatttaaaagggagcacggtaacggtcaaaacggaatcggttttggaaaccctagatcggctcggaaaaggaaattgagcaaatccgccactttacaaatatagcggacttgggggcatgtgttaacgaccaaatttggtaatgtatgaatcaggtttgatattggaatcaacgcagatttgacaaagagatggattcgaagaacagagtatgcatcggctgcgatgacgtcggctggagtttgcatcggctgagatggattggacagaggacagccgatagaggtgatgcagccgattccgattgcggtggcttgagagttgtttctagaatcgatcaaagtgcttcacgaggattgccacgatagatataaagctctcagataggcaattatatctattaattaggatattttgtatggtttcgtcagagatatgtttgggcaaaagtctgccgcaaagacttatggtattttagagtttgttagagataagagtcgtgtcctgcaaggaaatattttgtaatctcgggtataaatagaacccgaacacatgtaatcaagtatcacacgatcaatacactttcggcgcatcaccaccctttttactttcgttttatttcgatgatttcttgctttcgagttgagctgcatcgattcgatcttcaactagaggtaaacttgtcatggcggcttgcgttctcaggattagtgcttccatctttatgacactctaatcttgttatgtaattcgtcgagttatcatatatttataatctttgttagtttcgctatataactcgccatcagctggtttttactgttagaaagtagccgatagagttagatctcgttattgatttagattatatcgtatatctaccatctttcagaggttttcatcatgttgtttagatcttacggttatctttatgcttaatgttgcatcggttgagttcgatctagtaagttctatttataattgtgatatctagcttgttttatgaatgtcaatagagatagcatcggagtttcagccgatcttacctgatttagctatttatatcctatgtctttacttatcatgctaaatctgccctttatattaagatcccgttgcattaaagttatattaggtttattatttgatatattttatttgtctcgatatcttgatatagagtggtatcggagtattaaccgatacacgctagatctatttgatcggctatgctataaacatccatataatctttgttttaatatatatttcgacttaagtggtttataatgtctcggcatggcgaccgatctatcccaatcacttagtttaaatatatatcgaagtaaaggactatatgatgttgatatctacagccgatcgaatagatttagttttatcttatttattaatcactgccgatcgattcaaacctgacatcggctcaaggataaatgatatgtcatcggcaactagtcgatcggctatcgtttttggatttaactgtgttttcttatcttttatcttgttgattgcaggatcaaatcaactggcacgctgacgaacctaaaggcgggattttggacctgcacagaagttaagcagatcttccaggtcagtgtgtgtttttcgcatcaacagttatcaaccgtactctaaacccggttgatctcgccgagaaggctaatccctacatgcgaatcaaaaaacacaagcaagaacaagatagattgcaacacaattgcatatgaatgattaagcactcgaatttggggttccacaaaccgatctagcggtgaaattgttcttgacagaataatctaagcaaaacccgactctaaacgatgacagctactgaataaatgcaattaaggacatcctagggttgccctagggcgcacaccgccttgggctaagcccacgacacaattacaaggcccaaaacccaaatcagattcggactggataagatacgtggcttgttttgcagattcctgacagctcggtaggaattttgacatgggaccaaaaccatctgaaagtagactctataagctttccaacaagtactcaagggccctgaaatttcttctatatcagcggctaggtccgtttgaagttgatgctgtcaagaggcccgaatccgaatacaaaacgtgtagaactttatctcttgtcttctatggaccaaaagtgacatggtgagatgaaataagacttagagaaggtcttggtttggtccccaatcaacttcttcaatcattcatgcattccttacgctcggtctcttttctttcgcccaagcaagtaactgtacaaacaaaaacacaggaaacttattgtgtagcaacgtttgttcaaatatataataagtaaatctaatgtagaacatatgtacctttgattgattaatacataaggtagtcatggttatatccgagctagttatatcctcatcaggactgatcatgggagtgtgctggtgagaggcggagcttggttagggttctagacggcaagagcgaggcttgaaagacaattccggtgagagcggagctcggggaggcttctcggacaagtaccaggtgagaggtagagctccaggaggcttcaaagggtgtcggatctcaacggaaatcagtgagttcgctctcaatgggatctcacaaaatcgccacggagctctgtgtctacagcctcatcctccactgcctccaccaagttacgccattgtcatgagccccgagatccgctgcctccactgtttcactccttgttgagcttgtggaggccacgagtgagctcaagacagcactggatgagctcaagttggtgaggctctcctcatcgagctttccgctgcaatgatgggctacttcgacatccaggagctcgtggagatatagggcgacggcggcagcgctctgaggaggcgaaggaggtctgtgggggcggcggcggcgtgatgcggttagtttctggcttaaatgtgtacatggtttgacataatagggtcaaacaagcaaacaagcaagatataacagggtcaaataagtaagggcaaaatggactatttaccccaaaattaacaccgttaactcacccaaacggaatagggtcagaccggagctttgtttttgaaaaggaaggtcaactaagcaaacttcaaaaagtatagtcaaattggtagttacagttcaaaatggggtcaaataagcaattgccccctataaaaaaacaactacgtaagtgtgacatgagacggtgcaagcctcagactaagaattctagattaattgatgaattagaccattgaatgaaccaacttatgttatatgcaatatatagagtggctacatgtattgataatttcggattatccggaaaacgacctatcggataatccgacagaaatattgaataatccgtatccgccggattttagagacaccatatctgtatccacatccgcatcatactattcgccagatttctaaaagctcattccatatccttgttttggacggattcggagcggatcagatcggatattatacgatccgttttcacccctattaagggtctcattaaatttatctcacatcttagagggaacgccgtcctatagatttcctgtaaaatttgtaatctgtacgtccacaagcacataacacattctcacatgtggacatcacctcgtccatcagttcagaaaaaaaaaacccttcgatcagccgcgcgaccccgtggacatacgacccacgcatacgtactgctactcattaatttttcttttagccttgatgctgaaaacgccaagcgatcgagacgtacaccagcacaagagcccacacaaactcccaagtcaagcgtgggggcacgctgccggcaaaccggtcgacgcccgcgcgctcccgccgcgagcaggcccagtgcgcgcgggcgatcgagctagcgccgcgctctcatctgcaaactctctagctcgttcccgcggatgtgtcccgtaatatttaggccattcacagtacatcatgagccatgattaaacttgtgatgccacataggatgaagctcctataaggtattgctcggtttagagggggttgaatgggatcggaggggtttgaggaggaacaattccacaccacaataggtgtcgaaaaaatcccctccaattcctctctcttgggaattaaacatggcctaaagcaacttgcttcacagtgcaactatttttaatgggtcccacccccactcgcttttcacctccctctctctcttccactctgtctccccaccggtggaggaacacacgaggcgtctgcccatcttccgccaccgccacgacccacctttgcgccgttggccacgtcaacgccggcgcccctctcactctcccccttccgtcggcgcccctctccctcccccctcccccttccaccggcgcccctcttcccccccttctgccggcacccctctctgcccctaagagttatcacaaccggcgtggagcgggacagcgcaaagctcaccagtgtggagtaggatggcgtggaactcgtcggcatggatctggtggtagatgacctcgagctcctctctgtaaaatcaatgtgtgtttgattcttattctatgatgaacaattggcatatgaaattattggttttgatatttggagattattggcgaagtagttttggagatgattggatttgtaggtgatggacaggtactgctgaatgtttggtccggtcaaaccggctgggtaaggccggtcagaccagtggtatgcggccagcccgcggtctgaccggccgactctgtcggtttcggttacgggttgtttcattggatatccatggataatttgtgtttatgacttctagatggatactatgcgtatgtaagactgctgtttgttaacaatgagtcaagttagagatagctttgtctcggagtatggtttcttgtttgattcacgtgtaggtatgttgacgaccaaattcaacaaggtaatcttgacgcctcgggagagtgttgccggtgatggatcggaagtcaacttggagataaggtgacgtccggacggttagatatcatgtgggacacttaggctaaagatgaatgcacgtggttggtgaagattccgtatggcatacgatggagatattatgtgcatatgagacgcggagtcaaatttggaaggagtccaaatttggtaattggagtttgtaaagttggtttcttgtacgggaaggtttcctagagggattataacttcttgtatgagttttgtttgtggctttaggctgtctacctcatgtataaatagagagagagggtgtggcctcccgatatcgttttagaaagcattgagttgagagaaaagttagagtttcgagtttagttgagattttcatgaggagtgctattgttgcactttgtaaacacagagagaagtaataaagttgtcatctattttgagagttctttgatttgtatttgctcgggttcgacagtccaactgacgagtcaccgacggtcagaccgacgggttcgcaccggtcagaccggcggcggtgataagaggaagaggcaatttcggcaaggttagaatgggcaatctatactggtcagaccggcggcataggcacagccagaccagcagatctatttcggttagaccgattgacatcgattcaagggtatattttaattccactaaaagttttggtttttaagtactacaaccattcaccaccctggttggcttagttcttgttgttcaatcctacactctccggcagcgtggatctggcgcgcagtcgctcaccccaccgctgtcgtggctctccctccccactgtcagcgccgctctctcccccaccaacggcgcctctctcatcctctctccccaacaaatctggcgatggcgggtgggagaatgatggaataggagccgtcggctggcgctggcaccgccggatgggacggtgggagctcggactcgacgcggatgcagtttctccagtgagcttcccctctccacactctctctccggctttctcaccatcgatgtggatgcgattccttttttatgagaaaagttgttttcttactgacgaggctctcgcagcccaagaaggatgcacgaacatttctcctccacacatgcattttatcaacatggacagggattgccacacactacatatacgcacagtgaatagccttagaattattgatccatcgatcatctctggcatggtgccagaccaccggccggcctgcgcgcatgtcgtagcagatcgagcagctcgcgcgcaccgcgccgtccgatccgctgcatgcgcgcgaccctcgtaagctgacaagaaaccgaaattaattcggaagcagcagcccatgtcactgcatcgcgatgcatgcatattgtactcctatgtgcgagcgagggtgtcccagctcgctggatcgatcagcaacaacaatgacagcaaggggaaagggtcaaggtttctcagcggctagcggtgacacggacgtacggcaacctgccgttgcgagcagcgtcgtcgctagcagctagctgcatgcacacacatacagtatggcccctgcaatgcattggtcagatcaggggtgtcacctctcggctgctgcaccggccctccggtggttaatgctccacagtgtgtcccctcgtcgacatctcgagcttgcatcggatcactccaaattctctagtaccagtactactactagcaatgcatgcaagtctctgctactagctggctgctactgtaccgactgctactctcgcctgacctacacacacaagctgctgaaaagtccagcccggcctgtgtgtgttcgattttaatctggatattgcatgcatggttgaaaactttcatgtacattcttcaaacaggaggctactcctgattgctcacagtcgccacagtagcctctcacagccgtaacagtggcctccattttttgtgttattctggaggagggatcgcaggtgacaggtcagtggatgggggaacagtgcttactactgttaccaatcctcaaatcaaggggaaatagggtaggcgagtagcagcatgccattgcaaagaaggtcgtcgaaattgacgcctgcgcgtgctgaccagtgccctagcctataatatatagcagcttgattgatctcttcagtttatgcagtttctatttccttttctactgttttcgaaggggattggaattggtttggtagtattttgcaacgtgtgtggttttcctgaactgatcatcggtcaatgacagaatgaagagcttcagctagctactactccctttatggggataattcaaaaaaaaaaggaatatatatcaaaagagaggggttgggggtcgggttgaatgcatgaacacttgacttatattcatgcaagtatgaccagaccaagtaaagctaagacaaataacatgtgtagaaagtaaggccacagctatgcggttacgatgtgccatgcaataggtttctgaacttgagaaataatttataaggtccccacacttctccatttcgtcaaagaatgatattttcgccattaattaatagaaaaaacacacaataaagaatgatatctttattttcgctgcctctgcagcttttgtaacttcttcttccatgtcttgcagaccttccttttgtacagttttctcccttttcttttggaaaattttattcagtttggggttatatgaacaatatgttataaagttcagtgggctatatgtcctgttccaaagtttaggattctagatagactttcaatcaaagtttacgggtaccttttcctatataatatactccctccgttttagattgtaagactttctagtattgctcatattcatttagaagttaatgaatctatacacatataaatgtctagattcattaacatttatatgaatataagcaatgctagaaagttttacattgtgaaatggaggaagtagtatagaaagtatcaagattcaaaacaacacgttcaacttagaaagtaatgcagttttgaaaagtaatggagttattcactgattgaatataatgagggcatagagaaggccctgaagttgaatataatggtgccatccatgtccttaatcaccataaaaatcacgctgttgcacaatttttttgatcttgtctatagtaattgtgttgactaacttggctacatataatagggaatactaatctatctctaatcatttgacaaagacctttagtatagttttctctaagctaatctatagtgtgtttaccagctgaacactagctagctactcgggcaggaaagaagtgcatgcttagcgcctgattgggaaaatcttatcatgcatgcatcttttgttcaaaacctataaacttacaggacaaaccaatgatagtatagctatagctatctctagctagctaactatttcattcatgatatctcttcagtaatacaatattgataccaaatatgattttaaagtaccctgtattaattgttatgaaggataaatggttttttttttgcacataaaagtaatatatttgctatgattgatgctaatgtactgccacaaacaagtgcgagcaaatggtaattaatagtaaaaactacatataggcccattcttttctccaacaaaagttgaatgaaaatttggatattcatggcacgcttttcaaagtgctaaatggtgcagtccgtgcgaaaactttctaaaatattagataaatatatttttcaagtttataataattaaaactcaattaatcatatgttaataccacctcattttgcgtaaaatatttaatcttcatcttcatctgcatgagtttcaaacaccaccatatattaccccgtgttgtgaaacatttagccaaataatgcaagcttacgtataatgatataaatgaatttattttattaggttaagttgtcatggttatattcattttaatatataatatccacatatgcaaattatctactacatatatatgaccgtttgaaaaattattcatatattgtttagaagacaatgcaaatatacgaattttaattgttgtacatgctcattgtaggcttagttatatctacgcctggaaaataaaatctgcaaactaataacgtgcatgactatggctttattaagttacatttatatatcaaggtattaaacttactgaagtaatgtgacattatatcttcaaacactgtatcctaaatcagatgtttctgtaaatttgggcaattttagttagaatctggccacatgaaaatttatctatatatgattcacattgatgtccaacgaccatgtgttaatatgttagtaactgaaaatgcaattactattgcagtttaatttttagttagttcatactacaaattaatcctatttaattaattaaactctgacgattgccattcatttttgtataagcataacgcttcctttgaaacaaaggaattgaactactaattaattcgtttcaaactagtataacgtttccaaaagaggactaaattgtgggaggaaacaatatactaactataactgctatacggacaactgacgctcgttctgttaacttttttatttttaaaaaaacttcaatactgttattgagcaatatattgggtagattataactttagaaaaataaatgatgaaataatatggacctacataatacattatgttgacacataaaaagaaaaggtgcacatgtgaatttgggatggcttcctatagacatcagtgctcatgaaataagctatgtaaaatgtacattcttcatgtttatatttgtttttttttccttttcgtttgcagaaagaaaaataaacctgtttatatgagaactcaagaaattatgcaaattaactaaaatattgattatgaccaacatgctcacagtataaaaagtatcagacagataatttgcatgattaacagacttactactaatgtggattttaaatttgcatttcatataataagatatacttcccaatgataccaagacaaaaaatgggtctgatcatgcatgtgaccatatgaatagaaagttagctagaaccagtcccacacccagctaatgcatgtcactctgaacataagatatatatgtattatatatggtctggaagcatggttaaacaaaattaacagtcttattaataattaatctcatggtgcagtgtgcatgtcttggaaggccttgggacaagtacttgaaagatctcactccaatgccttgatcgacatggtcagatccaaagtactcagccccagagcggccttcttgctactgctgctacctgtcatctcttcctctaacctcccggcggcttctgcgccgccgccgccgccattgtcgccaccaccccggagcgacagggaaagcgtgagtggcagctgctgcttgtcactgtccacctcctgctcactcaagaacttcctcttctcgccggctgatctgtgatctcccgcgttcgggctcaaactcagctgcaagtccggcgtcctgccgttgatctcctccgccgccaccgccgccgccgtcatcttcaccggcgtctcgaggcgcatcgcctcggtcgctttcgtctttgccctctgcagcgtacacaacgccattgttgtgagttggtgtgacgaactgaacgtgtcagtgtgacagtggtcatcacgtgcgtaagcgtacctcgagcagggaacctagggcagcttcgcttgcgaccaccggatccgacgacgccgtcgtgttcccgctgccggcggcgccgcctcgccaccgaagatggtggtggtcgcccatggtagccgccgccgccgctgacattgtcctcgtgagcggccgggaggagctgctcccgatccaatcaaagttgccggccttcccggcgccgtctagccggtggtcggcggcggcggccgtggtcgccgaggtcacccgggtggaggcgatggcgtccctcacgtcgaacagatgcgacgtcggctttccttccttccggaagatcatctcgtggatgagccctttcgccgggccgtggccgttgacggcgccggcggccctcgccgccgcgtgctgctggttgaacgcccactcctggttcctactacgcgtgcaaacgagacaccgattagggtttcgacatgatctcgcagcatcaccaccaccatcgctactactactagctgatcgatcgatcgggcttgtcctttatttcgctttggttaattacctgaagctattgcagttcttgaagtcgaatttttgcatgggagcttgctgccggcgttggaagagaccgtagagccggctggactccggcaagccgggattcctcgaagcgaagaacccgccgccgttctcgtgcagcatcctggaggagaacggcgagacgccagcggcggcggctcgctggaagaacatgtcgtggtggtggaaacgatggtcccctctcctcatgtggaactccatgggcgaaaacactgaaaaaaaaaattcaagcagctaacaaagcttaagaaaatggattccatggcttactctctgtatgcatgctagtcctgtggaggagagcaatgaattaaaaatttaagggagataattgagattgagacaagaacctgatgagatggctcctctctcgtggccagactcgtggtctagctttttgcttctgtacatctgaaaaaagtggacaagaatgaagaaggaaaaagtttaggcacaggaaatcttctgtgtgaagatgaaaagaaacaaaaccagcatgtacacagcttctgctaactgctaagtaagtagtcatgactcatgagaagtaggctggtttttttcatcctaatctgctttagttttacctgcaaatggcttttgacatgagcaatgctgagccccctcacattcatcatctgaagcacaagctttggtgttgctcctgccaacaattattttgacacacgaaattttagatgtcgacgaatcaaactaatattcaaattagaaattttaatttaggatgaaattaacacagcacaagaagaaaaggctagcctacgaggttgtactcactttcttggccgcccaacctctcgacggcgtggacgaacgccatgtggaggtcgggcgtccaccggagccgggggagcttagaccggttgtactgccgcaccgtcggcaccctgtcgccgccgccgtcggccttgctgctgctgctgttcatgtcatggtccttgtcgctcccggaattgtggttggtgctgctgttgttgctggagctcctccctcctccggcaacttcgcttgtgctaccgccatcgtcatcgtcgtcgtcgtcgtcgtcctcatcatcgtcttcttcatctccgtcttcgccaactcccccttcctcgctgccctcgccgaagccctcgttgaggtccagcaccatggctggtggcacagagttttcaggagatctgatcttgttgtcatgatcatgctcaaaaatctctaccacctcattctccttcacctcccccatagtaacaacccttctaattaagctagaaatcttctctcttctcttccccttctagctctctctatatttctctaccaccaccatgataggattggaatgatgtggggtagaggagttaggaaccagggaggaagaagaggaggagagtgtgatgggagaataagggaggggaagaagcataagcaagagctaatgatgtgggggataaaataaggggaggagcttaggagcagaaatggacaagtattccactacattgactagttttcaagactgatatatactcccatttctcccctttttctatagtgtcaaggaattggaaagctatgcaattgctgtgctgtgagagggtggtgtggggtacatatgctaaggagggtgtgtatataattggatgtagtggccctggaaggggctgattgtcaattagcaactggaggtgggaaaggaagcaaaatggggttgacacttgcttaggatgataacaactgtttgtgtccaggattttatcatattaatttgtgttcctaatccatgtacggtgtaagatttgaaaaccgtgcatacctaaagggggtgaaatgagggataattaatccttgaggtgtgtaatgaattgaatttccccatatatataactatactaatttgtgctgttaaaccaaaattttctgttcaaaaaggttcaaaccaaaatttatgcgtgcattactttttttccaaatattatagtactaccgcttccattcataaaacaaatatcatatcgatcggaccctacatttaccaaccttctcttcattaacttaaccaactagttcaaactttggttctgccatttgtcatgcatatgcaagatattaagggcatgttctatggtatagacgagtatgatatcctagataatacaaaattatttagagaccgtgtctctacaatagttgagacaacaaatgctctaattaatcattaacttaaaaatattattttattgtcattatttccttttttttttctcatgcaaccattttccagaggctttgttgttacaccatcattacccatagcaattatgttttatctcttcactttctctctcttccatgtcagccaatatacctaattagcaatattaagagacacatattaataaccatcgtacatgctagggtttatcatgttctctctctgtttttttttactgaaagttggttataattcttttaaatgtttctcattgcgaaaagtcggtttttaagaatattcattttctactaatgcatttatttattttttggctagttagatatttttggagcactaaatatgtgcatgaatagtatgtttctacaagtcaataactgcattggtggtagtatggactatatattatttctttttaggagatcaatagtagtatgaaattatataattaagaagagttggtggaactgatcgtaataatcaagtgtattctgcttgtgttgaagttatatagcttactggctctcgctgacttggactcggcagtagaaatggaataaacaaaaacaaaaaaagcacatttttcaaactagagttagctacctagattcagctgctattaattataaaacaattaattaaagtaaaatattttttataaaagtacgcagagtaagatatataccgtgagcatgcaaaccttataaagaacatacatgtacttttataaaaaaatattttactttaattaattgttttttaattaaatagcagctgaatctagtagctaactcctagtttgaaaaatgtacttttttttacctgttgacgcaaaatatatcgcaacacacaatggtctaagagattgcgggtcctaaaatcttgatgagattcgaacatgccagttagtttgatcatgcgactaacaagatgaaaacaggtcgatgatcaagaatccgaccatcaacttagagagccgaacatcaacttagtgaggttagccaatgttgatagggttttgattaatcagctatagatctaaggtggattcaaacaattagataaacaattatataaagatatgatagaaagaatatgaccaatgaaccaatcgaccgatattaatatagtgatagatgtagatccgatggttgaagcatacatcggcaaaaaaatctgacgcttgcagattttgaatgtatatcagctaactaaacaatacatatgatagctgaagctcacaattatgataactagttagctagaactccgatgaacgttgtataaaaatctattggcttactagaattaaacttattagcaataatctaatagatcggatctaaccgacacagtacaagattgaagataataagaaaaatctatttagccaatagatatggatatattgatcaatctaaaacagcagtgtgatgagaaaaatatcaacttagtcagaatgtcatacctaatcaaggaagtcctaactaagccgatgcaaatctaaacaatgttgcagttaaagataaaatcaatatatctgataggcaattcttgcatcaacttagttagaatatcggacctaaccgatgaaattctaaccaagctgatgcaaacgaaattgacggaacttacttcctcgctggagatcgaatttaaccgatgcagcccaacttgatagcaagatagtatatctgataggcaatgtttgcattaacatagttagaataccggatctagctgagtaagttctagccaagctaatacaagtgaagttgatggaacttacttcctcgctcgagatcgaatttaaccgttgcagcccaactcgatagcaagacgtcgaacttaatttctcacctaagattgaacttaatcgatgcagccctaatcgaaaattaagaacccgtcgaaaggttggtgatgcgccgaaatataattgtattgacctatggatgatattatagagaccttatgtgtacatatacctagggttggtacaagtccatattggacacgagataagatttcctaataaaaaaaactaaccctacttatttaagagatatactgaggaaatacgaaactacattaccatgaccttcacaactccttattaaattcagtttttatctagacaaacttttatttaccaatcagtttcttttcttaactgaatttactaagaaaccgtaccaaatttttgcgctaacaataccataacctcaacatataaatattattttttccctttctcaaaatataacaacttttagctataaatatgaataaaagcatgtttggatatatagttataaattaatatattttgagacggagacagtgtaacggatgaaaggaaaaaaaaggcttgagctttacaaattgatgtcacgggcaatcacaagtcatgcagccacattcacacgcattcctgtacgacaagaaatataaattaattatggctgattcagcaaaagaaaaaaaaatgcatcaatcaagtagaatgaaatgggagttgactagggtctgcaaaaattacagggtcaaagacgcactttaatacaatttgtttgcttttggatttcctgatggatcgatttgctgattgacgtcgaaagatacacattttctacgtacactttgtctcttggtcatctatatgacacgccaggcttgtgtatgaacggattgtgctgacgcgtctgattccattgcttaatttttaacacagctctataactgttactttcactagctggaatgttttataccctattattatttgattaactgcgcgatcaaactaattccagtggtgcattcattaataaccactcaactcgcgatttacctttttttgtttgaattaaaaactaagacatttaccttaatatttactctggctaataaatgcctgtagtttctttttcaattacacggaaaacatacacaccactagaaaatacaacaccacgtttatatatacacccgcaaatgccccctgcccccctaacacacggcaaaagagatggaaaccagcgacgtatgacttttcttactaaattccgattaaaatttgcatgcacacaatatttatgggcaccaggatttaaacacgagtgaaaagagttatatatgcatccactattctaccacgacaccaccggttgctaccccgcggtcaacttaattaattaattaattttaaccacacacgaaatctagtaatactcatgtagtccatcaattcttgggccatttggaacacacgaatttcaggcaaaatcgattccaagctgtcaaatgttctttttcttagtgcagaagcaactactgtattggaaccaacataaattagctaaagatataaagaaaacgagatagttatttatttctcaaattggattgatttatggtgccaaacttttataaaatagtaagataagttcaacaacatgcattttacactataaattatctatatttacggataaatacccactagtgcaaaatcgatcatttgtatcgagttccgacacccatctatatcggcagaggccagagggcttggtcatcgataaggcgtgttcgattggcttgtgtggatagaaatttttagcgcacgcaaaatgagaaagcacaatggcatagcacataattaattaaatattaataattataaaattgaaaaatagatttatttgaatttttaaacaacttctacatagaattttttttttgcaaaaaacacattatttaacagtttgaaaagcatgctcatggaaaccaggaaattgaagtttgaagttggaaaaaagaaatgggcctaagtaatcagtgatgtgaaaactcatatgtttcaggcgagcgaccatcaccgttgtcatacatcttaaacgagtttcaatatcaacccgtcatcgatatggttcacccgcgcgagcgagtagattacaacttgtcacggatgactcaattgtgatgggttacaactctaacccgttaaaggtgactggtgaccattgacaaggtactttagagcccgtctcggacgagtcatcggtgatggggttcagttgtaacctgacaatgatgttgctcactcatgacggggttattggctagcttcaggaaattactagccatgcccattacaaaatgatagaaacacagatatattcccagaatccccaaaatatcccgtacatttcatgtacacacattcatttacatactacgtactcacaatcacatgattttcaagtctccgttatttgtaagtctcaagaattggattcctcacataattatattaattctcacattcagtaaaactttaagttgcaagcctcaagaacttacaaaaccgcccatacatcttccaaagagaaaccttcacaatctgcgaattcagttacaatttgaaagaagtaatagaatttgtaaaccaaatgttaccaacatacacagcatgtacacaagaattagaaattgttttacgtacagtatataaacaaatatcacttagtcaactatttttacaccatcatttaaaattgtgcctctatctcgaacgttgttgagtttatcaagcacaaaggcaactatttcttctccaatgttgttgaagttgtgatgaggaatgttataaatggttgcctctaaggaggttttcttacctctctaagtggtggagaggtataggaggtatatatctcctagggatgcaagtgggtagtcccgctatctgcataataacccacttgctagtttattttttacatggtagtacaaaatttagaagaaaaaatgaactagaagtgagataagcgggacaaaaaaaatccgcttgcccgtcccgcttgcatccctattatctccaaggatataagaaaacctcctaagagagacgtggagttagaatcgtatgtaccacatcttatactgtaaattttctaatgcttaggccgtgtttagttcacccccaacttccaactttccatcacatcacatcacatccaaaacttttctacacacataaactttcaactttttttccaaacttctaactttcaccaaacttccaacttttttcaggaactaaacacagccttactcattgactaaacaaatatttatatatactagtacaaattaaatcacaagtaaaatgcgacaaaaacaaaagtttaaaaaattatcagagaatatgaacacagacttacacataagggagagttagcagttaaataataaaaaatgagtgaaatgaagctaatatatggcaccacctttttttagcaaaaccatttttaaggaacattaatagaaaacatagctagatcagtcccatatatataatgattctctcttttccgagttccaaccactagctagctaggatttgaaaaaatcatggtactagctaattaaggaagttgcttatgtactatatacaatattattggtagattcagatgtcaaattacatgattgatgaacaacttgggatgtagttagggtttggtttcgagtccatttttgcaagaacccacatatggattctatatataggttgtttggttaaccacttcggaatttcgtaataccactgagaatcatgaaataatcatcagcatggtaggaattaagatgtgcaaagcgctatttgttaattaatattgcgcatggtcatcactaaacgatactatggtaaagtagtattattcctcttacctgaaaccgtgccaaatatatattgaaatttgtagatataaacatcccatctgccaggtttagttgagctatttttgggaatttgatggtacgtacaataattaagctagtactgaggagaacacatcagatcactcctcttgagccagtcatgtgaagcgtgtgcaatataatagactaaaaaaaattgttttttgagggaaagagtataggagagcctcctacacatttcactactcaaaattagtagagaaaattcccaatctagcataaaaaaaattgctcttccctatatagcacccaaacttcaaaagttctctatcaatgcaccctcaaaatttttgttccctatctagcacttccgttagttttgaggatgacggtgttaattagcatgagaaaagatggttttgcccttatgtattttatactttttttccctttctctattcacagttttttttgttctttattttttcatttagtgtccagccgtgttcaagtctgtgcatacttcttttttggccaatataatatgagaacattagattaacaacgtacgtacttcttttttttagaaatttgacagaacaaatttaagagaacttacatgcaacaatagcatgtatgcaacacaataatgaaccaaataaattttagagagcatccaaattcacatccataggcctgtaacatcaagaacgacatgcatgcataagagctacatctaatcctactgccattgagtgctacaaaattttcaagaaactcagttgttgagttcgtcgccatgccagcctgtttgcccgcaccatccagggggttgctgcccgtgcccacctgggagctgcctgcctgtgccgccgtagccgtgagccgcctgtcctgcgccctcctgggattagccggccgagcaggcctggggctggccgcccaggttggcagggcgctagcctcccgtgccgccggccctgccctcttgtgccaccggcgctgccctcccgtgccgcgacggcctggtctcccgcgccaccggcgctggccgttcgggggagcccgccggcgccaatccttacaggggcgcgcctgattcgccgtcctcgccgcccggggggtcaccatccacgctgtcggccatgggggcggcgatctagggttgcggcgacatggagttggggagaggcgcggtcgcgctcggtcctgggactgatccagaaaaaacgacgacagaaatttctgagggtgggtccatgcttgttttgatagtggagactaacgggagtaactgaagtgctagatagggaaaaaaattttgagggtgcatagatagggaatttttgaagtttggatgctatagagagaaaagtaattttttctgatgctacatacggaattttctcaaattagtaagcaaaacttactgattcatgagataccatgtttgcggtcatattaatttactcagacacactaattaagaatatccaatgaaaaatattaaacttcatcaagaaattgaacttcattttttttcttttctacaaattaataatcttgaataatgttgctgcgggcatgcatatgtgtacagaacacatatttcgggtgaaatagcataattaatttttcacgggattaattcctgcaaatttcacttctcgagaaagatgtagtttaaataatgcatatttttcaatagttgtaaatttgttcatctatgtacaagagactatctttttccccaaaaattaaattgcaacacattatacgactgcagttaatctacataaaaaaacactactccctccatccctaaaaaaccaacctactccctccgtcctataatataagggattttgaatttttacttgtactgtttgaccactcatcttattcaaaaaaaaaattagaattattgtaaattttttgtgacttactttattatccaaagtactttaagcacaacttttcgttttttatatttgcacaaattttttgaataagacgagtggtcaaacaatgcaaacaaaaactcaaaatcccttatattatgggatggagggagtagctagtactggatgtgacacatcataatatactacgaatctggacatacctctacccagatacgttgtattagaatgtgtcacacgctgttggggaatgcctcattagtcccggtttacaaattgcaacccctttagtcccgggttgcaagccgggaccccaaatccgggactaaagatcataaagtctcgttgtattttttaaccgggactaaaaattgatctttagtcctagttaaaccggggctaatgtggtttttgcatcacccagcaaagatcacttctccggtagtgacatcttctgtgagacggagggagtatacgatatagctagtaagctagatatccattcttcatatagcactgtgttagaaactagtcaccaatctagtgtggggacaatacatatcaccgaagaattaattgttcgttctgctgctgtccatatacagtccattactattgaaatgcagaaactaacgctatatgtgtatatccatcaatccaatcgttaaatgaaaactgtcgatttcatctacgaaatgattaggcgtgtttggacgccacaatatataacagggaaaaagaaaaggaaattatatagaagactaattaataatgcacgcagttgcaaaaacatgcattcagaggagaccaattaatctttgaacaaaagaaagaactccgactaattcttgcatgatttgtaagggtattcacaaaatcacaatgcaatgactagataatatctatataattaaatgagttatcatataggataaaatgtaatgtggcatatgggtaaaatgaagaaagaggaagaaacaatgttttacattagatatacatggtttctacataatatctaagatttggtgggataagaataacattaaattcgaatatgaattagtagtgttaaaaatagtttaggatgaggatatgaaaactattggcttgcatcgtgattgccctgttccagtacaggcaagctcgatcaatcgatccagccagcaatttaattcagtgccagttaataacacctgatggctttgtacgattgagagggtaaatgattaactgagatggataaaaattaaatattaattccatgccgcagtagctggtaggccatatgcatacatgcatgctgcattgccagcttcgaagctgctactcttgaactgctcaacttcgtcgaagctggagacacgattggtctctttcagaaagcgacgctggctgtgctcacgggccaggattgggttccggtccttcaggccgaccggaccacgtagtagctcatatattcagtcaggcctctacacaaaggcatatatatagtagagttcattaacctgactagctcgacccatgtaatctgcacttgattcgtttgaaaaataatatatatgcacctccattaattagtccaaatacaaaaaaataatctagattagtattagcatgcatggacacatgtatttctggtgtgtatatatatatacaaattaaactgtgtgcatgtcagcactgtgcagttctgaccagctttgccaatgcaattatctttttctttaggaatctacattaacagcttcttcttaacgagcttttagctaggaatagaatctctacttgcagccctgcctgagtgacttaagatgcatgagaatacgtagcatgttttttttaagcaaatatagcatggttaatgtttaaggatgattgtgcattgcctttgacctagctagctgaaaatcaaaagatgctcgaaatatagctcatctttagatagctgtccaaaggtatgcatgtctagaagttgcttgtactttttctcctgaaaccacaatcctacctagcaactttaattgtatatttatatacctaactaactatatgacccattcttttttttatatatgaggtcttgctagaaaaaaaagtttccacggatccatttatactccctccgtcccaaaatataagagatttgggtcggatgtgatatatcatactattatgaatataaacagactcctagtctaaattcacatatagtactaggatgtatcccatccaacctaaatcccttatattttgagacagagggagtatcatccttttcatatgaatgtagataaatctaggatttttttttcttgtgtgcaggggcagggaaaaatctacttaattaccagccattaggaactaacagaagatcactagctatagtactggcattaattaatctggtgggtagctagctagcaagatgcacgtcgtcatgaggtgaatgtgcaatatagtactttacacagcactaagatcttttttctaggctgtgtgtatgcacgagatgggagctcacactatagtagctagctcagctgagctgatcgatcagctcatgtgacccaaacggccaatctggctcgaatccaaaagcaatttgtttttctaagctagccacgcttcgattgggtcgctgacccccttgtcgtgtggatctgagtgtcttctccgtgacacaatgaaaaaactaacctttgttagttgacctctgcctgcaagcctgcacacaaatacatgagaaagccttctttctttttatcagcaacttgttcagaaagagctagatatatagagaggagaaagcaatttaaatttgcaattgggttggtcacttcatgacatgcatggctatatatttatttgtcagaatcatgtctacatctatcgaagatattctctttgcttgtagagaatgagcccccttggacattccaaggagattaattcaacaagagctaattaataagcttaaaatgtaattgttcttctaacgtttccaagcctccaagctctttttttttccttctatacgatcagcatatatatgatggctttaggagattactgactagaacctacgtgatttgttttagccttcaatttaggtgctcttttccatcaccccattctgtttttctttcttcttaactctaaaactcattgatctattgtgtgtttgctaatcatttctattatctaacaaaaatatatataatatctagcattgacaacttaatggctaactgttttagtacttgtggccactaatggtaatattatagtatcagtattatctccagtagagccgccgtagaagtaattcgaaccattgatttataagttcaactaccattttttttttgaaaatgttgtaggaaagattattcatacagtacatatattaacatcactgtaaaaaacaatcatttacaatactaccaatattaaggcattagtataaatatgtatgattctggattagaaaatatggacgatttagattgttttctactactaattaatatagatcattgtaaattaaatatctctaactttaatttttacaccagaatattgttaatattttcaattttgaccccattcattttaatacttataagttatatttatattagatgaataatcgatgttgtactatatgtgtcttgttttccataatatctggattaattttgaagtggccttgttttcatgttccaagatactactaaattcatacatatattttttacaatactagtagcagtggcatgtctaaaatctttttggaactcagacataaacccagccacgccggtatcatgaaacaactagtagtgcggcttaaccgtctcttaccaccatggcttacctgtctcttaccttagcgagcctgagcagatggtgactgcccacggtagtccaaccctatgtccaatatatcctgccctatgtccaaccctgattgttattgtatcaaatatattgatggtgcacagcatgatgagcttgaagcagacacaaccagctcatagaaagacatatttgcttagtttccttcatatagaccatgtaaaatcaaggtgttgattaagtcttggtgatgaaaattgtcaaaggtaatgaagaagttattatgttgatattcatgaagtggtgatgaatttggagaagtgtcggaacatgcaaagttagaccggcagggtaaggtaggtcagatcagtagtatttgcacagtcaaactttttgggtaactgaggtctgaccgagctatatgagcggtcagaccgacagactctagggggagtcggttcttttgttgttttgatggaatatgcggggtataaatgctatcgaacaatatgcgtggttgtgaagattccgtatggcatacaaaagggattgtatacgtataggaagcgaagtcaaatttggatggagtctaagtttgggagtttggaatttaaatttctaaaaaataagtttgatatgtgtaagggtgagtttttctaagggattaggagtatttgtccttgttggattcatgacgtctcttgtgcagccacctcaaggtataaatagacgagatgttgaggctctcggcatcaattttggagagaatagttttagagaaaattagggatccaacctaggtttcgatttaagtttagaagttaagagaggagtgttatagttgtactttgtagacacaattagatgcaacaaagtcgatatactttcaagagctccttcgagttgtgtttttctaggtctcggcagacagatagaggttatcaggcagtcggactgatgtgcggtgcaacaggcggcgtgtagtagattggatcggcagcagaaagtcggttggactggcagtaggaagccagttggactgatgacatctgtacggtcagaccagcgcatacatgataatcagatcagaactcaggtttgataattaatgagttattacatgtcaaatactcattaattatcacttgtacatgtcaaatactcagagttaaattaagtcaatacttcctataaaaaaaaaggaagaaaagaaaataggtttctcagctctcatgatctgtgctgcttcctaaaaggggagaaactactcacacgaacgctggtccatgcatgcatcgttgcatcacggcttacatgccgatctccaactaacacacaccatggtggattattgctggaaagccaaaactaaaggaattaatggcccggccacccgtgtgcgtgcatgagcgtgacaatgacgagtttagtcgtccattaatacggcagcacactgtcttgtgaatttaaccacataaagttgcaattcctaggctagctagacagtggcgtggtatagtttctttctggttgatcttttctttccttttcatggcatggagaaactgttgggtcattcggttgggaggttattatatatgagaaaagaaagctgagtatgtctcaagtaccttttctagttacctcaaaaatattcatatagtttagaaatactaacaatattcataaagtattgttatattgccagggataatttttatgtactaacaattctttcatgtaatatatgccctataaacaaagtaatgtaggcctagtcaacaaataatcaatgaaaatgatgcatatttactactctctccgtctcataatataagggattttgagtttttgtttgtactgtttgaccactcgtcttattcaaaaaaatttagaattattattcattttttgtgacttactttattatccaaagtattttaagcacaacttttcgttttttatatttgcacaaattttttaaataagagagtggtcaaatagtgcaagtaaaaattcaaaatcccttatattagagacggagggagtagaatactatagatggaatatagccatctagtaaattgatcctagatcaatttactctacatatctacgtattctaaactagctgggctagctaagcactatatatataaaaaatcaaacttaaaatatgtgtccaatttcttccataattgattggaagtaggagagaaacattacaccaggccgatcgatgctgctcatctagtaaattaattatctagacctatttcgataattaaatttcaacatgcgctgctcatgttggtccagtttcatttttacatggaaatttaattagaacaaggtgagtagcatgcatgttgaatttcctttgtttcgtttctggtctaaattaatactccctccgtcattctagccactggtggagaaaccctttgtagtcccggttcgtaacccccctttagtcccggtttccaaaccgggagtaccaatccgggactaaagatcgctatctttagtcccgggtgaaataaccgggactaaagatagagctgatcttttttttttgcatgcccctgttgctgcatggtttatatatatatatatatatatatatatatatatatatatatatataaaccatgcatatatatctttcaatacatatatatgcatacatatatatatgtatttatacatatatatgttatgcaaatgcatatgtatatagatatatatatgaacaaaatatatttacattatagaaaatgtgtacacatgcatatataaacatatgtagtcatgtattaattacaatccattatatgtcctagctagctacgatttcgacgtagtagtactcgctgctaactcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaagaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgcaaaattcgatgacctcctctgttccataacccttggcgatgcttgcctctggacgagcacggttacgaacatacttctttagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaatccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacaaggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcat

SEQ ID NO: 55689 - DNA, 15649 bp, Oryza sativa
  unsure (1)..(15649): unsure at all n locations
ggatatcaatttcttccaagtgaattctcgatccatcatcagcaatactctcccaaggcctcaagcaacacctagacatgaacaaaccaaaaaattatatccgagcacaagttctttctcaacttagctcaacattagcacacaacatacgtattgaaatcatctcaaagtcataaacatgaagtgatcacaaaaatcaaaatatcaacgtgaaatcaactccaactcacagtctgccggccagccccgcagtatggatcgtaaccctaacccttttagggtttcatctttatatatactccctgtaagccgccgttcaacgttttgtaacttcacccgatatagtgaatttgtaggctggcacccgtagctttttctctcctgcacgccttaggagggttttccacgttaaatctcatgtcttctgtgattgatctgttgttcttcatcatttatctattgatcgtttcctaacaatcttgtgccgtagaaaaatcattttttttaaaaaaatatcattacacaatgagggacttaattaaggcttgaacactaggttatttgcacacacacaccgactggttttacactggtagtgactagtgcgccctgcttcaattccaagcaccgcatgttttggcagcattaccatgccgacaaggttggaattttgctgggtgtcaaaagagagaaaaaaaaaacgttcatctctcagctgcaagtccccaaacctgtccaaacgatggtcacattagcccgtcacctaatcctgacatcctgtgaatgattcttcccacatcacacggttgaccttctctgccccctaggctatccatctcatcctcaatactttaattcatttgcccataattaactaattttaggatccagctgattagttcgtcacactaatcacactactaaaccgctagctatagctagctaaagctcagcttgatgccctagatgcactagtagtacgccattatgttaaacaaatgcatcggtgtgagcccctcgaaactgcaaataattgtagggttttgtcatcttgtcccaatgccacgaccatgacatactgtccaaaattccattttgacatgcatgcatgtatgtgtgcattgagcaaatgtagctcagagagagatcatagcaaagctggagggttcttcctgaaagtaatggcttggactgtgggaaagagatgggggagatatcgacacttgatccctttgtgtggctagagacaaatgcttgccctctgtccatgtgccaaatcaatagtattttatttgaagagcttaaattaattttctggtccttgtatagtgcagcaatgtatatgtataggagtataattatatgctgtggatgaatgaataatatgctgatccatatgtcatatattttcaccttttgaagacttgagcactatagaggagatctaaacatggagagaattagaagatagcattagtctataagttcatttaattgcgctttttagtttttgagaggattcataattcaacatagcagctgcaccgggactacttcctttattctagctttgatatggttgcaaataaacggcactctaaattccatggtgattagtgacccactaataaattagcaggtttagttttacatttttcagattgatcctatgatcaattatattatttctttataatttaatttattaatttgaaagttacaaatgcatctctttcaaattaataaattaaattgtaaaacagagggtatatggaatttgtattgatcatgcatatcagggggcatcgtctggaattctggatgctctgtacgtaagttaaattatcttagattccttgatccataaattacacttgattattcacgaggatgcatggacaatacaaacgatcaacttggaatgagttggggctcagtaggattctttgggaattattacaacctcgcaactctatatattaaacagtaccttttggctgggtaaactactcatctgctctcaactaacacctgccacactgtctctgcttgttgatccattagagaagactgcaacatgctaattttattactgtggaatgattttgagatggatggccacttaacaacacacagacacatgcatgtagtactacactactactgcaaacatgcacgactttaagcatactagctgaaagcatatatttctgtgaggtcattattagtttgattagttttgggtgttggtgtgcgttatcttctttacaaatcccttgacatttttatccagtacacaaattttctagctagctagtttacttgtgtggttgcttcagaaggcatacttgtactatttacaagtatactaatattattgaatgttaattgatgtattgagctgctttaaaaatgtaaaatatagattctatgttaattaattagctgaggcttgttttttaaatatcatattataaaaaaataataactcatgtagttcccaaaacaaataagtctacatacagcttacatatgaagtgagatttcagttgactgccaatgacaaagctaatgcatgaatatgctaggataaatttagaccatctctagaatatgctgaatgaaaacaaaatcttgtcctgatgttctctcatatacatgtcattgatctaactatatcaagtagcccgagtggtgaattatttgatttagctagctatgtaaaaactaaaattaaaataaaatttcctgactatatcttgcaccatccagctgagattgaataaatgtagccatattacattcttggtaataatagcacattgtatgattgtaatattcttgttgaaatcaattatctgttctgattgaaataaacaaataggtggtaggatagaggagtgcacagacatcccctcatggtagcatatagaggaacaattggatgctgaataattaattagttaaccaataagggggttagcccacattggaataaataaataaataagatggactcagagatctagctcagagacccttgtccctaccttaattaattaaaactctgttcagtgtgcttgcatcctcgatcagttgctcagctctagtagtttccttgtggacttcggtgtgccttcatgtgtcgtactttctctagtttcttattttcttctctgtttttaatctgtgcataaccactgttttagctgaagacccgccgcaaacacaggcgatatattccattagatgcagatcttctgcaccggagattggtgtgcatattcataatgcattgattggtggccttgtacgcaccacagaattcagaaattaatttgtttgccttgtgtattccaactttcatgtgggagaacaaatggtactagttaacatatcttttcagtgtgattttgttgtttgttaaccatgtgtagttcattagaaatttgtcttcagctagaaacatatctttgacatgaatcatcagattgtattgccttttaatttagtatgattcttaaccatccatggtagataaataggcactatgtcaagaatataacatatatatatatatatatatatatatatatatatatatatatatatatatttcaactgaaaataatagttccctaaaaaaactctgccaataaaggtcatcctactcaagttatcaagtaggagccatataaccagaaatattggaggaattttctttttatttttttatcttttttgcaaatcctctgtgaaactcatcttctatttctgaagatacctcactaatagttcatttgtgtatacttggccacagcgatggcaaccgcagaagaaggataatcaccttgctaaacatacatggatgaactgtgtgagggagctgctttcactgacaatttttgtcgtacaactcccatccccatgtaatccaatttcagaatcagataaaacaacggggatgcttgtactcatgtgcaaattttggttgcatccctagcttgtttacttgtgtgcgtgtttctaactttgtatactaattaacaccattcatctaaaaaagtagaattccctgttgaaatgagtgttccggtggtatctttctccgtttgaacatatctgaaaagaagaaaccggtccaaaactgcatctgcttttcgacaaaagtgcagatttctctttggttagtgatgacaagattagccaactcgctagaggtgcctaattttatattgttttttaggagattctccatgtagtcattgcctcatgggtgtttcttggagatcatcggccttcctatgctaggccggcataacagggcgtccacattttcacttaacataccaagaaaaagtccactatacatcccttcatctaagggtctagtttcaatcgcgttcctcaactataaaactggacataacatattccccatgttataatataacagtgcaaatacagccccaaggtagtattgagggtggttttcgttaacatagcatccacgtggccgcctagtcgctaaataaattaaaaatagatatggccccacatgtcaatgcccacttcttcctcttctcttctttcccttgcacagtacgggtgttgacgacgagctcacccgtcgtccatgcgagggagatggaggtggtcgagggagagggagacaaccagccagcccctcgaagctcgagctcaaggacaaggacacgggccttctcctctgttgaccaggtgatggcctcgaggaaccgtgtgcacacctcgacacacgcgtcgaagaggagctgaagcgtgacggcactaacgggcgagtggatggtaccaacgagatcggatgtcccaaggaggcggaagacctagacgtgggtgggaaagggtgcaaggagaagtacagagtgccctctaaccaaggagtcgtccttgcatgtcgttgacaaggatgtcggtggtggcggcggctaccggccaaggacactaggtaacgagattgggagtagagaatgggtgcgaaaaagagagggggggaatgggattcggctcctctaacttcagcgtgtgaagtcaaaggtgcacagtaaaatgagtcttgcgctacagtgcctctacagttgatcactgcagtaacagtgaaaaatagtggaaaacactgttatgctttactgttcgcaaattactgtagcgattgatttcgaccgtcggatttacatcggacggctgagatggggtgnagtnacaggtnntgtgcttntnngnccccaccccctaaagtcagaggatctcatttcgggggatgggactaacaagtgcgccttcagtaaaggtggggccggccacatgctaactcaagtatggtcaacaaccacgaaagccgataccactgaggaacttaatttacactgcttctaaaagttaaggggttctatatcccttttttcgaggaatatgattgtaactcgactcttatttttgtgggatctaaaagcgaactttttcctattaccagtgtgctggacaaggctaggttggacttggctttaagttagcggcccagctatttatcagaggagtgcaacattccacaacggccggggtacaccattaacaattcagatgattgaactcaactgaactgtgattttcattattttcaatggagattctttactcaactgaactaagtccttgccagcttggtgacagtttcaaactttcaaattagcaccgttaatggatccacagttatattgtgttctatacttttgctcccccaacttttgttctttcatttctacacacagtcgcgcatgcttctcaaattgttaaacgtcatgtttttttaaaattctataacaaagctttctttagaaaccatataaatcgattgtcatgttttcaactaatatttaattaattgatgcggggatggccagatggcggatgggttcccaaacccgtaggttcgaacgcataccgaccggagtcttgggccggagattagccagcccaacaggccgatcttgaacttttgtttagcaatttgaggctcccgtatccgtttagcaaactgacccaaaaccaaaagcatcccagaagcggctggctaaacaccagaggcaaggcggccggcgaggcacgacgagcagccggcgcgccacagcgcgatcggtcgaagccctcaccgtctcgcggcagcaagccggctaggccaggtcccggtaagcttggctactggctggacagtggacgcacttattaaagattgacaggttgttgcaatttttttttctatctcaaataatttggtggcaacattcatcgttagaaaggtacaatagatcgtctatatatattctaccttcatttttataaatgaatcatttaccacataagttgaattagagaaatactaccagtgagcaaactacaagcacagataattggagattcaatcttcaaagaaccatctaatgtcaggttatctttgctttgtaacatactacaccctaaactaggatgaacagaaattaaaggagttggagagggcagggaattgttgcttctgtttagtgtcatatattatttgtagtatattttgaacatatgttgtgtgattttctgtgcatcatattgatcttggataaatatttacctgttaggttacacgtcctcgctgaacctataatttattcctgtatctgctacttaattaattaatgagatgtgatcagtaaaaaaaattctttgtaactgctggttttctgtttgacagatttttcctgtactagtaattagaatgaaaaaaagggtaatacatgttcattttagtttttacatctttttttccgataggcgggagaatttattatctagcatgcttgcatttacaataatcatttcagtttatgtgtatattactttatgacaactatgcgctcttgaataaatccactccctttgcatgtgaacagcatatatggcattgccacattgctagatttgcatttggaatgtgctttaattcgctttatttgatttcataatagaagactatctgaaaaggcagaatttgaccattgtaaagcaaaaagtttcttcagttgtctctgccacattattattgaaatggagcatatataggacatctatatcactcattattgttggatataagttcaaatttatgaagaaaagtgaccagtggatgaaggcaactaatcaactctgctcctgttgatttgtgaaaatagttgcatgggtgagcttttctccattataactatgcaggcaattataggccaagcgatttaattgtattcttgttgagaggtactcactgaaaggtactcagccattaatctgcagcttatgtgtcaaaatctttcttttcaaatcgtatgcaattccaaactgaatactactaagcacaataaggtgtcccacgaaatcaatataagcggccattgtttgcatggcccgacactgtgacatgccagctcttggttgatgacaagaacttgattaggagtcctttgtttgttgggttaccgtacattcccctgtgatttcaattattcaaataatgtggattgctatttcagagatgaacatacaagctacccaattatctgctctcactaaaacgagggtataatgcgaatccatgattgcctcaatgaattgcaagtagcactatgggcgtaaccaatttgtattcttggcaagttgatgtccaagattcaattctgcactgtcaccgagctgtagctgcagattatgaggctcttattagttttgattgatcgtttgtttgtttgcttgtgttgtgtgggctgggggttgaataacttatctgatttgttcctccaaaatctgtaaaaataaataaataaattctcctgcacaccatattatgtgttcaaattttataggactatgataatgttgtgcctacgttaccacactgttcagatttctgtttgtattatcaccgttaattcatggatgcagagtgtgtaagagagagaatgatatttgtattacaaagagtaatcagtttcaaaggcggaaaatttgagaaaataaggatcatgtcaaactgaagtttggaaattataactgataaaacctgaggaaccatgccaaacagctgaaatgtgtgtttcagaaacagacgaatgattgcgtatctcccagttccttaacctgaattattgcgcagatatgatattcctacatagtgagcctgtcctggcagcctgcctgccatttgtagaactagattcttctaatttgtcctaatcttgttcaacttattgttaggttaaccatcatggttcaggtaaagaagacagacatacactcgggcgaaatttagcaagaggtgtgtatatttacttctacaaactgcagtcacctgcattaacaggtgtaactgtcaaagtgtcaattcctcgatcgccagaatcacacaaacttccagagacatgtttccacgggtgtacatcgttgtttatctgtgcaaaacaacgatggagaaaaagaagcatatggaacggttataatggaacggcttgttcttttccacgcgacgaaggtgataagaagtgagcaaaagtcgatttagcaagaaacatttaagagtagcaaatgatgatcaatcgatttagaacacaccatgattgaaaaataatgcaggtaacgcgatgatatttcaggtggagacacccgaagacaagtcgccttcttgagtccattattatgaagaaaattggttgatgtgctgcaaatatacgatgtgagcttttcttttctgcctttttgaaacttcagcggatgctgataggtgcgtatttaaatcaactgtttggacatgtggctcgtccaaagcaatgaaccattggtttggtacactttgatgaataataatttgtggttttcattgccttacctgtgctggactgctggtagttataatccagtactctaatttcagctaatttccaacaagagaatcagcagttcagctgtagtacctaggttactgccagtttcagtagagaaaggagcacacaaataacagcagtaaaattcagaatgtacaatactgatgtttttgggttgcaatccacatcgggcatgccatattcagcaagttgcaatcagcagaagagtggttcagattgcatggctactcatccaggttgcccaaacaatctcaccaaagaacagtggtgctatcaagcaagatttgcccaacctgttgtacaggctagataccacacaacaaaaaggaaaaggagaaagcgagcaaatgtccaaaacctgaagtttatggcagagattcttctacgatataggaatataggatagttttcattccatccaaaaatagtttcagaactacagatatatatcatatgttagtctccactgcatctttctcctttttgataacctctccaattggccaatttatttttgaaaaagaaggatatatatataagttttcctttgtctcgatagaacttttacggtacaatatattgccagtatatactggcagtatatagaagggcatgctaggaatttgctagaaaataaaataacactttagtaatttttggttcagattgaatctaattgagagtacccggtgctaaaccttatcgtgcactaggggagaagcatcctgagcgccattgttgacaaagcacgtgacaatagcacggtttgatgatagaataacaaagaaaagacaaaattactctttcaaactttatactgtcatctaattaactaaaaaatcaaatcaatctacaccgttaggttatatatacttgcagtatatactggcaccgtaaaaatcctcttctcagttgcatatgtttcctcgtaacagcagtctacctacctaccatcatgggatccttttgagaatcatacagggaatttcaagcctatcagtttaaggacactttgatatttgcatcaagagattctatatctcaaaatgcattcgatataagtcaaattggcatgattacaatttctatgccaacatcaacatgaagcattaagcattaagcatgacccctgaattaaagcagggccacaaaatatttcagacaagaaagaagccaagaacaaatgactctatatgtttcaacttctacttgcaatttaatcgagattcgttatagatgtttatctctcggagcaattttatagtacttgaggaggtacatgaggtaccattttttctgttataaatttgatacctcttgatacataggagtaggtactaggaggtaccaaattttacagtaaatttttggtacgtactcaagaactgtaaaattgctcctctctcgtggcaagaacatggatatacaataaaacgccaaagttaacagctccataggcttgccaatgaacaatctttcccaaatttaatgagcacaactacgagaacagggtattagtagcagcatttagcagcctaattaaacagcaacagtgccacatgatacattcatcaggatccaccacacaatcactgtcaaaaatgctaaactagactaataaactaatcaatgatgagtaataaaatgaaaaacaattaaagatactgggatcaatccttgttgaaagatcaattctttcgagccaactgatccatcattcattcggcttcagccgcagcagccgcgccgccatggccgccgccctccaccggaggcggcagggcgtcgacgacgaggccgcgcaggccggccttgagctcgttgtcgcagaacctgcggtactcggcggtgtcgccggccttcttgcacacctggaccatgacgagctcccgcgtgagctcgaacaccttggcggagatggcgagcgcgcccttctgcccgttccgcgtcgcctcgatgctcacctggcagtccttggtccgcgccgtgaagctcaccatcccggcgatctcctgcagcttggcgataatgtcggccaccggcgcgccggacacgaagcgcatcctctcgccgcgctcctcgaacagccccgacaggtcgaagctcggcgacgacgcgatgatgtcgaacgcgttcaggctcttgggccgcggcatgcgcggccggggcgggagcgggagcgggagcgggagggacgcgctgtcctccatgcggtcgagctcggacagagccggcgccgacaccgaggtgtgcatgccgcggggcgttccggccaccggggtgggagattccgacgacgacgaggactcgatcgtgtcggtgtcggagtcgtacagctccggctcgccgtcgaggccgtcgaggctgcggaggcggtcgttgctgtcgatgtagtaggtgacctccttgaatcccctcttgaaccacctcatctccatgatctctggtatggtgatgcggcggtcggggtcgggctggaggaggcggcgcacgagacgggcaaggtcagggctgaacgacggcgggcactggaactggttctgcccgatcaggcggtagagcctggagacgtgctcgtcggggaaaggcttggggccggtgaggagcacgtagaggacgacgccgcatgcccagacgtcggccttggcgccgtcgtagccccggcgcttgaacacctcgggcgcgaggaacagcggcgtcccgcagacggtctggaggtgggcctctcgccgctccatgtcggcgagcgcggagaggccgaagtcggcgaccttgaggttcccctgctcgtcgacgaggaggttgtccagcttgatgtcgcggtggaacacgccgcgggagtggcagtaggcgacggcggagacgagctgctggaagaaccggcgcgcctcgtgctcccggaggccggcggcgccgccgctggggcccctgcggaagtagcggtagagcgcgccgccgcggacgtactccatgacgacgcagatgcggcgcttgttggccatgacctcgtggatgcggacgacgttcgggtggcgcagccgctgcatgacggcgatctcccgcttgatcagctccgtggcgccgagcctgacgagcttctccttgtccatcaccttgatggcgacctcctcgccggtggccctgtgccggccgaggtacaccttggcgaagttgccctcgccgacgagcggcccgaactcgtaccgctccgtcgtcatcgccggcggcttcgtccccgtccccgtccccatggatcggaacatgcacgcacgcgcgccgcggcgggcggcggcggcggcgagaggacgcggattctgctgctgttaggggggatcgaggcaaagggcggctcgacgattggaaggtggttaaatacacggatcacaagggtttagcacgcgagacgctcgtgagttcgatggaaatcgccagccgtacgccgcgccggtcaatcctggccgttcttttgttcatgcggctaggattttctggcccgtgtataattgacagggcatatggactcatggaggcccatcatagctcccccttcactttcgttgactagcgggagttttttttcttacaataatgtgagaaaaggtgattaattgaaaagcttaattaggctcgactcgttggcattaatatatcattgggtatattgtaaaagacagtctagcctgtttcgcataagctaacttcagttcattttttgtttttggtatagagagtgtatcaatttgccattgagatcgtgtgcaggtacaattcgttaaaggactgcagctaatctcatctattgatttttctgcctcttctactaccgtagtatctttgtctaccgcaaaacacagtactacctccataccaaaatgtttgacgctgttgacttttttaaaaatgtttcaccgttcgtcttattcaaaaaatttaagtaattgttaattctttttctatcatttgatttattgttaaatatatttttatgtatacatatagttttacacatatcacaaaagtttttgaataaaacgaacggtcaaatatgtttaaaaaagtcaacggtgtcaaacatttaggaaaggagggagtatttttttaaccaaaaatgttttcgaaattagatcaaacagatctggtgtgtgaccgtttaagttacagtcacactattgactgcatgagaccgaatccatcaattcatatgcactgccgctaaactgaccattttgtttggctatggttgtacatatatataagcacccgctccgaacctatctctctgtttcatattagaagtcatttaattttttttattagtaaaatttatttaatattgattaagtttataaaaagtatagtaacaattcaaatataaacaaacatattattaaaatatatttaatgtaaaatttaataaatttaatttgttattatagatgttgttaaatataaagaaattttaataattaaaaagtcaaacgatttataaaaaaaatgaaacagatggagtagtaatcgagagcaggacaacggcactcattgtacatagttagtacggagtacaatatatattcaagaattcttccagccatgtccggcagattagtgacacggtgccccttggtgtctgtttggcgtacgtttctcctggcagataatcgaccaaccaacaaccgtccagtggaagacacctgcacgagatcattgcatctgtgaattgtgattctggtcaatctcgaccatgattggatttctaattaaccaagtcattaattacaataatcgtcgtcgtcgtcatatcatcacgaggacctacaaaaattaatatcctagctacaggagctagtttaatccagctaattaacaagctagccgactcaaacgtcacgcgtacaggcaactgacgcctggatcgtgcatgatatgcatggttttgcctgacaaacgatcagacacacagctgggaatgattcatgtatacgcgtatgctgaacaagtgatcaagccgcgaaaagaggaggaaaatgttaccccatcttttgcaaaatataaaaagtttcagaattgaatacgagtattatgaaaattgataaacttaaagaaatattatgattggttaagaaaagtaggtagatacaaaatttgaacagttaaaggttatgatttgttaaggaaaaattatagatgaaaaattattatattttgaaacaaaatttaaatgttagaagttgttatattttgtgaggaagtgggcttttggtcttgaatctttactacttaaaaaattcatagtggtggtggtgagtcctgaacgatcaaatggttaacattcatcggagaatcctctcacaggaatcagcggatgagattttctcccacgatccacccgtcgcaccccttctcatctccccgatccgcatcgcgctccctctctctccgatccgtaatttcgcatcgcactccccagccccccatccttcctcctcggcgcgctgcctcctcaccccaccgacgcgccgccttcccatcccgcccaacccacgccttcttctccggttgtcctccctccgtattgtgccgtccctcgctccgccccctccctctccatcgcgccactgccccctccataaaccataacctccctcaaatcccgatcatctgcgcagccgtcattatcgtcagaccgagttcttcgatcatcaccctccgttgccgccactgcatcggacccatcgaaatggtggataggaatgcggacctcagtatggttgaggggtaggacgagatgatggcggtggttgcaggcgcgcccaccagcacaatcgctggagtgtggagctagaggagcgcgcccgctgctgcgagtcaccggcggtgtcgtcggcatcatcgtcagctagctctgcatattaaaaacataatatgagttgtcaagtaaagttagtgcaatgtaataagatgtttttaatttacctatgagaatcactattagtatttcctcttgcatcaatttagtggaagatatcaaaaaacaacagaagatattcaaaagggaactatttggatggaaatatgcatatattgatggattatcaacacctggaagctaatggtaaatacaatttatttttctcgatagcctagcaacataatttcattaggataaaacctttattcgtacctaatatatttccctcttgctaagatttagctcagggtattcttcattcaatggcctagccagatccatgctgcatgttaattatgacatgggttgtgctgtttcttggtggagaagatcgttaagtatctcctggcatgcatgccgctgccattaacattctttcttgatggctgtgagcttgtcatattttatctggtgttatcccggctgatgagcatcccattcgattttttttctttgtttacattggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55690 - DNA, 770 bp, Oryza sativa
cctgcagcccagtgtaatagctcgtggatgagtgattttatccgccagtaagttgtcatggagcatgtatcctgggattagaattatgttgacaagaaggtgattatggtaaatttatttctcgtgcagataccacaacgtgaacatcaatgttgctgtacagactgagcatgggttgtttgttccagtaattagggttagtaatctgaacttgtctatttatatgaaaaaaaaaaaacattggtttctagcttgtacctgtgtttcaggatgcagacaagaagggacttggtacaattgctgaggaggtgaagcaggtggctcaaagagcaagggataacagcttaaaacctgaagattatgaggtatatggatcgcatggtagctaatataagcatgagacaacatcatttttccttgaaaattctggtgcttttcagggaggcacattcaccatatcaaacctaggaggtcctttcggaatcaaacaattctgtgccatcataaatcctcctcagtcagcaatcttggccattggtactggtaagtcatgctaatatgtttgtgtaataataacggtagcatcctgtattatctgcatttctttctagtatcttttgagaagcatattatctttgttgccccatcctattatttttaagtcgggcttctactcagaaatttggcatgatgttacagagtgccaactgcttagtagcatttagccttttataaacagggcttaagcatagaattcaaggtgtagtaga

SEQ ID NO: 55691 - DNA, 10794 bp, Oryza sativa
ctatcggcgcagaatttctgaaagcattcaagggctatatcgagaatccaaactcaatgttactgtgaagttaaagatcagcaaaactattcttctcatgtgctcgaataacgcagagtggtgctatctcattttgtataataccggcacggtgttctgtcaaggaggacccgaaaaccaagagcacataaccatagacagaatgacctggtttttggattaaaagctttttctgtttatcttttttttttttgtttgtttgtttcgttccagttatagtgggaattaggaggatcaacttacaagcatttttagcacctttttgtgggtttaccctcggcaagtgtgataactggagagagtaaattcccgggaaacaatgcagtatagcctgtatacgatttgtcccttttctttttccccttcatagtgcaaaaccaagaggcgcagaaggatctttcggaataaattggcaatcttggggagtatggcttatactgtttcttaagcttttgtgtagagaagtagattattggtcataataaatcatgcatttgcttatttcacatacatgtttgatgtgctgatttaattttgggcctttaatggagtacaataaaacaaaaggaagcttgttaagaaagaatatgcctgtgtgttcttctcctccaagtcactgattttcttttttggctgcccatgggaagtttgatcgtgtattgtctgcttggtcggtgcattgttattttcttccacgtgagttggcacaagtgctctcatatttcttgacctactcctatgtgcgttgattggttgtcattctttgaagctgcaggaccgagaaggtaagacgaatcttgtccctcgcagtatgcatttcagcgttcttatggaagaagcttctaatcaaaaggaaatgaatcgctctagtaatcccaaatccacacgcaattctgaacgtcaaatggaacggaatgctagaaagcgaagggagactataaggtcaaaaacttggaaaaaggaggagatgaaaaatggaaccgatttcataaggagctgagcttttcatagctccgcttttgataattgcgatagcatagcataattatcctccaagaaacgccggaagcaagagcaaaaccagcaaacggccaccggttccaggacagggttgcttccgggaaagatgcatgatgcacagttttccatcaacatccgtaccaaattaagtgtttctttgacagcgtgccagatttggatcggtcattcgttgcggaaagtagtaccaatgacttactgctactattaatctactactgtttcgcttaagtataggtaaaggaaatgtaaccctatttcgagaaaatatattagtggtagataggatagctaggagatccaaagagcagaatggtatactgcattagatatatccaatgtgccacgatgagtggtttttctttatctgtttgtactaatttgcgcacttttgaccgataagcgggccggcatctttttaaatagagaaacacgcgatatgatgataggcagtgagatttcttcacaaatactgtacagaacagtagagcagtagtagtagggcacaaattgatggaatcaacttagcaacctttgtagaccgtcgtcaattttacaagggagagatatagtagaatgcgggtacaacagttcatgctgtgttgagttatatattgtttttgggtttgtgattaaacagtgtaacaacacggaaaggttcaagacgagcaaacacgtcagcatgtacaaacgcagtgtatgagttaattaattatatggttagcgtgtatcgacattctcgataccagtttaaaatatgtgatgatattattagaccttgcacccctataaattagggccggtgaacaaaaccatcaacgccttagtttttgattttgaagaagaaattgttgtcagcatcattagatcttgtgtgagtatatttgagagtcaaatcagcatgagcggtttggaaaaccgccgtctgtagtgtagcggttttgtctccagagcgacctcttctctataaagaggaggagaacttccatggaatgagccacaaaaccaccatcgatcatttccatttccattttcaggagagatccacatcgccgttggcctttcatccagtgagtgagggagggagatctcgatctcggtctcgcgacatgaagaaggcttcgtctctgtcggagctggggttcgacgcggagggcgcgtcgtcggggttcttccgtccggtggcggacggcgggtcgacgccgacgtcgcaccggcgtcggctgacgaagatatcggtgatcggcgcgggcaacgtggggatggcgatcgcgcagaccatcctgacccgggacatggcggacgagatcgcgctggtggacgcggtgccggacaagctgcgcggggagatgctggacctgcagcacgcggcggcgttcctcccccgcgtccgcctcgtctccgacaccgacctggccgtcacgcgcggctccgacctggccatcgtcacggccggcgcgcgccagatccccggggagagccgcctgaacctgctgcagcggaacgtggcgctgttccggaagatcgtgccggcgctggcggagcactcgccggaggcgctgctgctgatcgtctccaaccccgtcgacgtgctgacgtacgtggcgtggaagctgtcggggttcccggcgagccgcgtcatcggctccggcaccaacctcgactcctccaggtccgcttcctcctcgccgagcactccaggtcaacgcccaggatgtccaggtcaacaccttacccctctctctctctcctccactgccattgccattgcccattgtccattggccattgttgctgtctctctctctctctctgcgacaaagtgacatgtggtgtggggcctagctaaagcatatggttggctgagtggtggtgtcactgcccacccacatgtgatgacatggcagcctttagcctttatcctatttccatggatgactagcttcctgcacacatgtgacaagagcgaacacatgcttctgacaacttgataaaagcccaaagatgcttagttagtgctgatatgatattattaagattcaactgaatagaatcgaatgccttgggttgatgctcctagctactactatatgtggaataatacaacttaggatccgcatacgggagaacgttttggctaaaatttccaacaagacaaagttattatcatttgactaatcgaatattagtaactacaaattttaaaattagttttttatatataaaatcaaattgcgcgcctagcatcattatattttctatcatataatagcatatatgttttctcactatattattcaaatatattaaaatgacaacataattttaaattttgcaatatgtgtaatattcatattatattttatatacatgttagttattaattatttttaatatcaaattttagttatttataaattgtatatattcctatatggactctagactcgtcttttaatatttcctttttttaattccgaattttctgtaaattgtatttctatatagactctatgctcttcttccaatattatttatttttatttctgaattttcatattatattttatatacttgttagttattaatatcaaattttagttatttgtaaattatatatattcctatatggactctagactcgtcttttaatatttcttttttaaattccgaactttttgtaaattgtatttctatatagactatgctttttttttcaatattatttatttttatttctgaatttttattatttctaattgtatttctatgtggactctaaactcatctttcaatattcttcaatttttaatttcgaatttcagttactaataaattgtattcttatattgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctattttttttcttaattgtatttctatatggactctatcctctacttctaatattccttatttttaatttcaaatttctattatttcataattgtatttctatatggactctatactctacttctaatatttcttgtttttaattccgaatttcagttatttcctaattgtatttctatatggactctatactctacttctaatattccttatttttaattccgaatttcagttattttctaattgtatttctatatggactctagtctcttcttctaatattccttattttttaattccgaatttcagttatttcctaattgtatttctatatggactctagtctcctcttctaatattccttattttttaattccgaatttcagctatttctaaattgtatttctatatggactctgctttttctttttctccgattaatgtgagaatttctaagccatgagagcgaatgtggaagctcctttttctattcctttaattatataatagataatttgtatataggaaacttttgcatcaaatacaccatttactagctaaaaatgagttggtccctctttaagaaacgaaacgcagctccagcattaaacaaatggagagaataaatcttagaatgactatcagaaagaacagtctaatctattatgatgtaatacggcatttttattattgaaccaaccagagagaaagatgtgaaggtgcatcagtagtgattaacactgaatagttacggggggaaaaagtccattttaaattgggcctaacatttcatcgctccacgattaattaaatagtggtgatattagggttctattgaacaattaatcatagtgctaattactattgactagacattattagtgacatgttagttgaggaaattgacaaaataatgaatgaaaaataaaaaaatgcaggcgtacatggtgggagagcacggggacagctcggtggcgatatggtcgagcatgagcgtggccgggatgccggtgctcaagtcgctgcgggagagccaccagagcttcgacgaggaggccctggagggaatccggcgagcggtggtggacagcgcgtacgaggtgatcagcctcaagggctacacctcctgggccatcggctactccgtcgccagcctcgccgcctccctcctccgcgaccagcaccgcatccaccccgtctccgtcctcgcctccggcttccacggcatcccccaagaccacgaggtcttcctcagcctccccgcccgcctcggccgcgccggcgtcctcggcgtcgccgagatggagctcaccgaggaggaggcccgccgcctccgccgctccgccaagacgctctgggagaactgccagctgctcgacctctaataaatcttattattatcatcgtcgtcgtcgtctcgtcacggaattaattaaagtacctactccgtacttagctagctacaataataaggattcattgatcactacaagagtgatcgactcgactgtagtatgtgtgtgcaatataatgtgctgtctatcaacaactactagtattgtcatttttttcgaaccagggaactttttaatgataagaagaaaaagacaagtacttattgtcgagcactcgtggacaacactgtgattgattgccttgatcaatcttaccaatttttggtagctgtaaataatttacatagtttgttggggcggatgagcaagcaagcaagctgaatgggctgttgatccggacgaacgagccgcgcattccttgcttaattaatgggctgtcagtgggcgaacgaacttggtggggcggacgtcaatcttttggccaaaatttcatgacaagtgcagtgcggtggaaggaaaggagttgggccaggccggtaggattatttatgatgggctgggccggaaaaggcagcgatgatatagagcgggctgggcctcccaatggctagcaactcttcataggagaagaatcgtgcaacaatacacgcccaagagaagaaaccgcggcatggaaggaacaaatcgtggtgcgctctctgcgtctgcgtgtgcgcatggcatcgtgcagtccacaggacaggagacggcggatcgcaagacatccgcgccgcatcgggattccatcctttccctcatgtatactatctccgttccaaaataagtgtagccataaatatccgtgtttagcagtttaaccatccgtcttatttaaaaaatattaaaaaaattagtcatacataaagtactatttatattttatcatctaataacaacaaaaatactaatcataaacttttttcaaataagacgaacggtgaaacgttaaacatgaataaagctaaaacagtacttattttagaacggagggatcagtactctgcgtgagtgctcgtggcgtgctggttggaaacgaccattgactgattacgtgctacacgtggcagacagacatgtgggccctccccactcccttccatgcttcagcttcacacgatcgatcgatcgatggagatgcggcgatagttgcgctcctcctcattcacagtccacactgccatcagccatggggggcagccaccacctcttccgcttcctcgccgccgacgaccaccctttcttccccaccttcccaacctcctcctcctccttcctcctcgacgacacccacccatttttcttccctccctcctcctcatgcccactcggtttcacctctcctccttcatcgtcttgcccactcggcttcacctcctcctacgacctcgacgccgccttccaccaccatctcgacctcgacctcgaccttgacctcttcctcccaaccccgaccccacctgtaaccacctcctgccccgccctccgcgatcccttccttctccaccactccctcgcccaccgcgtctccgcgcttgagctcgccgccccacgcagcaagtacacctacgaggccgaatccgccggcaggaagatcaagtggaccacccacgacaagcccgacggcgaccggaccttcaagtgggaggcccagatcgacacccccaacgacgatggcttcgaccgcaagtggaagtgggagtccaaggcctccgccgccggcaccaccaagctcaagtgggccaaggaggtcaagggcaagggcttcctccacccatggtcgcacgcctactccgtcgaggaggtcttcggggacgacgaccaccaccacaaggcagacaagacagcagaaaacaaggtcaagcagcacaacaaggatacttctgccaaggaggagaagaagaagacgaacaagtctaatgttcagatcgttgagatcgacgacaacactgccggatgcgtcgccatcaacaaggtcacatcttctcctctacatttatttcattatttatttattcaattggacttggtcctagatttttcctattcagagtttcagatctaggagtagcagcttgttatctcaagcttgcgacgtgaggtttgcgcaccgatttgcacaaatccgtcatgtttctgatatgcaaagatctaatatacggagtacttaactactactccctccgtcgttttgactttaagattatggacaaacataataatatttacagtactaagttagttccatcaaaccaataattaaatatattttcataataattttgttttgggttaaaaatgttactacctttttctataaacttgatcaaatttaaatagtttgacttttaccaaagtcaaaacaacttataaactgaaacggaggtgtatttccgatggcattttgtaagggaagccatacccataaatgtgattagcaattgctagtaacagatagtagatcgtcaattttcgtgtgcgctgtactgacaacacaacactggttttctcaaggcgtttgcaagcagctacgccaagggcaagagaaagcagctgtccccgcaggatgctgcattgttgatccagatgaactaccgggctcacctagcccaccgctcgcaagtgctgcgctgcctccgtcatctggcggtggccaaggccaagctcaaggacattaggtccttgttctacaacatctcttaccgccgccgcatttcgcatgactctgaagagcgtcagaggtttgccgacaaaatcattgccctgctcgccactgttgatgcccttgaggtattaagctcatcaccctttctgatcatgccgtttttcattaacaagtggcccccatcaaaattttgcattccagacaatttcttcttgttatatagttatttttatttattactatgggtgacgattggtaaccatgccaatgcatgtgttgttatttacgcgtttatcagcaatgttgtttactaccaaacgttatttgattgatgaaatcatcagtgtagacatgacagtaaaccacacccaattttcttccgatagtctagtttagggtcctgactgaatttatggatatcaatacctgcaacaacatggctctcatacagtacttccatgtaagataatctaggtgtaagtgaagaaggatgaaaacaccagaaaaatattttctagctttcttcttcccccaattcttcatcagaataaactctaaacaataacacatttgttgatagctacgtgagggtagtttcttaaaaagaaaagaaaaagcatctaacagccataaaaaaacaaagaatactgtacatatatattgttttatcatgggctctataaattggaagattaagtgccatgaaatgctttgatcttttgccatgtgtgaatgttttgtgcttacagggaccagactatatggttcgcaatgcaaagaggtctatgctggaggagctggaggggatgctagagatcgtaggtcctcagtcactagggaagccaaggactctgagccgcagaaagtttgagaaccatatctaatgatatgaggactggtgtcaagggcaagtgaaaggcaccatcggttctatttcgtagtgcggcgtatgaagatgcttgatgggggacctacctttctgaatgtgtttacggtttagacagaatgttgtgtctgtaactctagttgtatgatctatcttctgcttgaactagtacttatgtgttgctagactagttagagcttctttataacctcttgttgtttgaggaagcttcttgtagaaactgtttcataatttgtcatgaaatgatgtgcggcatgtgccccctaataaataagaccattaccatatggtatgcatattggcatggtgcttttcaaccgatgcatctaaccgtgcggcgtgttgccaagcctccgcgttaccggccacatccaatacggataactgcaaaaaaaaaaaaatgctaaccgattgggagaggcaatgatggaattttttggtattccgggtcgttgttgtgttcaatatgtgaagcatcccgttcctctcaggcaaagaaagttccaattcaactggcaagcactgcaggtgactgctgaaacccccatatgttggtgtgtgccgtgctcatggttatcttgtgccgctttaagtttctgtagaaggtttgcgtgatgtcattgcatgcactgggggctgtacttatactgatctaattgtaagtttgtatattataccatattcatcaggctatgttcaagtttgtaccacttagggtgtgtttgaggattggggagattggggagattggggagattgggaagatacgcaaaacgaggtgagccattagcacatgattaattgagtattaactattttaaacttcaaaaatggattaatatgattttttaaagcaactttcctatagaatttttttgcaaaaaacgcaccgtttagtagtttgggaagcgtgcgcgcggaaaacgaggtgttttctctctcaatctccctcaatgtcctccaaacgaacgctgccttaggttgtatttctcattgatcagtatattgacatcgaagtatgattctttgtattttggtaaccctgtgcacatgttaacgagcgcggcgtgcttatacttcttgtaatataaatgcttgactccgcccgccccaatcgatcccgagctcgagcaccttggtcacccatcccgttgtttccccactctgttccaagctggtccttccggagcttcgagtctctgccttggcttgggccaccactccataatttttttttagataatggaatgaaacattcctacctttgctcattagagctaaagccaaccacttcctccctacattccattttccacatttatttaactggccgattgcaccatccccatccacccccacgtctcttctacatctccctcccggacccaaccaccttccttcctattccttccacccccaagacccatggcctcctccccgccgtgacgtttaactatttattactcctagtctatgatatgtggatggatgatcttatggttaacatatactatcatctatttaaatgcatattacaactaagataagttaagacatcttccgccttcccgcagcagaggagcatcatccaaaggcaagggaatgacagcgcgtgcaaggctccacaagagtcagggttgttataggtgaaactttatcctcgatgtaccttcgtacagcaatggcgggctgc

SEQ ID NO: 55692 - DNA, 4927 bp, Oryza sativa
acatgttagctcaaccaagctctttgcggagttgaaccctaagatcttcacgctcttgaggcagtcatggctgagctcgggcagctgcctcaaatgtggggaagaactttcaataatcgattcatgtgccatatcgtcctgacaaacctggaggtgataaaaaggaagattatatatgaatgaatcaatggtccatccgacagatatctttctttgcaggatggaataatggatgaacagcacagccttacatccaagtataaagtctccaaggaaggagatgcatcgacgaaagaaaccagaaagaaataatcataggatggggaaaaggtccctcccgcaatctgaattgttaggtgcttgaggtagaggaatttggtaggcaacattggtatattaaccgcctgcacaacaaatgcattgtcacatgcagaatatttctactgtcatatgcatatgtatagctactatatatgcagggtcttagaacatacctcagagtccgaacctaattccatagtctcaaggagggcgataggcaactagttttgtaaatttttcaaatagaaaattatttcttgttaacaaccaaatttggtaacatctgtgtcaggaaagaagattggatcaaagcgaagtcggaggcgaagatcgagttcggaaacagagtaggaatcggctggagtccagatcggctatgattaggatcggctgggtctgagtcgggctaggtaagccgatacagccgattccgacaatacgacttgtgtacgacatcgggttcaagttaatgtgcttcaagatgattgccacgcatggatagagtcctgggaaggcaattgtatctattaattaagatattttatgtagattccttatagataaatgtgggcaaaagtctgccgcaaagacttatggtatcttagagtttgtaagagataatagtcatgtccggtatgggcatatcttgtaattctcgggtataaatagaccctgagccctatgtaattgataacacacacgttcaatacaatttcggcgcatcgccaccctttttgctttagttttgtttcgacgagttcttgcttttgggttgagctgcatcggtttcgatcttcaacaagaggtaaaacttgttatgatgacttgtattctcgggattagtgcttccatctttatgatactctaatcttatttatataattcgtcgagttatcatatatcttacataatctctagcaatatcgccatctaacctactatcggttaacatctgttagcagagggcaaccgattaggttagattttgacgttgatctagattatataagatatctaccactctatgaaacttctagcggcttgatttctagatatcgttcttcatttcatacttaatgttgtatcagttaagtttgatctgttaagtcgtgcttagaatatcgatctctagcctgccttctagttgccgattagaatagcatcggagtttcagccgatcttatccgatttaactatatttgttatatatgctttattgacatgttaaatctgctctttatatcaagatattgttgtatctaagtatgttaggcctttgtttgatatattatacatgctttaatatcctgatatagagtagtatcagagtattagccgatacatgttagatctatttgatcggctacgctataaacatatatagtcctgttattgatatatatttcaatctaagtgatttatactgtctcggcatggtgactgatctatcccaatcatttgatttaagtatatatcgatataaggagtatatatcgttaatatctacagccgatcgagtagatttagttcttctttacttattcatgtctgccgatcgatacacagatgacatcggctcaaaggtaaatgatatgtcatcggcatctagccgatcggctatcatttatagatttaaccacggtttctttgcttctatttcttgttgattacaggatcaaatcaactggcacgctaacacacctgaaggtgagctttggacctgcactggagttaagcagatctcccgggccacgtgttttctgtcaacacttttgtaaatatttcaataaataaaattaaaaattaaaaaaaaaatcacaactagtgcaccaactgcatgtggacaggagggagtatgtagtatacatgtagattgtgaatggcggttggaccgcccggctcaccggtcggacaagtggaccgctgaaacgagagttcgtccgggtcatccatcggtccggctttttttactaaggtttaaagggcgaaaatccgattcgttgtaaaattaagggatctcagatgaacttataccatttcttgaaatccggggcgggctggcgtggattctacccggcctgctcccttacttcggccccatatactaccagcccacgaggcccatgcatccactcttccagaaacttccggacttccagagtcttcgacacggatagcgcctcctcccagtcccatcgcacaacgaccgttggattgttgagccacggatcgcgcgttgatccgagcaatctgaactgttgctgcgccacggattcgttcgctgtctcaaattcattttcagatttcccgctccccggttcaaaatattcagcccaatttctagtataaatacccggcacaagtagggaatcaatcgcccccaattcgatcgagagagagagaaatggctctccagctgagcggtctcgccgaagtcgtgcgcgaggtcggcgtcgccccgggcccccgccgcgtcgtcatcatctccgacatccaggcaggcgacgctgctgtcatcgacgagttaatggcgatccagctcggtgtcgatgcgtcctgggaattcgtcaacagggagcggctcaggaggatggggcgcacctacaacctgctcaagatggtggaagcggttctcccaggcctcatcgacgacccctaccacgcctccgacttcctccgcgacatggagcataaaatcaggacccgcgctactttctccggtgtctccttccgcgtcctcgccgtcgagttctgcaacctcctgcgcgactacaacgaccgcatcatcgctgatcctcccgtctctacccgcgaggagctccaggaccacatcaacgagctcatcgcccaactcgatgaccttctgcaccagacctgcacgctgcgccaagatgacccggttccatgaaggcaagcggaaagttcatgtgaggaggtcccgatcgtacctagttgttcatctgatctgatggtagttacagtagcagtagtagtcaagtagtcgaatcagcatgttaatcctgtttgaaggagcaagtagcagcgagtaatgtcactagtagtacagcacagcacagcaacacaagtatatgaggatgtacccgcacaaccacagtatagacaagtgtgaaatatatggaaccaccataagttggtttgaatttgttctcaatcgtgttgcctgcttggtttcagttcgttggtggcaagtcatctctcttctgaatcttcttgtgaagttgttttctgaatcttgctgtgaaattgttttttctgaatcctggtggtggcaaatcgtccgtcttctgaatcttcttttcccctagcttctgttctgtccggtttgtgtacacagatctggttcgcgtcttttcacccaaatttttagatgtttctgtctgtgtatagaatcgtccggtcgattgtgtttcagtttcttgcaggattagtctgctggccaccgtgctctctgctagcttgtggtagtaaatcctttctcctaccttgatggttttttttctcgcacacatcgattctgatttcctccggttttttgctcgttcctccgatgtaggcgtcccccgccctcttcctggcaggggctttggagcggtagagatgcagttccaagtccttccccggcaacccgatctgccatgtgccacaacacctagtaagtggaatatgttttgattgccttgtgccagattataatgagaatgagaaaggtgacaattacttctgctgtttgcctccctcctgattcacagtttcatactagtatttagcaagtttttctctgtgttttacttaatgagattgctgtttgggttgtggactttagtattgtttctgctagttaatacatatcctgcagtcttcagtctaaccacctacttcatttgcttgcttgtctggaagggaaacacttggttgcattactgtgtagattatgtcagatggttctctagctgcagttactatagtaaaattgatcatcctctgaatcattgcaggtgggaggtggcatgaatatcaaatctgattgtgacgaaccatccccgtatgctgctattcttgcttctcaatactatgttgtactgttgtttcaagatttgtatgcaggcattgttcttgcgtaggacaaacggacatatcttgggttacctatttttggaattctgttgagtttgaactaacatattgccttgctgtacgttgagaacaatttgttttgctcatatacaagtttcaccactagtatgtcttgattgccgtatgttttgattataatgaggatgaaaaggtgacaattacttctgctgtttgaagagagctctaaacacatgatagatgtgccttttgattcacggtttcatgtttagcacgctctcgatcgatgatgtaggaaggtttatttgtgtttacttgatgaggagcaggaacatttcttacattttgctggttgggatgtggattggtaacgtgttcagttttcctactgggcagttgcatgggatgttttggcatgaaattgattttgacacaacttgtaattgttgtgtactctctccgtcccaaaaaaaacccaatcctgggtttgaac

SEQ ID NO: 55693 - DNA, 1433 bp, Oryza sativa
gacatgtggatcaccatacttgggcttctcgatggaaaatctctggtggcgaacaagcttctcaatgaaatcctcctcaccagggcgactgggaagctcagcatattctgaagcagaggctagaatctccaggagccctttcatcttagtcttttgagttagcattgaactgaacctctcaatagttgtgtagctaatgtagtagtacgaagcaatcagaccaaggttgaggggcttcaggtacatatcctcctctatagccacacacttgcttgattctaggtcattcaatacagtctcaaccaactcagataaatggtccgacaaatgcctgtggctcacgccctgcagattgtagtagttagggttcttggtcagccgcctgtacatgaaggtccaagtaaggtaatccacagcatcttgcttgttttctatgacaccaaccaccacctcagcgttcatatgatcatgcaagaagtggtgaagatggctctcaacagggaaggcctcaaaaaggaacttcttgtagtattccttgcgaggcgcatgacacaatataacacatttccctgagttatcttgaagaggcctgctagcatgacccatcatttggagtagatcagtgattggataatcagtatgagcattctcccggccatcataatactgggttcccatcacaaccaccagatgggcaggcaatgatcttccccagcacacagtgctactcgcaacacacacttggatcctcccaccgagaaacagctgcgttacaacttcctgttccagatcacttaaaccttcatgcaagtagcctacaccacatttcagagtatatttaagtgtttcatcactgataccaccagtgaaagcatccatctcatcttctgaaccaagaaggaaaggtgttccaccaccctcagcactcgagtatgcacacaagtccaatgcagtcaaccttgcatgcttccgtgtaggcacaaacaccagggcaggtttaccattctttgcatgttgggtaatagcagtgtatgtcggcttcgtcattgcctgcatccttgcctcaaaatttgctatatccacaccctgaatgtgtatttctaatggcaccggccggacagctggaggaaagttgaaaaggccatgagaggtagcaccaatccattctccgagatctttagcatttgcaagtgaagctgaaagagccacaatccggatgttactgccgatatgacttgcaatacgcctcatcctagagacgatgacttccagaacatgtcccttttcagatccaatcagatgaagctcatcaacaatgaataggctgacctgttggacttgtttccgctgtttccaccggcgagagagtgcatcccacttctcaggagtactaatcataatctcccctttatccagaagcttcaagtcagctg

SEQ ID NO: 55694 - DNA, 772 bp, Oryza sativa
cagaacattgatctttgcactgggctcctccaagctttctttcacaggaataggcacacgatccaaaagcttagccagctccattttctcatcttgtctaacactgacatacttgaattcttcactgagtgaaaagagccgacatagctcaatatcacccattgtaggcttcaggtactcattgtaagttgaaatagtcccgtggctaatatagtaataactagcaatccttcctaggtcagtaacctggaagtatcctgttttcctgtcatactttatcaaattgttcctatcgagcagatttgcagcagagtgcacctgcagaagcacagaagtacaagaatcaacaattgattgagcatggactagaaggggtaacaaagcagttaaacatcaagagagcatacagagaaaccatacaatatgaacaacacaagcatgaatcaattgtcaactagatgcttcagctatggaattcagccaacaaaaataatgagttgaagttgcgcactttttacgcattttttacatgctaccttaccctgtagttcgagtgctaaattgatgcacaatgctacatcggtagtcaagatgcgcatacatttcaatagaagagactggcttgtatcatgttgctattggtcaaagagagcaaatatacaactattaagtgtccagcaacaaaatataaagctacactgcaaacagcattcggacaaataaaatccaaggccattatcctatttctattatacactagtacatgctaatg

SEQ ID NO: 55695 - DNA, 7031 bp, Oryza sativa
  unsure (1)..(7031): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagaggagatgctatggcaccatagccatcaatgaactttcggtagtaaccagtgaggcctaagaatccacgaagagcgcgcacagtgcgaggttgaggccactccgcaacagcctctaccttgctaggatccatggccaccccacttgcagaaacaatgtgtccgagataagtcaccttttcttcaccaaagagacacttggatcatttaagcaccatttggtgttcttgtaacaccaacaaaactgctctaacatgttgaagatgttctgcccaagaagaactatatatcaaaatgtcatcaaaaaatacaaggacaaaccgtcgtaggaagggagccaatatgtcattcattaaggcctgaaacgttgctggagcgttagttaatccaaaggccatcaccaagaattcataatggccatggtgggttcggaaagccgtttttttgacgtcatcaggatgcatgcgaacttgatgataaccactacgcaaatccagtttggtgaagaagcgagcccctttgagctcatcaagaagatcatccaccaccggaattggatatttgttctttatcgttttgctattaagggctcggtaatccacacaaaaacgccaagttttatcttgcttcttgacaagtaatactggagaagaaaattcggaatcacttttctggatgataccttgggtcaacattgcagcacattgtcattcaatctcatccttcaggagttgtggataacggtaaggacgaacagccaccgctgctgtgtcagaaatcaaaggaatacgatgatcatgacttctttctggtggtagtccacttggctcattaaaaagatcatcaaattcttgcagcaactcaggcaataagtcacgtccagtcaaagcatgagcctgcggcggaaaagaatcaccaccatgaccatgccaagctacttgatgatcgtccctccaaaaagacatggtgagcttatcaaaatcccacaagatgggtcccaatgtacggagccactgaacacccaataccacattatagcctactagtggaataacataacaatcggtgatgaaatcctccgagtcaatttttataggaatacctgagcagatgcttgagctagtgacttgatcaccatttgctaccataacgttcagtccagattttgtggtaggcgagaggccaagacggtgtgctgcctcagtagccacaaaagtgtgggtagatccggaatcgaccaaagcagacatggttacacctccaataataacagccaagcgcatggtcttgctagtacggatgccggtcaatgcatgaagagagatggtaacggtgtcatcattgatactatcatcgtcctccccctcgtccatctccaagaggtagatacctttcatagagcactgacggtgatgatctttagagaatttctcgggacaattgaagcaaagccccttttcacgacgctcagccatctcagctgctaacaagcgacgaaacctgtgcctgtagtacctggccttgtaggtgatttggaagcaacaatcgcagcagaagaagacgtgctactacccacacgggaaggtgctggagcagaacgaaaagaaagtgcagaacgctgtttattctccacgatacgtggagcagcgactgcatcatcttccaaccgctgctcataagagcgtgccaagctcatggcggcctgaagattagctgtattttgaagctcaacatcaatacttaaaggcttgccaaggccggcagtgaaaagattgacttgatgcatcggattgagagatggggtaacacgacaaagaagagccaaaaattgtttttggtattctgccacagtcccggttcgtcgaagtgcggacaattcaccaagaatattgttacggatgggaggaccaaagcgcatattaacaaagtgctcaaaaactgaccagttcacgagtccattatctttggaaaattgaatataccattgttgcgcctcacccgtcatgtgataggaagcaagccagaccttctcatcctcaggcgtccgttggccttgaaagaattgctcacaccgattaagccaggtcaagtgatcttcttctccatcaaatattggaaaggttagcttgtgataacggggaacaccacgtttgtcatcatccagattagcaccactgctccctttttcccatgaatcttgccgagcctcaaggttatcaagtttcttcatcaagagaacaagtgtcttggccaaatcagccatggttgtgctgtcttccgacatggtggagagctaggtataggtggtggctggggttggttgacggtggaacacaacagatgtagcggcggaagtgacgcaagcagcgcgaatgtgaggcgtgctgcgtcgagcggaacccagcgacaaagcaagcgctggatgagggctctgataccaaatattatggctggaaatagaggattgatagggaagatcgccctcaagtcgccggcttctccggaagaccgagtctctgatctgattgacttagtgggcagggcccttaatatctttattgcttagtccttaatacaataccaggccccctttatatactaggtgccaatctaatatttaggaaatctaagacaaactaggaataggaaacagaatcctaaaccaactagaattagatatatctactgattattcctattcctattcctatggtatttgattccataacgccagtctataacagatacagtatgcaatcagattttgtatttgcatgaacacctggagtcaaagaatccacaggttagatggagagaattttgtaatttgaattgagtaaatttcatcattagcacaaagatgagtcagtttcaaacagtaaaaccataaaattttaagggtgctaataaaaaccacaggaaacacgataaaaatgtttccgaaaattaacaatcgactatttttaatcatcaattgatatattatagtactatatatagttagcagatccaacaaatgacagctgtgtttagtttcacactaaaattgaaagtttgaaaaaattaaaacgatgtgatagaaaagttgaaattttatgtgttgaggaaagttccgatgtgacgaaaaagttaaaagttcgaagaaaaaaaaattttaaaaaaattgtcctgctcttctcctctccccctcccttgtttggagaaatttaatatggcaacgccgccgtcgcccgtccacgcgcagtgtcgacttcctctcggccgcgctagggacccacgccgccgccgccgccacgtccgccttttccccgctccgctgctcgcctccccagcctccgtccgtgctcccctaaaagcaggaggcggccgccgagaaggagaaggcgccgcgaagagtgagagcggggggctagacctagtgcaatcgagccttcatcggcgccaccgcgggccatcgcgtggttagccgccggagtcgggggtgggggggatgccgcgggagccggccgccatgcgcgtctacacggtctgcgacgagtccaagtgcgtgtcgcatcacaaaccctacctctcctctcctcttccaatgcattgaatccctcttgatgattcaggtacctcatcgtgcggaacgtcccgtctctcggctgcggcgatgacctcgccaatctcttcgccacctacggcccagtagacgagtctgtctcttcctcctcccacctataccataccaccacctgcctgtgtgaatgatttgcttgcttattcaggtgcacgcccatggatgccgaggactgtgacccctacaccgacgttttcttcatcaagttctcgcaggtcagcaatgccaggtgagtaaccaaaatagtaccttttctttcagtcctttttcctgttcaggaagaaccgacgttcacagaatgagtgaaaaatgttactagccaccattaattccaacaattaaatttgtgtttggtagtcttttctaagacaaatttgtctccttctcatccctgttttgagctctgtgcttaggattacagctttagtttagtttgttagcaattgggaacaaatctggacctactatttgccaaatcgcaagtttattttctcaatgaaagcaagaaacggcattaattgcaggtttgcaaagaggaaattggatgagtctgtatttcttggcaaccggctgcaggtgtcatacgcccctcagtttgagagtcttctggacactaaggagaaactggaagtcaggagaaaggaagttcttggccgaatgaaatgtgtgcttccatgttcttcttttccccctaactctatgctgtttagccttcgttgtttcaatatgtaaccgttttctttctacgactacacattgctagtttatcttgcttggatagttatatataaatgtttgctttcatttctccagcatcttctggaagacctgaagggttatctcatcattctccaggtcagggatcatctgctgcaaactcacaccgtcagatgagctctaataaaaggttaacatattgcgtactactatcagtttttttttgtgtgtgtgtgtgtgcaaacattgctaaggagaacattggtcatcagttactcattgatcggcccagtcttcaactaaattctatccctgttaaccatgccatttggaattggaagttaccctcatatccacatctttattgatatatgacatctggtctgaatatttgaagatggatacccagtctttatgaatagcttagcagctaagctacagtgggtttaccgaacaaaactgagatctttggcacagtaaagttgaaagaaaaaccagcaatccttattccttaatcaaaagactgagacacttcttctagctttgtgtttggtttgctctttagattttatgcatcagtttgtatatttcatactcagcactaccatgtaggagtatcaaccaggatttggtttgttcattttaaggaatgaacttcaattatgatacaattacatacactcgccttttatggaatattttcaaactttataagtaatattgaatgatgtggaactaagatggtaacccaaaagcccatctggatcttctctgattagaagtgtaaacactgtatatgacttatctagtgaagttccattttgccatcttcagggaatacacaaaaacacttcatgcttctcaatttgaagatcctcgtttcactcatgtatcctctaataaggtatgcagtacaacagtatgtatcctctaataaggtatgcggtactgcaaagtaatataatgtttggaatttggactctaggtgagaaaccaagaggttattcattgagaaaaaatatggcattaaattagcagggcatataatggtgtaagccaactttcttttcagaaaaagaaaaacagaaacaggggaattaatgcattgagtcatacatagtacctggaaaggcaaattctgcaataatttggaattttgtatatcctgccatattattgaacttagtattcttaccaatttgtggagaaaatacttctctgtaggattattttccatctgagtcgatgaatgcaacagtaaacctagtcagggagaagcttgataaggtaagagtatctttgttaagtgtattatcatattcactgcaatatgtgcatttgtggataagttaaaggttccattttcaaaatttcagatacaatccagcagcgacaattccagtgctatagttgcacccaagaaaccaaggaccgataaccgtagacgaatttgatatcatgggatggagtagaacatgcatttttttttcttcatctactttcttgtagtttgttttataattggcagaaaatagtgtactataatgctaaatgctgtctatattctccctcagttgtaaaagtatccccttttaggttttctgcggaagtaacgttagtatcatgttttgacgtggattaatgtcatgtttgatgagcacatttctcttcgtgaaaagtccacctttcttttgaacaatttatatttgaaacatcatgttctgttggtatactgatttatctctacagttatgttctatttggatctcaaatggttcctatgaggttgtgacatctgtgttatggcatgaagaatttcatgatgtctgatataggagaaaaagatgacctctgctgatcagatgtactccctccgtaccacaaaaaaaccgaatctaggactggatgtggcacatcttagtatgtatgtccagattcattgtacaaagatatgtcacatccagtactaggttttttatgggacggagggagtaatagatagcttacatatactctattcggtcataaattgttgacgtctcggacaaaatttagccggagttttgaaattccctaaccacccgtatccttttcttttcctaacttcaagttcgagtcggatcccgatgcctatgtactatgctaagagcaagtacgatagggatgactcaatactccctccatcttataaaagaaaaatctaggactgaatgtgacacatagtataacgaatctagatagatctgtccagattcgttgtactagcattaagaacaaaagatagtgcagtcggctgtagaattataaccaggctatagcacgtaaaaagagaagatacaataacttgtccgcttctattagctatggagcatagatagtgatgggcctaataaatttgtatcaaataactattgtgcatgctagctactaaaaaaactaacttagactatagttagctgttggctttaccattggacctgctctatgtgtggaccttgaacatcaaacaat

SEQ ID NO: 55696 - DNA, 3185 bp, Oryza sativa
taacaatttctaactatatagatagaagttactatagtttataacatagagagtatgtaagcgtcgtttctcaaggtctaaaaacaactgggaagatcaaaatgggaaaatgagggagaaatatatagagatggaagagacgaaatggaaaggggaaatgaataatgcataataaaggaaaaaaaatgacaactgaattttttttagtcggacgacctcattgcccaacttcttgtaaaaagaaattaattaaatccggaaagcacaaagtaatagaaaaccatctctctcgcgatgtacaaagttgctgacaaccataaacgtggcaactttctggtctggaattcttgcgtgggaaagccgttaccacaatattaacaggaatagaagaaaggtggttactattaagtcttcgtgatagacgtaccatgacaatatttatattaggtgaattttcaaatagtggaatataaaatgccagcataaatatatctttacctctactattataaaaattaaagatgtttttgccggtgctttggtaagtcatccgtatatgagttggtttttaagttcgttttattttgaaaatacatatccgtatttgagtcagtttttaggtccattcgctttcgaaaatatagaatgagttgtataagaaatctcttaaaaaaactcgcatactaacttgaggcgatcggaatcctaaattcataattgaagctcatgattttctaaaaaagggcttgtttggtacagctccaactcctaaatataactccaggagttgagtctggagtggagttgtggagctgccaaaacccagctcctcaactctagtacattttgtgagagagctccacccaactccactcccaattttggtggaactgaaactgattggctgagctccagctccaggaggggtgaagctggagctagagctgtgccaaacagacccaaagtatatatccaaacaaatttctacagtgaattttatcttaactaaactgtataacaataataagattaaagtaactttcacccgtttgcaacgcacgggcatttttagtggaaataaaagagaaactcaaggagtaaaagaaaaagaaagcgaggaaaagagaaaacagggggagggagaggagagagagacatcaagcaagctaggaacaagggaagggaggggaaaaaactgtaggatctcccccgacaacaaaagaagaagaagagaaaaggatggcgatggcgatgcgacgtcgggtgtcgtcgtgagcgcagccctccctcgcgatccacctaccccgccgccggtaagcctccacctccgccattcctccccccacccaaaccctagatccacaccctcctctccgcccccgagatctcctcgatcccgtccgcgattccacgccgacatggctgaccccttcgtcgccgacgaccagaccgacgccgacttcttcgacaagctcgtcgacgacgacgacgacctctcccccgcccctgcccctgcccctgttcccgcccaacagtcggcggaggcggccttgcttccagctctttccgacctcagcctcgccgacgatgacacagacccttccccggctcctcctcccgtcgaggccccgccggagggtgcctcaccggagtcggggaagggcgccgtccacacaacggtcaagcaggtccagtgggcctcatttggaggcgccgccgacgatggggctgatccgttcagtgatctgtctggaggcgccgctgatgacggatttctcgggaccatggccgggaaccagagcttccagacctccgtcattgggagcgtgggggcatcagctcacgggatctttggcgggagccagagcttgactgccgaggtgacagatcaggattttttcggtggtacctccgatcagaacaccgatacccagcagcagcagctggagcagagcggaagcagtgctttcgactccacagatcccaagtatttggagagcatttatcctgggtggaaatacgacgaggcgacacagcagtggtaccaagttgacaattctgatacgcacggtaacgccactcaggtggacaccagcactgagaatatccagcagcagcagcttgccgcttcttacatgcataatccgacacagtcatcgctagagacaattgcggaggagggtacgacgacagggagtgtatcgacatggggacagggtggcacctcggagtacccaccaaacatggtattttacgccgagtacccaggctggtactttgataccaacacacagcagtggcaatcgcttgagtcgtaccagcaggcagtgacagctagtgctgttcaggatggagcaaacaatggtgtcgttgcctcttctgctgagacaaattatagcgtcaaaaaaccgaagatcttcctgcccacaatcaggtggcccaacataactctttctctaataactatagttatcagagccagtggcagacaaattcatttagtaactctatgcaacctgaaagtgcaacagctagtctgccagatagtttccagaccttggtcagcatgctatttctgaatctttcaattcctctacaaatagtcaagttagttttaacaccgctgaaaccgctacaagccattatggcaacgtgaacttagattcgtcaagtactcagggtggctacaccgcaagtggtggtcaacaaactggttacaagggcttcgaacctttcacaggtcatcaggctggttacaaggggtttgaaccttctacaggccaccagacaagtcataagttatttgatccatcagcaggtaaccaaaacagttacaagccatttgaaccttccactggtcaccaccagcacaaggggtttgagccttccacaaatcaccagggtgattacaaggcatttgagccatccacacataaccagggtggttacaagggattcagtccttccacagttcagcagcctggttacaagggatttgaagcttctacaggccttcaaactaatttcaagggatttgaaccttactcaggtcaacaggctggttacacgggatccctaccttctacaggccaccagtctagttacatggggtttgagacttcttcaaaccagggttatggtgatgccaacaatgttgcaaatagtcaaggctttgttccgatgga

SEQ ID NO: 55697 - DNA, 1459 bp, Oryza sativa
agtgttgataactccaagaatttctctcagcaacaatttcttggtccaaatgcttcacacttgcaatttgggcagtccccacatgaagagaggtcatcagctggacgtccaccacatgctttggttgcttttgggtttggaggcaagcttatacttatgaaagaaaccaactcaatggccacaaactatgactctgggaatcaggtatgctaagagttcctgtgtgatatatttttagtcatcaaacaaaattatggcatatgttaaagtaactaaaatattctattttaattttgcaattcaaggggaattctagtggcacagtatcagttcttaatttatcagaggtggtcacggacaaagctgatgctttaagcgccagtaacggtagcgcacttagttatttccatgctttatgtcgtcaacctgttcccggccctcttgttgggggaagcgctgcatcaaaggatgtgaacaaatggcttgatgacatgattgcactgtatgaatcatcgactagtgaattccagaggggtgatcctcgcaagttgcttatttctttgctgaagatactatgccaccactatgggaaactgcgttcaccttttgcttctgacccatcacatgaggtactttctgcctttcatgctcttttttgttgcatctatagtgtattttaccaaaacagaggctgatataatgaatgctccagttaatcaactcttagtgttgtaataacggcgcagagggcaagcttttaatactttttaatgtgatgaacatgtctgaattagcagtttaccttttagctcatcgtgtgtgataatttgggtacttgtttcattgtttgtcctttcacctttgtatctctgactcatttgaattctcaataataggacacagacggtccagaaatggcagtaactaagctcttttcatcttgtaagagaagtagctttcaaatgggcgatttcggatcccatgtccgttgcatgaagaatattccctctgaaaatcagatgcaggtgattgccatttatattatatggatgtgaaatttagctaaatcctaaatgtccccagttgaggcagctactttgcttgtaggctgttgcacaagaggtccaaaatcttctagtttctgggagaagaaaagaggcccttcagtgtgcccaagaaggtcaactgtgggggcctgcaattatacttgctttgcaacttggtgataaggtttgttcgacttaatagccttctcttgtttgcatttgaatagtttgcttgattttcaatgaggttttcttttccttaattttttttatttatcttttctttccccaccggtggtgcagttttacgtcgatactgtgaagaaaatggcccactgccattttctatctgggtcacctttgcgaacattgtgccttctcattgctggacaacctgcagatgtttttaatgc

SEQ ID NO: 55698 - DNA, 2054 bp, Oryza sativa
acacttctacagttctactcgatcacttctgtaggttaaaaatatacttgttctgttttgttagattaattttttgacagttactctgttacaaaagtagtacaatacttttgaatatgagtataataaatttaatcattttataaaagttatatcctaatagagcaattttgttagtcaaagagacaattagactgacatgctcccttgttagtgattacagtactacttgcttgattcatttcgttccttccagcggcccgatcgatctagctagaacaatcgatcgggcaatcaatctcgttcgtcagctagctaagctagccatgttgccatcagggtgtacggcgtcttcgtcgtccttgttccagtacgatcgaccagcgcaaaaatgaaaaagaaatcataaagggaatgttgattgatcgagtaattgggcgatttaagtccggactacatacgcaaccaaatcacacgctaatgaaaacgtacgattccttcttaattttgttcgcccattggaacgattttgctgcctggtaggactttactatcatattatcatacaaaatatatagggtccactcccgataccctcttattttaggtaggccccctttaatttaaagaaaaatctagaaattttagaggttttttttcctatatagccatttgaatcaaataaatgaacactatatgatcatagaaaataactcatttcatataagttttggaggaaatttaacatgaggtacaaacccatagaaatattcttttgagtctattatctctcctcaaattatcttgtttttttatggtccaataaaaatattattactatgttttttctttattttacaattctctattttatatttacatttttgtaaaattcccgtgttttccttaccccccctccattttcccaattgaaagggtcccttattctctcttaatttcttgtcctgttcttttatctctctatctttctttttcccaaatgctgtatagtctccttgtttcattacaagtaataaatatcttatacttcattaaccttacatgtaactcagacaagacaagtagctctagttgatcatgtatatgaattatattccgtataaaatcctccatcatcaggtaccataacgtcgacgcatcatttttctcaaaaagaaatgtgaaatgcaggacatcaaaaagcagtaggccccaatgtttctctgtagcagtcagtctagtgtcccccatctgaaaggaactgatctaataaaaaaggtgcatatatatacatgtgtgtgtttgtgggttaggcagctttacccatttggaacctttctttctatcccaagaacaattaatctagcatttatatttttcgttccatttttctctatttttcatcatcagggtatctcatattctgatattcaggtatacgtgggtgtactgtagctgtagccgacaacagaatagaagagagcacaaaggatacttacaagcggcctgatagctacagcgttgcattgcgccatatcggccgtgaacttagctgataatgatatagatctcagatgatactctttcagaaaaaaagcaaacattcagctgtccatccttgggttcagagttcagaccagcagggctgcatgcatgcattttgccacttgctgaatgcgtgagaatatcatctagctacaccaaatgtactactcctagctccttaatgcatccttaattaactgtatactccaaatgaatgtcttatcatctatctgattgagaaatcagaatttcagatcaccaagagcttaattactgtatgtccttcctgaccttatctgagcgatcgagctgactgacgaccaaccggcagcttatacagaaacagtgagagcctgaaaactgtagtaatacagttctagtagctaaaaggacttgacttttcttaattaaccagtatatgtatatgttttcggatgtatacaaattcttctcatgcctgccagatcgatcgatgcacagtttgaagatagataggggatgtataggac

SEQ ID NO: 55699 - DNA, 6239 bp, Oryza sativa
tttcgggcgagatgtgagcatttcggtgggggcgaaatttcgaaccgaaatttcaaaccctgtttgtgcttcacgttctttacaatcaagttaataatattgtaataagtaacagctaaagtagaggatgggattttcattgcattatcaaaaaaatgtatatatatattcgacgaatatttccaccggtttcacctcacaacataagctatagctatctatcttcatcagcagcagaggcagaggtgagctgagcacaacacatctccccttgagtagttgagtactgcacttgagtgatataaagcttagctagtatactgactgcactaagcttaaacctcactcgactactaccacaaaagtgaaatattcttggctagtctagtctactcgagaacgccaccatcaccatggcgatgtcgccgcacgaccagcacgagcacgagccggaccacgcccaccgctcgccgtccaacggcacggcagcgaccagcaccatcgccaccaacagatggggtccctactccggcgccggcgacttcgccagcaacatggccgtcatcctcgccgccctgctcgccgcgctcgccctcgccctcgcgctcaacgccgccgtcaggtacctgctccgccgccaccgccgggccaggcaacaaccagccgccgccgccgccgccgccgaggacccggagaagccgcctgtgcaggaggccgacccgccgccgccgcccccggctctggtgtactccgcggcgggcaccaagctggccggcgccgcggagtgcgccatctgcctcgccgagttcgtcgacggggacaccgtgcgcgtcatgccggtgtgcggccacggcttccacgcgcgctgcatcgagcgatggctcgccggaggccggcgctcgtcgtgcccgacctgccgcgcgccggccgcgacgccgcccggcgccaccgctaccgagcccgcggcggtggcgccttgatgcatgcatgcggccaactgatttggcccttgttcttggcaagctctcctctctcgctctctctctctctctctctctctctctctttcttcgcttctttctttcttgcttgctttcatgtgtaaatattcgtcaagatcgagatgatggatttgatccaactggatggatcatttggtgtctctctctgttttgtttggctgttcaaggagatgtatgaactgagagttttagattaggctgaaaaagtgaaaatgattcattactctcctgttcgattatcacaacatctgttcagttattggcttcttttttcccatgtgaactagtgttggtgccaagaaattcctctggaatctgggctcagatttgcacagataaaggtttatcagacagggcctttcaatgtagaggctgcaaatttgcttccaactccgggaatttgcacaacctgcagatttgtttacaggggagtggtgaaacatcttcattttttatatggagactggagagacatcctagcttgttttgtgaagggaaagaaaaacacaaacagttaggtgatcattcaatctcgagtattcaatatggtgtttatatcgttggtttgtggtcactcaatgtgtggtgtgcctcttgaatgactgaaatcgggaattcagtatgcatgtctgcttgcttaattctgacggaaaggcaagtgccactagtactctagtactgcctccgtttcgaaaatgtttgacgctgttaactttttagcatatgtttgaccgttcgtcttattaaaaaaaattaagtaattattaattattttcctatcatttgattcattgttaaatatatttttatgtagacatataattttacatattttacaaaagtttttgaataagacgaacactcaaacatgtgctaaaaaatcaacggtgccaaacatttcgaaacgagtagtatataaagttgcatgattctggcaaactttggtaatatctagattggcaaatgcatgataatcagtgctactttactattactacgctggatatttatacagaagcttaggttgtgcttagcctacgcctaatttggcaaagtggataatgcacatcaatctatcctgttgttactatccgacagtgagttgtcctgtatttctactcacatcgattgattcagagtgtggctgcctttgatgccttcagtcattcagatagacgatagttactgactctgtgttcaacgtggttagttctccacccaaacgacaatgcttccggttccagaccatttcatcgcgtgaaaaggttagcactaattagtggtggtgttgtgcatgaagatgcctgaccaaaattatggatagtcaaacagtagtcaaattgatgcgtcctcccgggtgttggataggagtacattgctcttttttccttttttgtgtgtgtatgtgtgaatggaggagtataatcaagtgtttaccgcaaacccgctctggcctatacagaaaggcagcccgcaaaatatgggcttcccacgcggcctattgcttcttcccgcttcctccaataggcctacagtgggctgacgatcaatatgggcctaaatcttagggatcgtagctggcccggccttttgtctgatgggcctgaattaaatcaggcccagtagtaacacatccatagtacgaattttttttatttttaattttttttattaaaagttttaaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccggcctccgcgagggcgattttgtactgtgcggggggccgcctgcaaatgggcggcgagggggcatggaattttgcaggcggcccccttgccgccctgggggagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattatgcattagatgtgacaagacgatcacgcgtgggcgtgattcactttatgtaaacaggcagcgccgaaagttgatagtgataactcgagctgccgcttttcatgtgtgctgttgtggactatgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagatgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgttgtaggtcgcactgctctgaagctaggggcgctcgaaggcaaacgaggtcctgcgaggatggaacatcaagttaccgcggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgaacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaatgggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactgtcgacctatggcaaacctctcggctgcccaaagctgaagcaacatagggcagccagcgatgatcgctcccgcgtcagttgtcacaccccgaagttttcctccctagtcaaaattgtaatttataattgaccctaagaaaatgctggtgaaatcaggagaaaaccctaagaaagtaatgcaaataataatcggatttgacatgtggaatttttcttgaattctacatgtcgaaattcattaacaggatttttagtggaattttcagagctctagaaataattttaaccaattaaaaatcactaaagtgcaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccggccggctccctcctctcggggtcgc

SEQ ID NO: 55700 - DNA, 9697 bp, Oryza sativa
  unsure (1)..(9697): unsure at all n locations
ggtcgctttcgccacacaccagtttcagggtcntgcgtcagcttggtgggacaaccacatggccacccgcccaccgggtacggaagttacgtgggcagagttctgccgtagctttaggaaggcacaggtgccagacggggttgtagcgcaaaagaagagggaattccgggcgctccatcagggcaacaggacagtgacagagtacctccacgagttcaatcgcctcgcgcgatatgcaccagaggatgtccgcactgacgccgagaaacaggaaaagtttatggcaggcctggatgacgagctgaccaaccaactgatatccggggactacgctgactttgaaaggctggtcgacaaggcaatccgtcaggaggatcagcgcaacaaaatggacaggaaaagaaaggcggcgcagttccgatccaaccaaggtagtcagcaccgaccgcgcttcactcccggacagcagggtggacctaccaccatgatcgtccgacagcaccgcccgttccactctagcaacttccaccagggcgctagcggcagtcagaaccaccagggaggccagcccaaccgcggtgcagctccacgcccaccaatggcaccggcacagtcagcccagcccgcgcaagccaagaaggagacgggagcaaaaccagggtcttgcttcaactgtggcgagcttggccacttcgctgacaaatgcccgaagcccaggcgtgccgggctaaggtttatccaggctcgtgtcaaccacgcgtctgcggaggaggcacaagcagcaccagaggtcgtactgggtacgttccctgttaactcaatccctgcaacagtactttttgattctggtgcaacgcattctttcatttcaaagaaatttgtggggatgtatgggttaaggaaagaagagcttagcacaccaatgagggttcataccccgggaaatagttcaacctcagtcagttttagcccttcagtgctaatagaaatccaaagatcaccatttctagccaacctcattcttctcgaatccaaagacctagatgtcattcttgggatggattggctgaccaagtttaagggagtcatcgattgtgcgaatcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcggatcgacgatttgtttgatcaactgaaaggagctaaagtgttttctaagatagacctgcgatcaggttaccaccagttgagaatccgggaagaggatattccgaagacggccttcaccactcggtacgggctatacgagtgcacggttatgtctttcggacttactaacgcacccgcattcttcatgaatctgatgaacaaagtgttcatggaatttctggacaagtttgttgtggtattcatcgacgacattcttatctattcaaagtccgaagaggaacatgaacaacatctccgtctggtactcgagaagttgaaggagcaccagctatacgccaagttcagcaagtgtgacttctggttgacggaagtcaaatttctgggtcatgtcattacagctcagggtgtagcagttgatccatcgaacgtggagtcagttacaaaatggaccccaccaaagaccgtgtcgcagattcggagttttctaggactggcaggttattaccgccgattcatcgaaaacttctccagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgtgtcctaatgcaagagggcagagtggttgcatatgcctcgcggcagttgcgtccacacgaaggaaattatccaactcatgacttggaattggcagcagtggtccacgctttgaagatctggaggcactatctgatcggcaaccgctgcgaagtatatacggaccataaaagtctgaaatacatcttcacccaaccagatctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcggcaggagtttgaacatctcaacgttggaattgttgaacacgggttcgtagccgctctggaggcacggcctacgctcgtggatcaagttagagccgctcaagtaaatgatccggaaatagcagaactgaaaaagaacatgagagtcggaaaagctcgggatttccacgaggatgagcatggcacaatctggatgggagaaagattgtgtgtaccggacgacaaggaattgaaggatctgatactcaccgaagctcatcagacccagtactccattcacccaggcagcaccaaaatgtaccaagaccttaaagaaaaattttggtgggtcagcatgaggagagaaatagctgaattcgtcgcactctgcgatgtttgccaacgagtgaaagcagagcaccaaagaccagcaggtttactccaacctcttcaaatcccggaatggaaatgggaggagattggaatggactttataacaggactgccccggacatcatcgggacatgattcaatctgggtagtcgtggatcgacttaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaaatggggacccgtttaaatttcagcacggcctatcacccgcaaactgatggtcagacagagtgagtcaatcaaatcttggaagatatgttgagagcttgcgctcttgattttggtggagcttgggacaaaagcttaccatatgcggaattctcgtataacaacagctaccaggccagtctacagatggcaccgtttgaagctctatacggccggaagtgccgcacacctctcttctgggatcagacaggcgaacgtcagctgttcggaacagaagtattagcggaagcagaagagaaagtcagaatcatcagggagagattgaggattgctcagtctcgacagaagagctacgcggataaccgtcgaagggagctaacttttgaggccggagattacgtgtaccttcgtgtcaccccgctccggggagtacaccgctttcagacaaaaggcaagttggcaccacgcttcgtgggaccgtacaaaattttggaacgaaggggagaagttgcctatcagctagaacttccatccactatgatcggcatccatgacgtgttccatgtgtcccaattaaagaagtgtttaagggtacctgaagaacaggctaattcggaacacattgatatccaagaggacctaacatatgtggagaagccggttcgcatacttgacactagcgaaaggagaaccagaaacaaggtcaccaggttttgccgtgttcagtggagtcatcattcagaagaggaagcaacctgggaaagggaagatgagttgaaggccgcccatccgtacctcttcaccagctccaccgaatctcggggccgagattccgtttaaggggggtaggtttgtcacaccccgaagttttcctccctagtcaaaattgtaatttataattgaccctaagaaaatgctggtgaaatcaggagaaaaccctaagaaagtaatgcaaataataatcggatttgacatgtggaatttttcttgaattctacatgtcgaaattcattaacaggatttttagtggaattttcagagctctagaaataattttaaccaattaaaaatcactaaagtacaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgccttctccgcgcccgttcccctccctctcccgctcgcgccgcgcccgagatggccgggattcgaaaaccgaatcccgcctctctctcctccccactcccccacgtcggccgtcgaatcccgccgctcccggccacgtccggtttccccatcccctatttaagcatcaccggcaccccctctcgctttttccccattgcgccgacctctcccgagctccccaacgcctccgcgccgtgcaaccacccgccgccgccgcttttgctactccggccgccgctagccgccgctaggctcgccgccgtctcacgccgtcgccgccgttagcttcgcgtggccgaggtccacctcgtccgcccctcctccgtcgaggttcgtcgccggagccctcatctccacgcgcacgggtgagcgccacctctaccgccgccttcggccatggatcccgatcgccatggtccatctctctctctctaattcctctcttctccttccttagggcacgccggagctcgtccgctagccgacgccgtcctcccgtggcttgccgtcgccgtccgccatcgccttcctccgcgccggccaccctcggtgaggcatcccctccctccttttccccttcctctcctcctagagccgctagccgccgctctccgccgccggacgatcgccgtcggtcgtcgctttgcgccgctgccgcatgcgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgtcggttcggccgccacgtggcgccgccgcccctccttttccccgggtcgctgaccggtgggcccgcgcgccgccaccccccttcctctctctcccatgccgctgaccggtgggtcccgcatgtcggcgccgcaccccccccctcgctgacgtcagccctggttaatattgcgcaataaattatttaaggatttcttttatagtattaaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgattgctttgtatgtcgctagattccggttccttcgacgctccggtgtacttcaagatagtcgccgaggttcccccagcagcagagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttgctggtgttggttaaataaagtgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgtttaattttttttacaactgtttttgcattaaattcctgtttataaatgccagtatttatgcaaatgaacctgcttagctatcccttgttaaatccatgcatcatacccctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgttttccgctgcatctctgtaagacttttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttctttgcaattggattttgttccgggaaaacggggatctgttcttgtggttcaagggaaaaatcttggtcgctcgtttaaagtgagttttccaaaacgagtcagtctagggttttagtaaaattattgggatttactcgtcagtcagttgggatttgatgggtgaaatgcattcggtcctagctcggtatcatgggttgcaaggtgtttatgcttcgtttgttactactattatgtatctaatttcccattattttatcgttatgtgagtctgtcttatttattcgcgctcatgtaaaatgatctatgcataaaattttgctcttatttgattcctttatttgagtctttattgctttatttaaatttggatttgagcatacattgatcctactcctttgtcttctctagatggccggtcacccacccaaccaccgcggagaaggcatgatcgacttcgtggcagagctggcacgcatgacactggtagtgggctaccccgacgcgccggagtacacgaccattccgccgctcagtggcgagcttcctcaccgtgtccgcttggaggtccatggctacgtggggacttgcctcgctaacatggcggtcgaggcatctggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgaggtagcgcgcctgaagaaggagaatgctcagttgaagggtcttccagcgccaggaggagtccggatccgcactacgccccgtaagaggacgactacacctgtgcgcatccagctggcgcccaggaacccacctccaccagcggcccccgcagcagctccagctccgcccgcagttcctgcagctccagctccagctcccgcgttcactctctccttcgctccagcatcagccgccggaggttcagccagtggtaccggaggatggctgtctgctactcccagtggcagcggcgagactgatccgtcaggctccaggagtcgctcagagggaccgggtgacgagcaggaggacgctttcgactccaccgaccgcaggagccgttccgagcattaggctcgtttttccactagttcatcgactgtctagtttttgtttgttagtttgtgtgtttaggttgcttgtttggggtcagttgacggtcgatatcatgtgtctatgatatggctgtcttaataaggatttttgcttgcctttttaagtgttttaattcagatcagaacaattgcagttttaattcctatataataaagcttagttcttgagcatctgtttttcttcttttccccgtctgttcttccctccagatggtctacaccaggactggtagccgcgcaacaggcgagggcagcaacggtgaagaacgcgctgatggtgtgcaccccaacggtgattctggcaatggtccgccaccacttcccgagaatccgacgcttgcccaagttatggcacatcagactcagatgatggccgcgatgatgcagcagatgcagcagcagcaccagcagatgcatcagaggatgatgcagcacgccgaacagcagcaccagcagtttggtccccctccccctcagtccaagttgcctgagtttctacgtgtcaggccacccaccttctccagcaccaccaaccctatggaggcaaatgactggctccatgcgatagagaagaagctgaatctcctgcagtgcaatgatcaggagaaggtcgctttcgccacacaccagcttcagggtcctgcgtcagcttggtgggacaaccacatggccacccgcccaccgggtacggaagttacgtgggcagagttctgccgtagctttaggaaggcacaggtgccagacggggttgtagcgcaaaagaagagggaattccgggcgctccatcagggcaacaggacagtgacagagtacctccacgagttcaatcgcctcgcgcgatatgcaccagaggatgtccgcactgacgccgagaaacaggaaaagtttatggcaggcctggatgacgagctgaccaaccaactgatatccggggactacgctgactt

SEQ ID NO: 55701 - DNA, 3476 bp, Oryza sativa
gggcctgtcgcaacgtgggttagcgttggacagcggatgtttaatactgtttaattttttttacaactgtttttgcattaaattcctgtttataaatgccagtatttatgcaaatgaacctgcttagctatcccttgttaaatccatgcatcatacccctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgttttccgctgcatctctgtaagacttttataatgtttgtaagacgtggatctgtatgtcaacattgtcgtttgtgtaccccggctggtcctggacgggggttttaatacacattctgcttggaattctattcgggaatttctgggcgtgacatcagtcttcgtgcacgcctcacagagggcacggtacgtggctgctagcacggcagaaccccagctccactgcggcacgtcctgtggctgagcatccgtgatggaccgtgcgtagtggaccagccggaagtccacagcgtgcccgtgggtgttagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaatggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtctgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacattgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatctaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgagcctcatacgcaccactgcaatgtgcactctctctaggaaccagtaccagctttcagtgttctcactctctacaaatgcaaaagccataggtagaacctggttgttcccatcacacccaattgctgtcaatatctgatctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggt

SEQ ID NO: 55702 - DNA, 3648 bp, Oryza sativa
ctctacatcttcggtttgcattgaaacatttatatctttctcttgtaccgacacaaatataacgaggggccatgaccgttcaaaagccatttccacataccgtctccaagcatcagtgctgtccatcggcattagttcccaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgatacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacttatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttatagggggagaggcaaaaatcgccctcccccagggcggcaagggggccgcctgcaaaattccatgccccctcgccgcccatttgcaggcggccccccccacagtacaaaatcgccctagcggagggcggcaagggggccgcctgcaaatttcgttgacggccgtcgcccgagagcgaacggccgtctgccacgtcattttcgccgccctctgagagggcgatttttcccagagggcggtaggcgactacttccgtcaattttcaaaatggaaaattatttttgtaaaacttttaataaaaaaattataaataaaaaaaattctccatagtacttgcaggggaagctcgcgaatcataaaattccccaagatcggtacggttcctttttccctgtttttttgaaatttttccctcctcttgatttagtgtcgtgtcaatttgctagtggccaggttgtttattttatgtttgtgtgtcacaaagatgtttgcccaatttgatgcttgtttgcatatgcattcttgtgctttcccgaattgttaactactgtcaagtacaatcccaacttttatttattgatgtgaaggcctttaatagtactccctccatcctaaaacgttcgatgctattgactttttttttaaaaaaaatatttgaccgttcgtcttattaaaataatttaagtaattattaattattttcatatcatttaatttattgttaaatatatttttatgtatacatgtagttttacctattttataaaagtttttaataaaacgaacgatcgaaaactatctgctaaccgcgcgggcacttctagtctagtaagcgaaagcccacgcgcgatgacccacgccgcccacgcgctatgcaaccgctacgccgccatcctctcctccgccgccggcgacggcggccggaccggggttcgcgtggccggcgctgtgcactgcctcattctcaagacgtttctccaggctcccccaaccttcctcctcaaccacctcctcaccgcctacgccaagtccgggcgcctcgcccgagcccgccgcgtgttcgacgaaatgcccgaccccaacctcttcacccgcaacgccctcctctcggcgctcgcccactcaaggctcgtcccggacatggagcgcctcttcgcctcgatgcccgagcgggacgccgtctcctacaacgcgctcatcaccggcttctccagcaccggctctcctgcccggtcggtccagctgtaccgcgcgctgctccgggaggagagcgtcaggccaacccggattactctgtcggcgatgatcatggtcgcttcggctctctccgaccgcgcgcttggccactcggtgcattgccaggtactgcggcttgggttcggggcatatgctttcgttgggagcccgttggtcgatatgtatgccaagatgggcctcattagggatgccaggcgggtgtttcaagaaatggaggccaagactgtggtcatgtacaataccttgatcacagggctgctccgctgcaagatgatcgaggatgcaaagggtttgtttcagctgatggtggacagggattccattacttggactacgatggttacaggactgactcagaacggttgcagttggaggctcttgatgttttcaggagaatgagggcagagggtgttggcattgatcagtacactttcggaagcattcttacagcctgcggtgcccttgctgccttggaagaagggaagcagatacatgcctacataactcggacttggtatgaagataatgtctttgtcgggagtgcgcttgttgacatgtactccaagtgcaggagcatcagattggcagaggctgttttcaggaggatgacatgcagaaacatcatatcgtggactgcgatgattgttggatatggacagaatgcttgcagtgaggaggctgtccgggcattctcagagatgcaaatggatggcattaagcctgatgatttcactctaggcagtgttataagttcttgtgctaatttagcaagtctggaacagggtgcacagttccactgcctagcacttgtctcagggttgatgcggtacattacagtgtccaatgcactagttaccttgtatgggaagtgtggcagcattgaggatgcacaccgcttatttgatgagatgtccttccacgatcaagtctcctggactgctcttgtgacagggtatgctcaatttgggaaggcaaaagaaactatagatttgtttgagaagatgttggcaaatggcttgaagcctgatggggtaacatttatcggtgtcctttctgcttgtagccgtgcaggacttgtagagaaagggtgcgactactttgattccatgcagaaggaccacggtattgttcctatagatgatcactacacttgtatgattgacttgtacagtagatcagggaggttcaaagaggctgaggaattcataaagcagatgccacacagtcctgatgcctttggatgggcaacattgctgagctcgtgtaggctgcgtgggaacatggagattggcaagtgggcagctgagaatctcttggaaactgacccacaaaaccctgccagctatgtgttgttgtgtagcatgcatgctgctaaaggtcaatggactgaagtcgctcatcttagacgtggaatgagggacaggcaggtgaagaaggaaccaggctgcagttggatcaagtacaagaacaaagttcacatattttcagccgatgaccaatcccaccccttctccagtagaatatacgaaaagctagagtggctcaactcaaagatggctgaagaaggatacaagcctgatgtc

SEQ ID NO: 55703 - DNA, 1264 bp, Oryza sativa
gacggcgagcacctcgtcggcagcgccgccgagcacgtcgagcggctgtccgccgaactgctgctggatgacgctgagcagggcctcgtaggcggcgcgcgtctccttggtctggggcttgtagacgacgtcgtcggtgagcgagaggacgctgacctcacgctgggcggctgcggcgcggcgcctgcgcttggcgtcgcggcggtggaggtcgtcggggtcagcggcggcggccttcttcttgcgggacttggtgagcttctcctcgagctcggggggcttggcctggacggcgcggtcgccgaagctcctggggtcgatcctgccccagagcgtctcgggctcgccggtgggctcgtgggtgtcgcgggggcgcgagtcggtggtgaggacgaggctggagttggcgcggtactcgtactgcttgaagcgcgcgtgcgcctcggcgccgccgcccaggttcgccatggctgcagatcgatagggtttttcagttggttttttcgtgcggaagcgggaggagaagcgggaggaggaggagagggatagctgggggttaccttttggcgagccgagggagggtcggcgcctccggtgataccgccgccgccgcgccggagaagggggagaagaggaggttggatttggaggaaaaggaaaaggcggcgatgggatgggagggactggattttctcgcggaacgaatcgaggcgagccctaactctaaaagatgacgacataagctaagctcaggtcggttcgttcgagagacgacggtttgggcccataagcccatccacaaaatagtactgggctgctggattaatgtcggtttcggcccatcaagttgtagccctcaggctctctcgaaaggaaaacaatttgggccaggtgggctcaactaccgctcaaacaattaggcccagatttcacccgtttctctgggccatatatactctgcacaagcaccctactgctctcctcattcggtcattagagtcatggaaatgtaaaatggcatatatcaacgagaaaaaagttttggagtaagtattttagtaaggtttttgttttagggtgctactttttgaagaggcaagttttgccctaaaaaggaactggagatactctactgaaagaaaaaaaaatactactcactccgtattttaatgtatgacgccattgacttttcgaccaacgtttgactattcgttttattcaaattttttgtgtaaatatgaacatatttatgtcatgcttaaaa

SEQ ID NO: 55704 - DNA, 6354 bp, Oryza sativa
aatgcactcaaaatctgctggatttggatatgcaggatctttagggggggttttgtgtgcttccaatattttgagctagattaggttcttcatagcaatttattatttggttgcattgctctaaagcaggtaggtttggaagagtgtcactttaaattagccgtccctttttttccttattaatatcgcttaaatttgattgtgtgatgttagcatcaataaatcaaacaatatcatgaaagggaaggcgagtaattaagcggtagaaaacttgtgccaggttattgtcgtctttgagtaagctcctttttctcttatcctactatttcaatcgattaattagttcggttaggttttctctttgctttatcaaggacttgtctttctttttgtttatgcatgatgaagtatgacaatcgcaattctttctgttggcattattacttgggtcctagaattttagttgggcactgactttttctccccttttgaatatgtgaggtaatagctatgtactaactagaacaagaacctgatggtgtgtatattgatcttgatctttttggatagatacagtgcagctgctatgacagtgagagtagtaggaagtaggaacgaatcaatcaactggttcttaattaattacatttagcgttaattactccgttccaaacatgagtgacttatattcagaattcagtctattcaccctgcagcataataacaaatctactatcctttttttccccatctgtaagcagtttgagataccagaaggtccattgaatcagctagctggctagttgtacatgtgagcaaaatggatcatcaatttgtctgcagcctagctcgtattgcttatgaatgactttgtcagtatgaaaccaagaaagcgacgcttcaccaaaagtccataaagatcaagcatgcgatgcgtttttcccttgtccacacgcatgcagcaatataatgcagcttctgaacacaggggacagatttaatccacagaaaaaactgaagcagccagcctacagctgctgacaaatccacagataaatccaacctaacctctttgcttgcattgcataagtgcataactaacccaacaatatatatatggagtatacacatgatgcaaattaaaccttaaatgattggctccagctttagttacgacaagctaaaacagatcaaccttaatcaatcgttgggttttcttagctagctagatcgtaccactaggtgaagagcgacatgagttacttcgagctggatagatagagctcatcaatgataggatgtagtaattagtactactcctgcttaattagctagctaggcatatcacagttgcctcactcacacggctaaattaaaatcaaggcagtaccactctacactagctatacgccgctaataagttggtttgtgattctcttgtgtttaattaggagtactaattaattgtaattatctggtagttcgttagatttgtttgttttctgtctcttgtcacgttctatgcctagtacacctctagcttgcgtgcaagatactccctttgttttcttacgtatcacataggagttaaaaaaaaggaaagagggagcatgtgtttaaatttcactgaaaaaaatcgtgtttaactagctagcttgaaaaaccatatcagtataagataagattgttagcactttcacgaaatgaacacactagtatgttgtactttatgaaaataaaatttaaattatggatgttacacgtgtgtatggaaatcaaaatgattcatgacactgtgttggctggcagaagaacagtagtcgcaggtgaagaagtaattaacacaagtattgcacagtagattaactgcagggcatgggagaacccaccactcattaactcattggtcgtaagctgtcgtcctcgtggagtccgttaaactgatcgatcgtcgctaaaatactccaaaaacaactcaaaatttaaattcgagattacttgcgctgtccaaattaacaacactgagtatttggaggagtgtttatatattataatgcgccgtccacgcaaactgagtacaaactgctggtactgacaggaacaacattaactggaagcactgttcattctcgatcggcaaattaatcccaaattgattagtagtcgctaactcgtggggatttgatccaaccaactgcgtatacgcgtacgccgtgcatacgtgtcggcgtgtatatatctttactcactcccaaaatttaaatttcatatatctgtatccgtacatcgtaaggacccagagattttcaaaatgttgttgtactgcaaaattatttaatgcatcctactatccctctctttaattttcatgtgatgctgttgactctatattcaccgtatgggaaggtactactcctactgtaataaataaataaattaaaagagacagtgtaattattcacattatgaattaaaaacaatttttaacagcaaccatgtatatacagagaccagatgagaccatggtgttaatataatcattcgttgaccagaattgaggggctagcttaatattaaattcccacagggggaatcaagattagggattaataaatcaaatcaaatcaaatcaaagctgtggttaagtagtaaaactaaactgccacctgtacattaatctggccatgcatacttattatgaacccattttctgctctgctcttgctttgctttgcatttctttcccaaactgaagaagctaagcttagcgcggcgccatggacgtggccatggcgctcgccgtcctcttcttctgcctcctcctcctctcctccgccgccatcaccttcctcctcctccgtcactgcctctccgggctccggcgccgccaccgtgctgccgccgccgccgacgtcgacgccgaggccgcagaaggcggggcgggagcacgacagctgatgccgccgtgttctcctcctcctcagcaagagctgccgttgttgcggccggcggcgaagttggtgcgtcgacgaaggaggagggggagccttggaagctgacgtggcgggaggtggaggcgctcaccggcggcttcgacgaggcggcggtggtggggcgaggtggctccagcacggtctacctggcaagcagctgcagggtcgccgtcgtctcgccgcccgtggcggtgaaggtgcaccggtggtgcggcggcgagcggtggctgcgcgcgttccggcaggagctcgacctgctccgccgcctccgccacccccacatcgtctccctcctcgcctactccgacgaccacggtacacgtcactctcctctctcctactactccaactgcttgaattatgtgtgttttttttccttgcacaaattattgaagctttgactctaagcttacgttacctcgtctcggtgtggttaaaagtcttaaaagggaacatcttttttctgttcttcacttgctttacactgcatctgcatgcaactctgatgctagctactccagcttgctgcttgctatgttcttcactttcttatttatttactttgcttaatttctttctcctcttaagatttgttattaagttagttcaatatgaatactactagtatgatgttacatttcacctcacaaattaaatttcaaatcgaccgaataaaacatgtgtagagaatggcatgcgtacgtcgtacggggggaaaacaataagaagaagaaatggagattacctcctacctaccgatcgattaagaacaaacgtcacttcactgttgcctatttatgtctagtacgttaacgagtaacgacctgtgttattttcgtcccatttcgtcgtccaaaacttaactcaacacgatcgctttcgatcgtatatatcattttaatcctaattctaattcaattttgatccccagatgaatgaaattgcaaatccccccaaaaaagaaaaagaaattgcaaatgattttatacttcatctaattaacctgctacccctccgttttatattataaatcattttgatttttctttgttaaacttatttaagtttatatacaaaacataaaacaaacttgttatcaaaatatatttaattttattttaataaaactattttggtattatatgtatgtcaaaatgatttataatattatacgtttgttactaagagagagattttttgttaattaaagagattaattaattaaaagaaattttattactgcgtgcagaggagggaggtgcactggtcctggagtacctctccggcggcaccctcgccgaccgcctccacggcggcgcatcgccgcctctgccatggcgccaccgcatgcgcgtcgtccacgacgtggccggcgcgctcgagcacctccacgacggcgcgcctccggtggtgcacggcgacgtgtcggcgtccaacgtgctcctcgacggccgtggcctgggcgcgcggctctgcgacctgggctccgcctgcgaggggttctccgccgccgtcgcgcccaccagggcggccgtcggctcgccgggctacgtcgaccccttcttcctccgcaccggcatcgtctccaagaagtccgacgtctacagcttcggcgtgcttctgctcgaggccatcaccggctcgccggccgccgggatacccggcccggatggcggcgccggcgggggcaacctcacggcgcggttgctgccgcgtgtcaggacggagggggtggacgggctcgccgaccgccggctgggcgacgactacgacgcggcggaggccggcgacgtggcgaggatcgccgtcgagtgcctggcggcgcagccgggcctccggccgacgatggcgcaggtgcgcgcggccatcgcggagaaggcggcgacgtccatctccattgctcatcacgacctgcacgatgcctccgattccacatgatggatatcggattgcagtttatttttattttgtagatgatttacttagttatttttgtgtctgtgtgttttattattggcaaggtaattaattaattgtaggaaacgatgaacactgcttaggaaagaactggaatcaattgattagagtgatgaaatactggaatgtaaatattgatttctaaattaagagtgcagcttgtgcatttggatgctatgatcttgggtttcaggtgtggaactgacaaacaaaaactaatcatacagagatgagatgggctcaatgattcaatcatgatggtgcatgtcattggatggattgcatatgattagacacagtagttgaaagaatttgaggtactagaacagaggctaccgcaatcagagtgatacacagtagcgagctccgttgccttttgctttgtctcaagcactgatgattggcaggtctgcaaacttgcaaaggtttcttgctggaccacagcatggaagatattgccaatatgcaagctcataaatgcagaatgtattcccaataggtacaacagtatgtccaaaacaaaattccattgtctaaaaaatggggaacaaaatggttatcacacactcctgacttttcaaccaacaggtaaagggtttacaagctgccaattcttctatgttagttctatggattaaagaccaccagaggttgtaagaacacagatcatactgatgagttacaactctcatgtccaatcagaccaaatgatttctattgatgtttctctatatcactgggtgttctgcatggaacccttcaaacacaaagatagaggaacacaaattctgatggcactacataaaaaaacctgtgaaacattcaaactttggacaagactctgaacacgattctaatgccactaaatagagccacagaagcattgatatggtctgagctgtggactgttcattttcagcatgttactagctctctgcaattagagccacggaatctactgactactgacataatacattattgttctctgcaattttaggcaagcgctgttagcacatacaaatcacataaatttagcgttcccatctgtggtaaagttaacagtgtttttaatcgtgcattgaccgtagaatatgaacttcaatgtgaaacaattaccaaaacacaaaatcatgggcagccaaaacagtttatggattaagggatttacaagagagatggtgtgtcagcattcgctgtttccaagcatggagtcaccattatgggtcactttgtcaattttggtgttggcgactgagatcctgcctgctctttgctcttttcatttttgctttgaacctcaattttaacatcaaagtctccatcgtgttgacaaagttgccgactgccattaccaccagcaagatcccacaaactacaacct

SEQ ID NO: 55705 - DNA, 1818 bp, Oryza sativa
ttttttagctttatgtatattatttcctttagagttttgttccatctatggttgttctctcttttttagttccattggtttctttcttgtattctaggattatataaattaatttatctattcaagtagcatggtgaaaatattagaaaatcagcaacataagaacaattttgatacagtatttcagcaaatctaagaagtaggagtataaatatgagaatcaatgaactttaagaagataattggtaagcacatattgttattacaatccttcacctctatttacattattctttacttttatgtgcattcaactgacattcatgtcagtattattacgtgtctatgtataacttcttaactttattgttgaatattccttactgcatcctggttgttcatggatctatatactgtatggttctggtagttgaagctggcaaaactgactacatgagcattatgcgtttaccatgaaccttactatgccaattctggaactgtttactgtggtatagatgcagtttacgtagaaatgctttggcaggattgctgctgcttacatgatctgtgaagtaggctgaatgtcttcagattgcttattccagtgcatagctcttgcatcttattctgtgaattaccatgtactatctgaagttgtgaattgatctgcatagagtgtttgcctttattttatagatgccttcttggagaccctcacaagtcacaaccagttcaactgaagtgggcgactttcataatgcatctgattctgaacactggggttgcatttagttacaagatcagattccaatagcaaatcgagaggtgatcggtcccaatagattgtctgaaactggtcaggtcatctgaaccttgacaagatctgtagttgtcatttctgttagaatgtatgccgccttggtaaatattccttggcagatagtagctcttttattatgtgaaacagaacatctgaacgtgactttggtaatattccattctgcatatgttctctcgacgccttttcatcttcggtgcttacaatttgcagtctacctttgatcttcctttttccctctcccttgaggtctcattttccctgtctgaaatacgttgggagatcatgcaatttccactaatattggtgcatagaactgcactattttgtaccgacatttgtcaactttcgtcatattgagcggagcatagtaaactaaattttgttactgtcattgttagtatagtattttgttgctgtcattgttagtatagttttcttgcctttgtaaactactagtaaaacagttttcactgtaatggatgaacagtccagatagccgatatataatattttgacagtggtacatgctgtcatgcagaagtgctgacaaaattcagatccattttgaggtccactcccttcgtcccacaaaaaatcaacctagtactagatgtgacatatcctagtattataaatctaaacatatctctgttcagatttattctactaaaaatacgtcacatccaattctagattcattttttttagggacggagggagtaattcacattagttcagcatttcacttggcagaaagtaaatgagtgccagcaaatgactctggctgctaagcccaattcgattgaccatgtcatatctggtatggaactgggatttggtatatttttaagctagctgtcttgtagcgtcccagcataagttcagttacttgtgtcattagattaagaggtaaacatatttaattgagaagaaaataatttgcactctttagaccagcctccacaaacgaacag

SEQ ID NO: 55706 - DNA, 3623 bp, Oryza sativa
agcttaaatcaataaatctaagcatcgatagaattttttatagaaaatatataattttaaagacttaaaacaaacaatcagcaataataatgttttattttgagatggtagatgacgacagaatcacgaaaaagacgtatcaatgaatttaagcaatcaatatttttttagaaaatatataatttgaaacaaataatgggggacaataatgttttatgttgagatagcaggtgatgacagaatcacgaaaaagagaggctaccgtggcttatctctgtgggccccattggtcagtaggatattagggagacatgggcccacgcgtcatcctcacgggagcttcttgtcttctctttacaagagaatagagaaagaagacgaccacgccaccaccgctcgtctccaccgcgagcgaaacccaaaaaggcaatggcgaccgacggcgacgccctcgagtcccaggcggcggcggcggccgaggcggcgcgggagctgcgcgaggccgccgcgtccctcgtcgcccgccgctccgccgacgaggacgcgctccgccgccgcgccacggcgctcgacgccgacctccgccgcctccaggcctccctctccaccctcgcccccaccacgctcgacaaggtgactgcatctcgttcttctcttctactcatctccctcttcctcttcctctccccgcgcttgcttccaattcgatctctctctctctctcactcacgcgtcgcctcgtacgggtttcggcggcttggaattgaaacctacgagctgctagtacgttagatcgtgattcgtttcgtgattatctcgcaaagcagaacgcttacgcgcttcacgccttcgcctggaggattgagatgtaaagtttgcacgcccgcgatctggtgctcgtcaaacactggatttgttgcgccatctccctggagatgtctccaatttacatgcttcctattggttttcaaagttaggaatccgaggcgtgtgcatcgagctggatgctggccatggccaacgattattattgttgttttttgtattgaaatctcgaggcagtttaggcaaactatagattccgtcagaaatctgtccccatcctttactgctccgtttagagatccttggaatattcgctctccctcatgcttgtgcaaatttgtaatgcatccactaggttgctcagtacgtggattgagaaacattgtccactgctccgtcgttgctaagccaaaaggtttaatctcaacctagagaattattacaacctatctagatttaatctgcactgtctcccatgcatttctttagcacgcacaagtgacaaaatttgacctgtttctaaattgatataagagtctccgtccgcatgtccaagtttatcgcactcctttttagattttctacttaccttttgtacctcttttctaatatatagttttcttctgtacttctgttgtgtcatctgtgagaattgtctcattctgccatttatctatataggttgaggaggaactggagcgtgccagggtaacaatctcagatagtgacgtggctgcatttctcccaagcaagcggaatggtatgctatgatttatctcaccccccatgcccgtctcggggaaatatactgttatttatggaattcacttctccttgaaatttagggaagttcctcaagacctttgttggccctgtaaatgtgcgggtggcgagaaaagaagataagctcagagtgaaggacgagtacaacaactacagggtagattttagatgcttcttcgataatttttttttagaaagcttatgcatttactttggatatgatttcttggaccaatttaataaagctatctgtactttttattacttttattttgatgacttaagcattctaaatttccaatgattactccaattggtgtattctttaaattttgatctgtgataagaatcactattgaagagaactactaccattttctacaaaaatctaagtaaatttcagattatcaaggtcaacgagtatggtgtgtattcaatctcagacagcatgctgataaaaccttgaacctgttttgtatgtcatatggtttaattagtaaatacgggaaacatgcaattctggactaatactctagaaatcatgttgaaaggttatgtaagtgttccttttcatgtcgaattcaagcagtcctttctaaattgaacatagtggcttaactggtagagtatacttggtataattttcgctactataaatttttatgtcatgcctgacagtattgatggtttcatttatttgcaggatagggctgcctatatgtttctattgttcccatccattctcctcctacttagatggtggatatgggatggatgccttccagccttggcagttcagatgtaccaggtatttagtgccgtgcagtgattgaccctgaatatattttctctatgtatgactttgctgtccagcagaaacgatctaaagtttatttgttccacttaacaggcttggctactattcctttacacaagttttgctctgcgggagaatgtgttgattgtaaatggaagtgatattcgtccttggtatgtgtctgaatttcattgcttacagaaactgtcaactgcagcactcaacaattttatggcaaatacccatttttaatgcacggacagacaaaagtgcttgatttttttactatatgcgacttataatttgttggtatgggaaagatcttatatcaaaacatcttttaatgatattcgtaaaacccatgtttcgtttgttcacttaatctagcaaaatcaattcctttcttagaatgcattatcatcttttcaggtggatataccaccactatttagcaatgctaatggctctcgttagccttacatgggagataaaaggacagcctgattgttccagcaagcaggtaaatgatcatttttcagagaaaactagcactcactttgtcatcaaaccttcaaatttttggaacgctgaactcagacactatggctttcttttcagaggggggtacaacttttcctgcggtgggcaatcatgcaaggaattgcaatgcatctacagaataggtaccagcgtcaaagattgcgcacccggatagctctaggaaaggtaaggttctgtggttcacgtcttgcttcaagacagtactcaacaacatattcttttagtgccaagtgaaggtgtacaacatgttccaataataagattcaaatgagtatcatcttcaaatgatatgtatacaatgcagatgcttatcaaaagcaatttaatgcactaatttgcttgatgtttgttgatatttgcatatcagctaagagttcggaatatcactgaaactaatttagagaagatgctctggtcttttaatcaaactaagtcttataggcaatggttgttcatacagctcaatagactgttgaaatgatgctgtatattgtatcatctatgtacctttctcaagttttatcggtgttgttatttattctgtttcatatttaattgcatgcaggctaaaagaatggatgttgttgctggagaaacagctggtgtggaagggcagctcttgctactttacccggtc

SEQ ID NO: 55707 - DNA, 758 bp, Oryza sativa
tgtaaatctgggtaccctttattataacagtgtgtgcaggcaaattgacaccccatgcaagggtggctgttgagacaaggacctgtatatgcttatcggcaaaaagctcctctacaagctcacggtctacccttgccaacccagcatgatgaatagcaaacccataaggcaaaaggtctttaaggtcactgctttttactagttctgcctgactcccaagaatctcttggcttgcactatcatccttcaagaagcggtttaacgtgtcattagccaatgcagtatctctgatggcacgggcagttttcgctgtctccttcctcgagtgcacgaatataagcacttgatgctttccagcagatgccataaccttctcgtagcaaatctcattcatcagctgaaacctctgtagtggcttcctcacagtgatcccaatgtattgctgagcaagggggcaaggtctgtagctgttatcgaaatggaagaggccatcagagcgaacacgcaggaaaaccgcgacatcttcatagttcggaagagttgctgagagaccaactagacggatatgttctttggtcgtctcaatctgccggacagttctagaaacaatgctctccagaacaggccctctgttgtcatgaagtagatggatctcatcaatgattagaagctttaccatttgagtataggttctgtcacctgattttcttgtgacaatgtcccatttctcaggtgtggtgacaattatctgtgtttca

SEQ ID NO: 55708 - DNA, 1439 bp, Oryza sativa
ctgcagccctacctatccaagattaatttctgatggtgcaactccatccaatatttaaagtatgatgcaaaatccgcgggacacggtgatagagcactttgatcgatgagaattaattttaaaaccatagagattttattgtctttggttttcgcgtcttttatttagctaatgatgatagagggagtaaattgccattaattagttcaagcaagttggagtagaacaatacaaaatgtgatgtagtatatatatgtgtgcgcttacctaggatgggaattatatactatggtgttaatgaacatcaacatttggccgtgttcttttctccaacaagagttagatgaagattaagatttttgtgacgcacttttcaaactgctaaacggtgcgtttcatacgaaaactttctatatgaaagttactctaaaatatcaaattaatctattttttaagtttgtaataattaaaacttaatctaccatatgttaatatcatctcattttacgtaaaaaaaaacttaatcttcatctttatctttagaagaaaagaacaccacctatataagagagatgtgagaaatgacttcaatcgatatcttgtagtattgttattttatttgcagataggtaggagtaattgttgaggaagaattgataccagaaggcattcatgcctcctactacaaggcaaagcttttgccttttctttatttctttttttttaaaaaaaaggaaggcattcatgcatcatccaattgatgattgatgggggaagtggaaaatggtggctgtgattgcttccggacatttaggcaggcgggctgctgccacgtcgtcgtgagcgtgggagccacacattaattaggcgatcgattccaacgcgacacgtgtttgtgctttggtcgatgctgactaggcagattggtaggcaagccatccgatacgacaccttaaggcaatgattatatttgtaaagtgagccatatatattgtggaaagtagcattagcttagggtacaccttatgcttaagttctaccacaaacaaaaagaaaatattttttctctctcattcacttcatgaacaagagatgaaacaattatttttccattctaagtgggccatcttgtggctaattttaaccatagcattgtgggtatggctataataatgactcactatttatagggcccaccttaaggttacattacaccacaaacattgaggatgccctaattgacgtgcgctataaacttccaatgtaatcaacccatcttgtcgtcgccgtaatacacactatattatacttctttttgttactatttcaagatataatcctttttaagatgcagccacaccggtttttatataaaaaagagtttgaaaccgagtttttataagatttgtttgtatctgtatcattatattttcatgaaa

SEQ ID NO: 55709 - DNA, 1552 bp, Oryza sativa
aaagagttttcgaacacaaatgaaaaaactaattttataacttgtctggaaaccgcgagatgaatgttttgagcctaattaagccgtcattagcacatgtgggttactgtagcactttatgactaatcatggactaattagctaggcttaaaagattcgtctcacgatttctatgcaaactgtgcaattagtttttatttttatctatatttaatgctccatatatgtgtccaaagatttgatacgatgtttttgtgaacaaaattttgggaactaaaccaagcctatttcgttcagttttgttacgggtcactctgttcagttaattttccagtactacatgcatacatgtaatcatgtagtaatcactatcactgctcctatatatatgtatgtagaaacgtgttttcctatattggagttattagtgcatatagtatatattagagcatccccagcagatactccatctagtcctctatccacaaaatagaggttgggagaagaaaaatgagctccagcagatactccatcctagcatccaaatttagctatcctccatccggggagagagaaacgtcaaatttgaagtttctctctcctcacaccatcctaaccgccagcgtcgcccgcccccatccggagtccggattgacctcccctccgccgcgacctccccaatgtcgtcgtcgtcgccgtccggatgtgcatttttcactatggagtgagggtggagagggagagacataccagatctagaaggagaacccacgccggccgttgcgtcgccgtgcctctacacgccggccgtcacgccgccgcgcctctgcgcccgtcggctgccgcgcctccgagcccgtagcgccgctgcgccgcagcccccgtcggccgccgcggcccgtcgcgccgcagcgcccccgctcccgtcgcgctgccgcggccgccagcctccgcctccacgctggggagaaaaggagagaagaagaagaggaatagaagaggagagaagaagaggaatcggaaagaggaaagaaaacgagtagagaggaggagaaaaaaaaggtccggaccattaaaaatatattcattaaaataaactcatttaaattatcaggataaataacacggttaaaatttaaaatttagttgtttaaaatatagtctttaaaaaataatacaaatgtatggttagttgaaaaatattagtaaaatatagaagggtgtgatatgaaagatgcaatatagatgatctgttggagtgagaagaaatatgaatgaggaatctttttagatggtcatccatatgagcatatggaggatcaaatttgaatgagctgctgggatgctcttagcagacatccatgttactagctagtatgtatagtagcagttgatgttgtgacttgtgacagcaattcgatgcatataaagctgatgagatgaaggtaaagtgctggcatatggcatgggtgctgacagttacatatacgcgcctaactaacggacgtcgtgttgcaataatgcaaacttcggtctcgacgtggcatcaaaa

SEQ ID NO: 55710 - DNA, 17910 bp, Oryza sativa
  unsure (1)..(17910): unsure at all n locations
tagctaagctgctggatcttctggttcatgaacattattgcaaaacagcactgccattgatagagctagaatagcaatacagcacatcagcaatctatcctcatcacatgttgagtttgaggctgatctgaagttggcgccatatattgtactgtatttgtagatgccatgtcagctagccatggtggggtgggggccaaaagtgacactgtaggccccaaggaaataattctatctggtggctgtgctcagccccaccactcatggagatccggaatctcctcctctcatctaacctcatcccatcacaagctcactctctcatggtcatggtcatggagtttagctagctagcacactgatttgagctagtagcagctttgagttcttggcatagcctaatgattggcacatgctgttgccaggtgccagctagtagcccaaatggactaatcaatttcttaattagctcgagcaaactgattgtcactagcttgatgaagcagctgagggcaaggaagttaagttgagtgtctgtccgagtcatcggagagagagagtcgagatgctgttggatgtttctgtttgacacttgttgtgcattgtcagcagcttagctatgagtgtgtatctccaataattctgtttctttaagtatcggatatacagattctccgagaaatggttcccaaataattgatcccaataatgcaattgtttaaagaacgatcgatcgatacctgtgtgcccggtcgatcgatcttaagtgtaagataactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagggaaaaacaacatatgcccctagaggcacccggaccccccttatatatggggaggagtccgtgttacaaaagacaatctatatccctaacggaatatgcagatacatataaaatatagtcgtgaccgactaagtctcagggtatttccttgatgcacaagttgagaaacaaacccaagatacacataagatattctatctatattcggtatcctatattcagcccaaatatcatcgccgtgtagatatgggatatccataatctccacagtagcccccgagacctttgcagtcaaccatcatagcctgctcaaagataataatccgagtgcttcaaacttttcatgccaaggcctgccgagtagcgaaaacgaagactgtaaagggcgaaaagataaagaatatggtgcatcgaatagatgcacctaattaggtatagcctccaactatgtgattagttaacaaactaaacatatagttgagaacaaaataatagcataattatgcatcatatgacaaaagcatacacggcgcctaaagaggcattccagccgactgctttttagccataataaaagaaatccaagtggttaacactctaaaaagttcacgaatgaacacacttgacaggcatccgaatataagactctaaagattacccaccaaatattataaaaatcatggtaatgaataagtctaatagcctaggctatgactatttaccacaatgaaaacaggcatataacataccgaggaaatgactatgataaaaacaagtcattccaagttaacccagacagcttttgtagcctaaaaaaacgtacaaaaacagcataacgcctttctgtcgggcaccttttaatttgcattgcaataattccaaagaattatatgaccgcgtaaaaaggattttatcagcattgggcaacactattgtgtacataaattgccaaagcaaaaaatgcctaagtccctaaggaacacaatgggccacgctgttaaaagtattgggctgagatactattcaggcctaggcccattcgcacctccgatacccttaacaagaaaacccgagatccaagcgacacttcgtcttccccgccggaactctcgccattttccccactccttgctacagtacagagctacgccggcaaactagggttcaccattccactcaaatccaccttcaaaaagtgatcaaaatccttcccgtgatccaccgcctcaattcctcatctctcccaagccatccctcgaatcaaatcaacgtatcggggaaaatcaatggcggaagagaaagaaagcttcgaaggccaatgggcgccgtccgacgtgacggaggagaacctgaaggagatggtggcgcacggcgttctccctgccaaggagatcatcgggtggcggccagcgtgcgatgaggcttttccgacccccgatacacacgaggccgtggtcttctctcatttcttttatggtggatttgctcttccaacctcaaagttcttccgtgggatactgaatttctatggaatcagcttacatcatttgaatccgaactccatagtccatattgcaaatttcgtccatgtctgtgaagcttttttgggcattagacctcattttgctctgttccgccgaatctttttccttaagcctcaaccaaacaaaaacaaaccatgcgtagttggtggggctggatttcaactgaggggcactctgagccagaagtatttctctatgcctttcaagacttcaaacaaaggatggcacgccaactggttttatattcaaaatcccgagcccgctcttcctgagtactcctgtcttcccccagtataccaagatacctggaactctcttcccatgggagatgaagctgcccaagccttagaactgatggaacgcatgctgaagctcaaagagcaaggcttacagggagagcaaatcactcggcatttcattaagtgtcgattagctccaatcaaagagagatcccgcacagcattcgagtttgacggcaagcatgatccaaaccgtgaagacccagactctctggactttaaaatcatgaaggagagaatgtataaaatcttctcaaatgctattgtcgtcagctactcacatcagctgccagttgtaccatataatgcattcaatccgcctccacaggtatgtatctgaaaccttcaactcatgaccaaaacataattttatcttcatgttgagtgagctaaccgtggaagcatctcattcaggagtacgtattgatgaaatctgatcccccaattgctcaacgccgatctcctcgccagcacaccgttcagggaagtggagggccgacaatcaggtcagacccgcaacctcaaacctccaaaccggctgggcagacaggttctcgcaagagaaagctggtgcttaatgacgacgaaggcgatgacagcaacaaatctggggacaagggcacgcccaataaactcccaaagcataccatgcccaggaaaaaactggctggccgtcaaatgccaaagattagaacatcttccaggtataaacttctcggtaccattttatttcggcatgcttctctcatagaaattacgctgaataccgaaaggacactttgcaggaaaccgtccgatatagatccaactggaaaaaatcctgatccggctgccacagagtcaaatttatccaaagatgctgatccgaccgccgaaaaccagccgactgccgaaagccagccgactgccgaaagtcagccgactggcgcccatgcttcggatgacaaggccaatccgagtgaccagccgccgactggaaaccagtcggcagctactgaaactgcaacaacccaagagcccccgactggaaaccagtcggatgtaggtctaaatcaagagattcctgaagctgaagcgcaggcgacaacttctcaaggaccagaggctggtaatgactcagtgattgggtctccggataaagagcagggatcacctcacgctcagctaggcacatcctcaggtaactcatcttctcaagtgatgccgttctgaataactccagcttactcgtctaatgtcttgggaatacatcaggtccactaggcggcgacgaagaagaaattctccgcataaaggcagctgatgactctcgtcctcctatcttactcaaatggtgggacgagaactctcaagtttccggcattgtcataaatcgccaaaaagaagatgaggaagtgtgccagctgaagaaagtacttggagaagctactcgcattgtgaatgtaagtcttctaggtgactgcctttaatgactttgttttctcgttagcaaaactaatccatgaaccaccgtgcagagaatccatcttcgcaatgaggccaagaccacaaccttagaaaagctggttcctcatttgggaactcttgaagccgttaggagccagctacacgaggccaaggagcatgccaagaaaacggagaaggaattaagggaacgaattgctcagctccaggattcaaactacgagctgagtggttcatcaaaaggtaatctctagatctgtcccatttatgctgtcataactggatcctcaaacatttggatttcaaacagcgcaagccaccaggatggctcaaatggagaagcaaattgaagccttgagaaaagacaaaacagaactagctgctgaaagggactcggccttgaaggaggttgaaggtactgccagctgacaatctgaactttcctctttttaatgcagcagattcttattataaatgtgttttgtagaccgtaaaatcaaatctcaagctcagtttgacgtcctggttggtaagatccagaggcttgaaggagcaagagatgaagttgccaatgtcgctacaccacttgtccaagctatgttccttaataacagtggtccgagtgcacttgacgcaaccgaaatctttgacaagctgagagttgcaccggatgtatatttcaagaacatcaagaaagctggaagtatgggagctagcatggcattggcgatgaccaaatccttgtacccgagaattgaaatcgacaccattgatggatttgcagacgggacaagcgaagaggctgctcttgatcttatcaacaatgctcaaaatgcggctgacaagattgcaagtgacgttgtagagcaattccacaacaacgaccttcagccgagcaacaataactctgatgatgaaaggactgactctgactgagtatgaatgtaacaaatggaggctcaatttgtacaatactggtgtatttatgctgtgcttgatagttccagccaaatctttgatttcttaaaagcttttatcaagctttgttgagcctaaaacccaaagaagctattaaaaactttcagtcctcgcagactaagtagaaaaatcgaacaaggcaatgataaaccaagtaagcaaattgaattgataaaaaatcacactccattattatgataatagcccccgactgacaacttcaagaagaaaacttgatgttgacagtcaagatagggaagtacaatgataaacttaagcgtagaaacgacgaagatgttcaatgttccaagagttgtcgacgagagtaccatcttctcgcttgagtcgataggaacctggccgggtgacttcagagatgataaatggcccctcccataaaggagataacttgtgccgatcccgtgtagtttgaattttcctcaaaaccaggtcgccgactaaaaaggcacgggatcgaacattgcgattatgataacgccgcaacccttgtaagtatcgagccgaccgaatcaaagctgcttcacggacttcttccaaccggtgcaagtcatccactctgtcctcttcgtagcgttcttcacggaaatttcgaaagcgcaaagattcgaattcaacttcactcggcaacattgcttctgccccatagacaaggaaaaaaggtgactggcctgtggccctactgggtgtagttcgcaaagaccaaagcaccgatggcagctgttgcacccatttgccggcatagggttttagccggtcaaagacacgcgttttaatcccttgaagtatcatgccattggctcgctccacctgtccattgctcatggggtgtgccactgaggcatagcaaatcttaattccaaagtcctcacaaaagtctttaaaaactccgccagtgacttgtgtgccattatcagtgataatccgattgggcactccaaatctatgcacaatattgatgaagaagtctcgagcattatctgctgtgattgtgacaaccggtttagcttcaatccacttggaaaatttatcaatggccacaaagagatgcgtgtaaccaccgactgcctttttaaacggaccaaccatgtcgagcccccaaaccgcaaacggccaagacagcgggatagtttgcaactcttgagctggtaaatgaatttgtctggcaaaaaattggcaaccttcgcacgtgcgcacaattttgtcggcgtcggacactgcagtaggccagaaaaccctgccggtaagctttgccgacaatggtgcgtgcagcagcgtgatttccgcatatcccagaatgtatgtctttcagcaattgtctcccttcctctaaagatacgcagcgttgcagaattcctgaagggcttttcttgtataactcagcttcatgcataacataaagtttgctccgccttgaaacccgctcggcttcatctttgtcttaagggagttcttgagaagtcaaaaatcgtatgaggggatctcgccagtcggcttcaatcatagctacgtcatgagtgcccgcaatttgagcagtatctttgtgaggtaccgtcggcgtataaaggtgttcgacgaaaacatcggaaggcgccacctcgcgcttggatccaaaattggcaagtctgtcggcggcttcattattatgtcgaagaacatgacttagctcgagtccatcgaacttgtcttccaatttgcgtacctcttgtcgatatgccatcatattgtcatcaaggcaggaccactctttcataacctggttgacaaccagctgtgaatcgcctctaactattagacgctttatccctagggaaattgcaatccgcagcccatgaaggagggcctcatactcggcaacgttgtgggacgccgaaaaatgtatccaaagtacatagcttaatctttctccagttggtgaaattagaaccactcctgctccagtgccggaaagtctttttgacccgtcaaaatgcatggtccagtgctccatcttctccgcgggggtatcctcttggaactcggtccattcggcgacaaaatcagctaacgcttgggacttgattgaaattcggggcttgaatgatatgtccaaagacatcaactccaaagcccactttgcaatccgtccgtttgcttcgcggttgtgcagtatatcaccgagtggaaatgatgtgaccaccgttaccgggtgaccttgaaagtagtgagatagcttcctggtagtgattaaaataccatatgacaacttctgaacctgagggtacctcgttttggagtcggctaggacctcgctgacaaaataaatcggtcgctggactttctggacatggccttctttctcacgctcaacgaccaagacagtgctcacaacctgggaggtggcagatacatacagcaacaacggctcctgcgggtgtggtgaggctaggaccggtggctcggtgaggagtttcttgaaatcttcgaaggccttctgtgcttcaggtccccactggaaatcatctgttttctttagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcctctatgagacaccataaaaccaagcagcttccctgacggtactccgaaggtgcacttttcagggtttaatttcatcctgaaagcacggatgctcgcgaaggtttcttccagatccgagatcaaatcatccttttgcttggtcttgacgactacatcatccacataggcttcaacgttgcggccaatctgcgttgagaagcatctctggatcatacgttgataagttgctcctgcgtttttgagtccaaatggcatggtgacgtagcagtatgccccgaagggcgtgatgaatgaagtcttcaagcagtcggattccttcagtcggatctggtgataccccgagtagcaatccaaaaaactgagaagctcacagccggcggtcgagtcaactacctggtcaatgcgaggcaacccaaaaggatctttagggcaggatttgttgaggtcagtgtaatcaacacacatgcgccattgccctgttttcttccgaactagaactgggtttgccagccagtcgggatgaaggacttctttaatgaagcctgctgctaacagcttggttaattcctccttgatcgcgtccttcctgtcttgtgcgaatcggcggagtcgttgtttgataggcttggcgtcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactttttgaagtcttggtagcgggcacttctccttcgtccgccgtggctgcagcagtcggatatcctctcgagcagacgctatctcgcgggtttgggccatgtcgcaactctccttgtcgcatgtgacggcttgcttgatgtcactccgtagggataagactcctcggggaccaggcatcttcatcatcatgtaagtgtagtgcgggacggccatgaacttggctaatgccgggcgtccgagtatggcatggtatgctgtctcgaaatcggcgacttcgaagctgatattctctgtgcgaaagttttcccgagtgccaaaagtgaccgggagggtgatctggccgagtggagttgcggataatcctggaattacgccgtgaaaaggcgcattgcttggttttaactcggagcgaggaatctgcatatcatccaaggtcttggcgaaaaggatattgagtgcactgccaccgtcgatgagggttctgcgaagcttgacattacggaccactgggtctagtaccagggggaccgccccgggtggaccactcggtcaggatgatccgagcggtcaaacttgattgcaatctctgaccatcgaagatattggggcgtgtcgggctgaacagcattgatctcccgttcggtcaacttttgcttccgtttagactcataagccagggggccgccgaagatatggttgagctccttgcggtggtcttgaaaacctgccggggtgtcgccgtcgtccttcttcctcgacgtgctttgttcttcgtcggagttcttccgtgtagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttctgcaggcttacgcttgcggtccttatgattgttacttccacctcctcccgaagccggcgtatccttttttggcttccaactgggacccgactgctttgacgcggtgacggcgtcttcagctttggcgtactcgttggctttttcaaacatgagcttgactgtcctgggaggcttacgcccgaatttgccaaccaattcttcgtggcgaatccctttggtgaatgcggcgatgatgacgtcgtcggtgatgtcggagatcttgttacgctgttcagaaaatcgccggatgtaatctcgaagggattctccggacttctgaatgacgttgtagaggtcgtattgtgtgccgggacgctcgaaggtgccttgaaagttggcgatgaagtggtcacgtaactcggcccaagatccgattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccatcgtacttctctattccagtcggcttgaagccggctggccagtccactcgacgcaggtcgtcggtgaaggctgctactccgtcaaggtcatcgtcgtggcggtccggcgagtgatgatagcctcgagctgcgcggcgctgtatgattgtgtcgcgaagatcgacggggcggcgacgaggtggtgagcgaggccgttccactcggcgctccctatggtggtcgggaggtgagtgaacagaccgctcgtcgtggcccctgctcctgcgattggatcctgcgccggtgatgctgaggcttggatgacggtagtcatgagatcggaagtgggggactcggctgccagtcggcgtgtggacgctttcggagttaactgggaccgaagccgcaatcatagtcttcgtctggttcaagatgttgacgacgtgatcggattgattgagctcgctttccctgagtagggtgtcgaggagggtgatcgcggcaaccgcattctgttgaggggtgcgaaaaatcggcgtcccttcaacatcttgctggccgatgagatcacgcgcccggcgtcctgcttccaaagctcgctgccgtcgatcctcagcctccttcgcggtccgctcacgctcctgctgctcatgccgtaaccgttcttgttcttgtgcttgatgctcctcttccagtcggcggcgttcagtctcgcgacgcgcttcggtctcccgggcttggcgttgctcctccgtctcgttattggccatgaagacgccaaaatagagaggggtgtagttgtcatctaggcttccgtcgaagtcgtcgagatccgggtcgtggtagcgagagctaaactcgtcgtactccacgatgtcggtggggcgcgagtcgacggtaggagagctgtagtcgccatctagctgatccgtcgaaaccgtgccgagtggttggaggatgacgccaacttccctgaagctaggcgaaatcggtgttgaagccgacttccgcctaggcctacgggaaagagacgctgtcgtgatggagacggccgccaaatcgtcggggagcttcatcaggatcggtgggtaagccccatcatcttgatctggtgacgttggtgaagatgcgatctcgcccgagtggtttgaagccgactcggtcgagatggtcttgaagtaactttcagccgcgtttgggagtccaaacggggccgaaatctggttctctcccgactggtccgactccgagtcaaggagagagatcttgccgaagttgttggtgacgaagtcgaggctgccgaaccgaaacgtctgcccgggtgggaagacgaggtcgtcgatgccggagatggaacccattgcactgatcggcgaaaagcttgacgcaacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttggggaaaaacaacatatgcccctagaggcacccggaccccccttatatatggggaggagtccgtgttacaaaagacaatctatatccctaacggaatatgcagatacatataaaatacagtcgtgaccgactaagtctcagggtatttccttgatgcacaagttgagaaacaaacccaagatacacataagatattctatctatattcggtatcctatattcagcccaaatatcatcgccgtgtagatatgggatatccataatctccacaataacataacatgcaatgattgcagaaaacaacaaggaacaccaacgtctcgattttcagggcacatgcagtcgtgttgtgacctggagggcaagaaatcgaccaagaacaatgtctttcggctcaatatccttcaacgcaacccctactgccagtctgtagttgctcaaaatcagctccagaaattgcactgaattttgagctgacaagagtgttgccccagctgttaagagggccaccaggaaattttgggctgtggccacattagtcgctgcagatcagctttagaaacagagctgctagcttgcagagatggaatagccctggccctccaatggactctgctgcccatcgtcgttgaatccgattgccaagaagcaatccagctgatcaagtcagtgaataaggtattgtctgctgatgcgtgcgtagtcaacgaggtgattgaacttatttttcgcaaaaagaccagccccggtactgtaggactgtagcaaaaatccgacgtggcacgtcccagcgtccgccccttcttccccccttaatcttccccgatggctggaacaagggtgattgcacttaataaagtgcacaggactcagaatagcattaatcatttcttagcaaataaaggccgaagtgaatccttaacttacttctggccggatgactcttgtattgctatctcacatttgctttgtgagaactcctattctgagtaatatatccttgtttccccgcaaaaaaaaaaagttataacaaaacctatacggacctacctagttgaaccgcctgaatcaaaggtgaaccaactgttgtaaataactagagatatgcaggttgcaatgtcattttcagatggcatgaaaaacgactttgttatacaagtcaaagtgtgagtttgttatactcacaactcacgacggcatgtagctcctttcaaaaattaaaatcaaaagtgtgatgtatttgtagaagagacaacaactactttggagagttgagagatttcagtttctgctctctttggttgaggtctgggcctttgtgctgctctgtaaaattcaggcttgtaatcttatcttaaggaaaaagtacaccgaaagaacaagctgcaaccctgcacttcggcccatgctcttaattgtgttacatgggcccatttattggataaaatctgtcacttcacctaagctgcaagaatacagcccacgatgcatcacagccatgtaagagtctaatgggccgagaagcaaatgatccaagcaacccgggaccaaactaggcccgatctaactacttgggccatgaattcagccatgagggtcttaaaacgggccgtaatttctggaataaatcgtggaagcccatgaggggagcgggagggcaaactcgtaaatccggtgaactaaaaccctacaccaactagtatatatagcctctccaaccctcgctctcccactcttgtcatctcggcggcggcgcggcgcggagcagaggaggacgaagcagcaggcggcggcggcagagcacggcgacctagcccgacctcgcaaccatggtgagccccctaccccctctcctccgtcctatgcttctcccccccgcgcgctctctcgcgtctgcggatctggctgatctgtggcatccttctcgttcgtagcttcggtgggattagttccattccccgctctccctgagtgggagttcgtgtgcggcgcgtggcctgctaggatgtagtagcttagtagtcggcttggttattttgctcttggtccatgagatttctttgtgatgtgtaggattcgtatgttgagtagatagctttgtaccacgctacagcctgttaggatttaaacgcatgttatgttgaatttgtactcgctggctggcttcagattgtggatcagttcctagtggttatgtttcagcgttgcgcgagaatgaacagctatgcacaatgttgggcttctagtagtagagtctaggattggacattgcatccttggctgtcgcccatttgtgggatcttagacagctcgttattttcagtatgctttgtataattgtactgtcaatgctagtttgagggtttagctcgtgctgtttgctgcgttattgttcctctacatttctgttacgtgccaaggttcaacttgtatatctgcctggcttcaaggattataggttctggtgtctagattccttttttgttaagaattaacaaagattacttagaaaccatgccgcaccattgccatgagcgatgttagggctgttcataaccttgtgatttcattgtgtcattgtattcatgtcgtgctactctgcagttatgttgttatttgtgctgatcatttccttttcccttaccgtaataccaggcaaggggtttgaagaagcatctgaagaggctcaatgcgcccaagcattggatgctcgacaagcttggtggagcttttgtaagtttgtcattcttgtttacacttaactacacatgcttgaagcttatcttttttttttctgttacctgatagcttatatttctaattaccttttaccataggcccccaagccatcttctggtcctcacaagtccagggagtgcctgcctctgatcctcattatcaggaacaggctcaagtatgctctgacataccgtgaggttatttctatcctcatgcagcgccatgtcttggttgatggcaaggtcaggactgacaagacctacccagctggtttcatgggtatgctcaatcgttattgcaatcaatatatgcttcagtgtatgatgtaaaaacacttggtgctttgtgctaaacatattcttttttggcagatgtcatttccatccccaagactggtgagaactacaggcttctgtacgacaccaagggacgtttccgccttcagtctgtcaaggatgaggatgctaaggttaggacatattaatttttggtactgttcttgctgaacacactcttgttatatgaaggtattctgtttgaaataatgaaatttatgttgtgctgagaaagatattttgctttgattgaactgttattgagaattgcttctttagtttacctctagagaagaactgattgtagcattgtgcattccgttacttttgagtgtattaattcaagttagaatgctggctgattctaatttttctgtgcacagttcaagctttgcaaggttcggtctgtgcagtttggccagaagggaatcccctacctgaacacctatgatggtcgcaccatccgctaccctgacccgatcatcaaggcaaacgacacaatcaagatcgatctggagaccaacaagattgtcgacttcatcaagtttgatgttggcaatgttgtcatggtgactggaggaaggaacacaggccgtgttggtgtgatcaagaacagggagaagcataaaggcagcttcgagaccatccacgttgaggatgccctgngccaccaattcgccacccgtctgggcaatgtgttcaccattggcaagggcaacaagccttgggtgagcctgcccaaggccaagggcatcaagctcagcatcatcgagaacaaaagaagcgggatgctgccgcccaggctgctgccaacgcttaaaatctgctgctgcgtctgcctggagttttgctatagcgagttgtttgcaaggatatagaactatctgccccagactatccttttttgagctcttttgcctaatgttatgttgatcaattcgcgaactcatgtttgctgctagctgtaatgcgactgtttaccttatttaaggcgccttttaagaacctccaaaccaaattgtctttgcctgttgctgagatggtatggttttgagcattcagcctatggcctttttgttcatagtcgcgttgcttctgttctgtttgcccgttgcatcattgttctgttagtctctattcgaagctcgtatactcgagcttaattactgggtgtcagttgttcgccattgaggatggatggagtagcatgctgtttgtctccgtgaagtcatggtaccatctctagcgattctgcatcgtgtctaggggtgcaagtggggcgggctttttttgcggcccgcagtcccgcccccacaaaaatgcccgcgaattgcaaaattttttggcccattagggcacgattgcactagacggggagacgtcgctgggcagcgagacggcaacgcagccgccgctactctcgtcaccgacgccgacttactcgtcgcccatccatccagcagcgaacgccgtccatcgctgcgatgctgcccatgctgccgcctccagctctaagggctccatcggcgtgggagcaggcaactacttcgagctccattggcagatctgccatggaagagagttgcagttccaattggccggccacaccttgtgcagcagcgacgacggccggtcagttctttttcctccttcttcttcggttcgtgttcaagatttgtttgatgtgccactctactcctgcgatttgtttgatgtgtgcaatcaaatatgctgtgtattgaccgatcaatttatacttcagcgcagggaatcgaatttaaaccatactacgaagagtgagattgagaattttctaatcatgatattacacaaagttgagcaatgtcgatctgtgttaggattgtagctgtttgatgtagttttcaagaaagattgtagctgtttgatgttgttaatcacttgacatgtcatttagcaatattagtgcttgtggctctgctgaatctatgagttctcttgcatgttcttgagctagtagctttcaatctgtttcctattcactgctctcttgttttttttttgtttttgcaattttgtattttcttccctctcttggtaggtttccctctcttgttcctagtttgatttgggacagggagtactcatgtgcttgtgtaaatattttcacgtgaaataatccagtcttgttgctggttgacgaacctaattaaacgaatgtctgcacattgcgggctgtcctacgacgcccgcgggctgaacctaattaatcgtgcccaatccatcgtgctgtagtagtagtttctatttgaatatttgtttttttaagtcgttaaggactctgctgtagcagtagtttctatttgagactcataaaattgttttttattactaataatccgttttgacatatagtaaagtccagctccaatcgaataaaaaacgagttggagaggaaaccagaaacagaactctcatactagaagagctatatagataggtaggagagtctgagatccaagggccaaggggggagagagagttatcgtcgtcctgaatgccatctgccatgtcctccgtggccgtgcaacgcgagcagcggtggcaaaacctagccctagccccagccctgcccatgagtaagcctcaactccctttgcctcccagccctgtctctggttcgtctcacctggatcagttcttgttcgctaatcggttcatgttgactaatgttagatggataccgaattataatttgcacaacattcaactgttgctgctttgctaggttaggtcaccgattcagctccttttaaccccataatatctgcattattcgttgaaaaattcttgatctttttatcccaataaaccattggtcggtagccccctacgttgtttgtctctctctctctctctaatgtgttcttgtcagtctgatgggctattataattataatcgtgctggttcagctgcagataaatcgaattgtacagtgggtagcactaataagggctgcagg

SEQ ID NO: 55711 - DNA, 728 bp, Oryza sativa
tcctgcagcccatgagatgtccaggagcacacatgactagctacaaaatgagggcttccccagcggtttctctaaaaaaactaggaagtgatatagttgaaaataaattaatctatagtcattggtaaatatataaaactagttaattgcatttttccacgcagatttcatcattaagggaggagaaagagaagagaaggggggtggaggggacaagagaaagggcatacccaagtaatcttcaatgtccgccttcaaaattcgcccatcaggaccagttcccattacgcttgacagtggaacctgttttgtgtttattaagtatgatcaataaaatctaccaattaatagcctagataggtaacacgaaaaaaaaactacattgttatcttctgccaattttcttgcaagagggctggagaatattcgaccccctggttgagaagcttcttcagtctttggggctttcggctcaggagtcctggaaggctctgtctccttcacctttggctctgcaggctcaggctgagccttcggttcagaaggggctgcaggtgcagctgaagttgaaggtttataatccttaaacttctcaaggtcaccctcttcttccacagttacagcaatgatctaaaggaacagtggggccataaatcaaccaagattacgtcagaaaaatttataggcagaggcaactgtaataatcatattagtaaaatgagagtcat

SEQ ID NO: 55712 - DNA, 5741 bp, Oryza sativa
tacacaaaaccacaatggttttaacacgtggacaggaaataaatactataggtgccggttatatcatttccagcacctataatgccgacttgtacgtctttatatagtagtgcaagtatatattatggtcgtaaagttttacaaactacactatcaacaattttgactttgatttaccatgcatacattttttttctacaatcacatgttaaatttataagttttttatctatcatataagtgttgcatctgctttttaaatttggatacatggtgtatgtctaaatattaattgaaggtcaacctataatactcagagttatatgccatatgtttgtgtaacttagattataatgtgcaaggttttatgaaattgacttttaattagtcttctactaatgttgagtaagcagctagcctttttcctcttcattaagcaagccactatataggtaaccaattcgtgcttttgctggccttctgtctatgttactccaataaagtttggtagcgccgccgaccagagcagctggctaataaaattaaagaataacaatatatcatgcatatatatattagtagtagcatattagaacttgcaaattgcaatagattgaaccaggattttggaagggatcgatatataaatatcgaagctagatccggacaaagcgcatgttatataattatattacacacgcatgttgctgagttgcacaagttaaccatgcattcttgtctctgcatatacacatacctgctaactgcaatatataataagccatagtatatacatacatcacatgaccgattctctgttggagatgcaaatcaaaacatgcctgacatttgccatggtataatggtgtgcatgttataatttggcaaggcattgaaactctcattcaggtagtatgtgtacatgaacagcatgcagagaagaaatttaatatatattaattagtataattattatacagatttcacagctgagtttgatcgatgcatgaactgtgtatatctgtcacggtagtgtgatgaaatatatggtgggggcatccaaagccagcccacatgtcagccagctgtagatccatcgatgctatgatgcatatatatggactatatatactcgctcgaattaattatgcgttacttatttttctctgcgcgtttaatcaaacactattaattagtacagtattaaactagctagctagcttagacagcgtcacctccatccatggtggggtagctgcgtacatgtgctcctgctttagctagctcaaactagtgcatctatcaacacaacactaatcatagcatgccgtcgacgccgcatttaattatagaaaggactgcctaaccggccatctcttgacagaaataaataccctaaaatcatgtgaattctaaaccgttagatcactatagatctgtacagctatattcttctctctcttcaccgctaactctgtttgagtgcacgctattttcgacattgagcttctcaatcctctaagatagatccatctgtcaccgcttcgcaggcgccaaaaaagcctactagatcaacctcctctcctcctccgtgagcggggtgtcaccccgttgtcttcctcgtctccaacagctcctacatcgtcacccgcctaataactgattaggatctctcacccccactgtcagccctatctgtcaccctgccactaatccgtggcttagatggtgtggacgttgcctcgtcaccctcccgctctgcagccaccaaacattccctctaaccctagcgaactttcctagctagcccccttagaccataaaccctaactgatcgatccaccgctagttactgtagtgggagaatcgaggagccaccgctagaaatcccccctccgccttccaatacttacggaatgaattaggttagcaactatgaatcacaataagttagagcacgtacttatttttatttataataatgaagtagcgggttttcccgcgtaatttaaaattacgcgctaaattctaaaattaaaaacgatatttgacatataacaatgatttctatttctacaaatatgactagctagcgtttatatacaactataccgacaaaacatctaacattaacttgtatttctaacaaaacaagaaaaaacaccatgaaatttctatgtggcccgggcagtgaagcatgcagtgtgtgacgcgggactccggtgagataggcgaggaatctcctctcgtaagattcacctactcttctctcgtcaaattaacagcctatcgatgatcgattaacggaggctggcaactgggccaaataggcgaaacaaccaatgggcccgcgccacgtgcatccagcatcaatccaccacataataataataactaaataaaataaacaaataaattagtgatggatccgaactctaatactagtattagcaatacaagaaatagaaatagcaattggatcggaggcactataaatacatcctccgacccctcgccaatcccgcacacaacgcaaacgcaaactaatctcctcttctcctctcctccctttttctttcttgtgctaatattatatccatctcgcggcgacgcgacgatcatggagacccgggacgacgtcgccgacgcctcggcgcttccctactcctactcgccgctccccgccggggacgccgcctccgccgacctcgccgccgcccgccgttcccggaggcgcccgctctgcgtcgccctgttcctcgcctccgccgcggtgatcctcgccgtggcggtcctctccggcgtcaggctcgccgggcgccccgcgacgacgacgatggtcgtcccgggggtggtggagatggagatggcgagcagggggccggagtccggcgtgtcggagaagacgtcgggggcggaggagatggtgaggctgatgggcggcgcggcgggtggggaggcgttcccgtggagcaacgcgatgctgcaatggcagcgcaccggattccatttccagcccgagaggaactggatgaacgatcccaacggtacttaatttctttgcattttttttcttttattttccttcttcgatcgatcgattgattgttctcatctcaattcgttcattccttccgctctgttcgttcgttcttctagatctgacaacattcaaatgctattaaataaattcccattttggaggaacgttttatggttaagattcttccagccccattttcctttttttttatttatttttgagaaaagatttaaaaataaaaaaggaaaaccgagatacccttaagattccaaccgcaccaaccgaccaggcattgtagaattcgaattacaataatttttagatagataaaattcaaattacattatataatcaaattaacattggaaatgcaatgcaggtccggtgtactacaagggttggtaccacctgttctaccagtacaacccggatggggcggtgtggggcaacaagatcgcgtgggggcacgcggtgtcccgcgacctcgtccactggcgccacctccccctcgccatggttcccgaccagtggtacgacgtcaacggcgtctggaccggctccgccaccaccctccccgacggccgcctcgccatgctctacaccggctccaccaacgcctccgtccaggtccagtgcctcgccgtcccctccgaccccgacgaccccctcctcaccaactggaccaagtaccacgccaaccccgtcctctaccctccccgcaccatcggcgaccgcgacttccgcgaccccaccaccgcctggcgcgacccctccgacggcgactggcggatcgtcatcggctccaaggacgagcaccacgccggcatcgccgtcgtctaccgcaccgccgacttcgtcacctacgacctcctcccgggcctcctccaccgcgtcgaggccacggggatgtgggagtgcatcgacttctacccggtggccggcggcgagggggtggacatgacggaggcgatgtacgcgaggaacaagggggtggtgcacgtgatgaaggcgagcatggacgacgatcgccatgactactacgcgctggggaggtacgacccggcgaggaacgcgtggacgccgctggacgccgccgccgacgtcggcatcggcctccgctacgactggggcaagttctatgcctccaagaccttctacgatccggccaagcgccgccgcgtcctctggggttgggtcggcgagaccgactccgagcgcgccgacgtcgccaagggttgggcttccctccaggtacaccttcattacctctctaaactattttaagtttaactaagttcatggacaaacatatattaaattagtttcatcaaatcaataattaaatatatttttataatatatttgttttgggtgaaaattttactacttttttctataaacttagttaaatttaaagcaggaatttgactaaaattaaaaacaacttataactcgaaacggagggagggagtatatattaattaatccagctactactagtaattagctagcatgcatgattagctaggcatcattggcatgcatatgtgcacttttactgggctccattgacacgttggatcgacgaacaacacgtacatatgcatatgcctgccggagtgtagcgtagcaatcaaataatggcagccacttgtgaagagcgagagagatgacgcgaacaaacaaaaagcttgtcatgttggttgtcaaaatgtcgcttagcttcatccaggaatgaatgcggatatcctgttggggccccactgctcagctaccgaccggagcaactgttgagatacccttttttgcaataattgacataataaacagatcgtattattattggttgatggatggaattgcttgtgtccaagctatagtcctcctagcaactgttactactagtaggaatagctgtccttgcccataactcatgtgcaaccatgtgctgtagctgcattctgcttgtctttgctgatgctttgcctaactgaaatcatttgcacacacaacttaactgggattcatagattgcaaccttttcttttcaccagaaaaagggctgtcttttttgcttgcttttcaatataattccaccgctctcattttctttgctgtcacagtactgatagataatgcaaaatcgcttggttcatgtgaagcaagctatagtaataataattatgattaacatgtgtaattaaattactggagtagtagctaattagtaaaaataaaaaaattggcatgcagtcgattcctcggacggtggagctggacaccaagacggggagcaacctgctgcaatggccggtggaggaggtggagacgctgcgcaccaactccaccgacttcggcggcatcaccgtcgactacgcctccgtcttcccgctcaacctccaccgcgccacgcagctcgacatcctcgccgagttccagctcgacccgctcgccgtcgacgccgtcctcgaggccgacgtcggctacaactgcagcaccagcggcggcgcggccgccggggcgccctgggccccttcgggctgctggtgctcgccgacaagcgccaccgcggggatggggagcagaccgccgtgtacttctacgtggccaaggggagcgacggcggcgtcacgacgcacttctgccaggacgagtcgaggtcgtcgcacgccgacgacatcgtcaagagggtcgtcgg

SEQ ID NO: 55713 - DNA, 1176 bp, Oryza sativa
catagaaaattttaacatagtaaccaaaacaatggggagatgtggtgtgagattgggatatacttattttgtagcaaataacctaaatgcttatataacacatacaaaaaaaaagttttgaaaattcaacggagatacagatgtggagaaaaatatccaaaaaaaagtagcagaatagaggatcacatgcatgaaacaattggtacatgggaagacgggataaagtgaagcaaataatagaacaaaaagaaggatggcaaaaaaacaacattgtagataagtgcaaaaaagatcaataaaaaactgaggagctgctatgcgatatcctgtttttttcccccaaaaaacgcaggagaactgcgcttcatttcattaagaagagagaaatatttataaagaaagggtcaaggaacccctcccaccaagaacacttcccaaaaagcatcacacataagtgaggcccaaccaataaacccacttaagactaactaactgctgggataagtacctgcactgcttgagaaagatcttgctgaagacacctgtccactgggaaaagaaacaggaaaagaggaatattaccaagatgcaatggaaattagaactgtcatggggtcatttcttctggtaaaagagcactaaagagcagagaggcatatctcaggggccttacagaagatgtcaataatttttttatggtttgtcttagctcaatgttcaagtattactagttcatattctcttgtttcaagggtggttctctaattcaatatattcctacacagccatataagctaacaatagcatagcagaaaacaaaacataccatgacaatgaaccgttgagaccggtaatagtggttgggatacaattgttaggtgctcttctacaagcatatcttccatttagtcctcctagtgacacctgaaaagataaaatgacaaactagacaatcaggatatgacaatagggatctcagaatgcggattatttttcatgaacataaccttgaaggtctcaagctctttcccaggctgcttgcactgagggaatctggcgccaccaattcttttctcaacacctgcagaaaccaaaagcacgggtgacaatgaacaacagaaacttctctctgtaaaaataagctgccacgtgacaaaaatagctgctgtctgcact

SEQ ID NO: 55714 - DNA, 2816 bp, Oryza sativa
ttaattagattacagtccagaatacataattgatgaatgccccatattcttgtgaaactgataatatgtaggtgcaaaagaagaagcacctctggaggatccaggataactgatacaagatacaaaagttgtattctgattaaattgaagtgagagtgcaaagcaccacatcagtttgaacgatgatgacaatgcaggacttataagcagtgaccacagccgcagcagaattacatagattacaaacagaagatacaattaaacaagagaaataaataatgagcacagaaaattgtaatgtgaaagggcatctccagattggttgaacaaacaaacaaacaaacaaacagattgcatgcatatactccagtaaatcaattgagaaaaagagaaaaaggctactagtacagcacataccagcagcagcacctccctttgtgggaaaggatgcagaagcagcggagaagtagcgtacaagagcagaccgatcataatctagagcatcacgtagagtccgcagctgcagtacaaaagtgagagccgtagattggaatgtgagccatctgcagtaggaatattagattgggaatctgaagggaatctggtgatgttccgatcgacctggaatggcataagcacgacagatcggaacaagatgcgttcggtgttgggatgagagaatgctgcggagaattaaacaagagatggaggagaggggagagggagaggaaggaaccttgcgggagtggcggaggaggtgcgccgcagacatggctggctggcgaagggggcaatgggagtggcgcctgggtggctagggtttgggtctctcctcctcgatcgatcgtccccacgatcccctgcgggtcggcggcggagggcagcgggagagaagaggaaggtcgggtcgtcaggtcgcgacttgtcttgtcttctctcgtcgagggaggggaggggactacttgttgggccgaattagcagtcgtcatcatcatgtttttcgacttgacttgcctacctcctcacctcaccattttttttctaatttttaatttctttcatttaatattttaaaaattcgttttgtaaatttacagatctagacgcctcatgcactttgagaggacttttttttttatctggcagatgactgttggctccgtctaatagcagcctaaaaaagagggtgttcatgtcagacggagcccttttgccctttgaaaatatattattatttttactgaggaaaggctacccgcaaaatactggtataagggtggtctagatttttctatcttatcaagcagatttacaagtgtcctcctcctataaaaaaaacccccaaaatactggtataagggtggcctagatttttctatcttatcaagcagatttacaagcgtcctcctcctataaaaaaaaaccctctgggagggcgggaaaggagtaaccaacagttatatgccacatcattctctaacagaatgtttgatgtttttttaaagcccgtttacactcccaaatggcatgaggcatccagatctataaatttttgaaacaaaagattattttttaaatattttagtgaaaataaataaaaaaatgccctcaacttttggtgattcctaccaatctctctactctagtagcctactccctacatcctaaaaactcaacctagaatatattgcaactaagatgggattgacccatcctaatacatgaacctatatgaacctgggcatcatattctatcctaggttgcaatatattgggacggaggaagtatcttagaataaccaattaaaaaaacttaaaacaattatccagattctttgccctcaatttctgttatagattttctttggaatgaaggaaatagtgatctattcttcctctccggttttagagagagcctttggttaccaacacacagcacaaattaaactaccagatgaatcacatcaaaccaaaccaccacatgatattgacctctttcatcacgcatgctggaaacaaaacaaaaaggatgctacttactccagtattgattgatccatcggtcgactccaaagaataatattatcatcatcatggtataggaacattacagtaagtataacaacactctacgcagtcaaaagctttcttctttcttacactagaatatccagacacatcttgacctctccctctcttctatccttctccaaaattatgaagaaaaaaaatgataataatacaatgacaaaaaaggatgtggggcggatgaattcccaattctctgcgtcttcaatgaattataatatgggggcagggctggggctgggctggggtggattatctgtacaatggtgtccacatgctctctgcttctcacatgtaaaaaaggacatccgactctttatccccttctctaaacccataataaccaacaatacctacaaaatctcccaaaaaaacaactgtttgtacgagtacagggcgggcacaccttgctttacttccccatcccacaactttgtgcaagacaggagatatccatttcacttgtggcattcccttcatttactgtaaaacatttcctctctttttccctccctccctccctccctcctctagggggtttgctgagaggatcaaggtattttacccaggttgtttctataaaatcatgggtcatactgagcagtcgcagcatatcagagctcaacctcatgaagatcctctgtcaaactgttgaactgaacagatgagttgctgttggaacgactatgtgactgcttcccaggcatgaggggcgatggcatggtctg

SEQ ID NO: 55715 - DNA, 2009 bp, Oryza sativa
actgatagtacatcttagagatgtgtttcactatcgaatacttgaattaactaggtttgccattctatatttctattcatcttctttgccctactgttcttgtagttttgcttatgttcagcgagttgtgttacttcttccaagtagcctatgatatcattggtttatgtcggggtatttggattttggagtgtccactattcagtttaatactctaggctctacaatttttgcatcgcgtaaatggtttgctttgcgtttggtttagagcacagaaaacaacctttttctttacaagaatcgatgcaatgtcatcactgtttagagtttaagtgtgctgaaaaaggtggctcagttccaaattgctccgcgtggagcacatgaaactgttcttcagaccaacttgtctcagatttggtttccaataacattgttttccacctgttattgcagtagtataagagatattcctgatacatcattaacccacttcatcgtgtcaattattatcatcctgagcagatcattaccgtccatgctccttgcacggttgcaccatggtttatattgtttttgctctacagatccttgcattatatctgttcagataatttcgatcttattcattctccaaaatatgagataaaaaacggagtctgttattctcgagacttggttgagaatgtgtgcttagtctggactctggagataggttctctaatcaaaagagttattgtacatttcatcagagacgttgatacatatatcggataatgataattagaacagatgtttccagtgcttaaacatttttttagctgggttagtgcttaaacatttgatgttgtatttctatggatcacatcagaattttgagaacctacttgacatattcaggtacttggagttaagaaaagagaagtttctattggttctggctcaaaatcgagggaaaaggttgtgctggtgcaagatgcgactctccagggtgtctttgatgctctgaagaaggcttgtgcttctgcatgatgtatgttaaatgtgcatatgtgaaaactactcacttaactgaatagaaagagtgtcaacttaactagtgcccttttatctgtacaactctgtcctgcaatgaaccctgtaaacggttaattaatttgcctagcgagtttacaagatgaaaactttggtcatcgcatattttatcacgagatggtggtacagcaaagggcaaaattatgagagctggtttttagtttgatatgctaaaactctctctcatgatttacgctggtgactctgcgttgccactctcaggtacaatctgatcctgatatttcaatcggattgtacctttcgttttcaaagcatgtccagtttgggcgtttggagttggaccttttggatgtcgaatttgaaaacaaatgacagcatcatttcagaacgtatgtcttcttttttggatccggtaagaaatggactgatttgtatgattgtttgcatactaagggcccctttgaatcgcaggaatgagaaaacataggaataggaaaaacgcgggattttgataggaatgtaagtgtaaaacagaggattgcaaaacacaggaaaaacacaggaatggtcgtttgattggaccgcaggaaaaacacaggaattagaggagagataaagactcaaaggaaagtttccaagaggttttacctcatgttagaattcctccaaaacttgcatggcattaggcaatccataggattccataagatccattcctttgattcaaatggctatataggaaaaattcctataggaataaaattctctaaaattcctatgaattttctttgaatcaaagggggctaaacaggccagatttaatttcgtcgagtatggaattcgttgaggttatttcttaatcggcggcccccaactgaaagcctaccaaagaagctagtatagcaagttgggcactagctggaaacttttctccatgaaacacgcaggacctcgac

SEQ ID NO: 55716 - DNA, 7992 bp, Oryza sativa
cataggaattttagaggatttcaatcctatagaaaaatttcctatgaagccctctgaaataaaggattgaatcctatctaatcctttgaaattcctatggaatggacaatcctatagagattttggaggaaatttagcaagagcttcaacctcttgctaacttttcttcgagtctatctttctcatccaattcctgtgtttttcctatggttcaatcaaacaatcattcctgtgtttttcctgcgttttgcaatcctccattttatacttacattcctatcaaaatcctacgtttttcatattcctacgttttctcaatcctgcgattcaaagggggcctaaaggagatatgaagggcccctttgaattggaggattatcatacgaattttggaggatttaatttcctaaggaatttttcctatgaaaccctttgattcataggaaagtataggaaattttccttatgattgtattcctgtagctcaatttcataggaaaataagcaagaggttcaacctcttagaaactatcttttgctttgtttgtttcctatggtgctatcaaagggaccctcttcatatttcctgtgtttttcattcctgtaggattaggaaaacataccaatttaattcctacatttttcctattcccgtgtttttcctatcctgtgtttcaaaggggcctgaagactcataggaaagtttccatgaggtagaacctcatgctagattttctctaaaacttgcatgtgtttaggcattccataggaatttcacaggattttataggattcattcatttgattcaaagagctatatagaaaatttttttatagaaatagaatcctctaaaattcctatgaatttcatttgaatcaaagtgggcctaaatcagaaaaacttgatcgtggaggtgaagggtgatgtacaagtgggaaagagacaaaagaggattgcatgttttaattgacgacagcgatgggatatgcacgcccccttaatttcgaaaactggatcattagcaattaagtactcctcctcattagagtagggtcgtctcatctggacgcatatgcaacgctgaagcttttgtcagaaagctgtgtactactagtagtagtgtatagtacggtactacagtggtggatccaaattgtatgaaatcccgaggcatgcagatgagacgtggattgatccttgctgtgctgtgctgtgttccctttcctttcctactagccgcgcgtagcaatgcaggatgcagtagctgcacaatgcaggagtactacgctggggcttctgtgcagtgcagtggtactgcatcttcacgtttgattcggctgcttgcgttgggctcggcactactagagctatatttccttcgtcacattttaaacgtagagataagttttcgtgtttaaatttaattatttgttttatttaaaataaaaaaacatattttgtaaaaaataaaaaaaccataagtcgcacatatattattatttatttttattacctaataacaataaaatactactccctccgtattttaatgtatgacgccgttgattttttaactaacgtttgaccattcgtcttaatcaaattttttatgcaaatataaaaatatttatgtcatacttaaagaatatttgatgatagatcaagtcacaataaaataaatgataattacataattttttttgaataagatgaaaggtcaaacgtttatcaaaaagttaacggcatcatacattaaaatacggatagagtaattataaaaaacttgaaaataaagcgaacgatcaaatctggcgacggaaactcatggctacactgagtacctagcaatttttagcatagtgctactcccttgtctcatattataaaagattttggatggacaccttatctcaatcaatcacaccaatttttatttaatttattcacctattttcttttttctcaaacaaaaaagtattttttttcaattactttcatctacttttttaactacctgtgctcattaaaaaatgattatgctttaggatggaagagctaagattttagcgatcaaatgctacccatcgttggtaggagtaccatatgagaaaaacttagaggttttttgactggccccacaaggtggtggtgggttcaaagcctgcggcagatgcagcaaaatccccccttccgtttcccgttccaggcgatcgagtcgagctgccgaggcgcgccaagagggagggagagatagagagattaaaaaagaaaaaaaaaagagccggtggggccgggccgacagagctggacaaatgcagacggaatgggggaaggccggggcccactaggttttgccatgtcccaggaatcagtgggcccgttggtctgacgccgacgttaagttcgtccacacacccatcgaacccgaacaaaagcagttcatctcaaacttgaaactgaaagcagcaagcaagcaagaattcgttcgtgtgtgcgcatgcagatgcaggcacctccgcatcatgatgcattcatgtaacgctttctttctccaccccacacggccacgtcgctctctcctcgatctctataactcttttctatatctgcacctgcgcgtgtgccaatggaccgatatcaacttttccgttccattgccgtcgtagcagtattatattttgccttttgcaattgtgtgcaggtaggtaggcgtgattagcttcttttcttttgtttgtttggcacacattaaagctaaagaaaaccaagcttaaaagcgatcgactttgtttcttcttcacaagagaagagaatggattatgtgtgcctgctactgctctgcactgcatgccttgttgcttgtgacattttcggttaattttcgatcagcgccaattcaaaggcagagcgcgtagtagtgacatccgctcattccaaagtcagatttactgcgttccaaaaaagaaaaaaaaagggtcagatttactgagcttttgctttggagagaaggaaagcctcgagtttgttcatgttgtgccttgacaggattgcagttaatctgagaatccgtcggtcgtcttccttcctccgagtccgacgacgagagaagaagcaaattcgaggagagagcggagggaggctgtcctcctctttatttattgaaggaaagaggcagcagaagcactccctgcacgaccccactccctctccactccaccacctcctcctcctccactccccacctcgccgccgcaagcgcccggccgccaccaccaccgccgccgccctcttcgtctctctatcttcaatcttcgcctaccttgtctcctccattcttcaaccttggcttccttccatttcggcgccactattctttctttttcttttcttttactttcttttctgagtcgctgtgttggaagccagccttggaggcattcatgagcgcccgacgaccagctccatgatgaccggaggccgccgatggaatggcagatcccgtcgatatcgacaaggtactctccctctccctctccctccctccctgcacccgccgctgcctcatctcttcgcgccttttaccacctttctttctcccccatcttataccttgcgtgctgctaaatgccggcaactatcattgattgctgcaaccaaagctctagcctttccttcgctccgacaatctctgtcgttgtagccttcttgctggtgttgttgtagattcaccgcggattattgaggaacacgcacttttgacttttaattcaatgccaacaatcacaacgtgggttgcatgaatgtagccaatgctgcccctgctctctcaaatgttggcctgcctatttgcatttggagatccttccagggttatgcttactgcaatgcccaattttgggaggggaaaaaaatctgttcttttatttttttaaaaaaaaacataaatggaaggggaaattgggaacgaacaaaagaaaggtttgtcaagttccactccacatacttcgaaattttcgatgtgcaattgcaaaccgccgattgagctgtgctgaattcaattattagtcggatggaggattgttactttcactggagaatgctgtggcttatcgagtttgaggcttttttttttgtttaccgaaagagtttcaggccttgttccccctgctcgaattatcttgtgctatgcacagatatagaaaggaggagaagctggtgcattagattagtttctatatatcaagttgaattgatgcttatcgtttctagttgccattcctttcttttttatgggatcctattcttatggggtctctgatgttttgattttactcttattactccttttttttaaaaaaaaaatcgttactctctctggataatgaaaacgacagaatccctgccttcttgctaaaaagaatcatgaagttgaatttcagggtcttgtttacctacttggttcagtgcttaagataaataatgtgtgccatttgtgtgagagacatacaactagtgatgaactcagttttgtcttcttctttttttttgttaggagttagcactatctcacaaatctcatcatttaaagcatcactatctgggcaggttgtgtgattgtgtcgtagaaatcttgacgatcaggaaaaagattttgagtaatcttgattatatgtatatgactgcgatgtctgctttccttcagatagatcctactcttgttttggaatctggataactgggttcttggagctaaccaaaatatcaaaatcaaaattttaacaatgtcaaatgcaatggagaaaacaaagggacaggcagacacttccattagttacttttgttttgagggaatagacaagaagacacttggaattttcccattagcattgatgctatcgaagttttaattgtcaattacatttccaagaaaatgttctaaactctagtgatctgttattgaagttttttgctaatgttttaccaatgttctgcaccagttactctgcttcataattctgttcgtcctaatgcatctggcaggcacttattgctttaaagaaaggcacccaactgcttaaatatggtcgcaaggggaagccaaaatttactcccttcagactatcaaatgtaagtttactgtcttgtgcaaccttttttgataaaggtgatctcaaagtacggttttgaattccacagttccagcctgaaatgtggatgggatttctttttttttaaaaaaaatatctaggtccatattatgttgtttatggtgctacttacccaagagtacaaccattggagcagaaaccacttaaattattgacagctagaaaatttatgacatattaatatgaaactgagagcaatgcaacttccatttgtagttattatatgtacttacgcaactttctttttcatgctccacaggatgaatcaacactaatttgggtctcaaataacaaagagaaaagtttgaagctatcatctgtgtctagagttctctcgggacaaagaacagtaaggacttactttttaactatatggcaatttgtttcatgcatttgatcttcaacctgtttcttttcagttggtttttcaacgttttctgctccctgagaaggaccatttatccttctcactcatatataatgatggcaagcggtctcttgatctggtattacaacaaggatcaattgaactttatttcttctctttcatttctgaatgaatttcatctaatgagccctaatcttgtttcaaagatctgcaaggataaagttgaggcagaagtatggtttgcaggccttaatgtattgatatctcctggacagcatggatcccaacaccaacacattgatggaatacgcaacggtgccctgtcttttgaggtaaactctcttcaacacagaccactttgtgaatatatcattgtttgagtcatgatttcacatcatcattacagcttttttttttaagaaaaaagaaaaatctttgggcagaacgctatcagtatttctagcaacctcagttcaaagtttctgtctgtacactgtgttcaactcttgggtcattatccaccacctatgctctagtagctagtacaagttattgttgttgacgaaattcccacatgcattgctagtagtaatacgcattatccatcatgttctgagaactagcctagcatctaggaacatctcatagaagcagaaccacagttttgattattctatccaattgagcttcttgtttgattaccaactttttgtttggtgcacttttggcctaagctatagggttacatgcatatttatattattgttttacctagttcattcaacatgttcttttactttatcttgttcattcaacatattttttatacatcatattatcttgtactgctgcttgtatgttaaataaccaataatgcattcctgtggtttattaactgtcaagaacatgctccatatctattttcaaccgaatgatctttcaattgttaatcccatgtaaaatagatgaacctcacagttacatcatggcatgctatgcttctgatttgttttttgtttaaattgcttacagtgtggcagagatagtagcctaagcagtagctctgcttatacaacggattcctttgagaataagttgagctcagcgaattctgccaaggatcgttcttcaggagaatttacatattcagaaaggacagatgtgtcagatatgcaagtgaaaggtgcttcttcagacattcgaatcagtgtttccagtgctctcagcacatccagccatggttctggagatgattctgaatcttttggagatgtttatgtatggggggaagtcatgtgtgacactacttgtaggcaaggatctgacagtaatgcttactctgctactgcagctactgatattcttgtaccgaagcccttagagtcaaatgtaatgcttgatgtcagttatgtggcttgtggtgtgaagcacgcggcactggttactcgacaggcagaggtatttacatggggagaagaatgcagtggccgtcttggtcatggggccggcacaagcatttttcaaccacgtcttgttgagtcattgtctatctgcaatgtcgaaacaattgcctgtggtgaattccatacttgtgctatcactgcaactggtgacctttacacctggggagatggtacccacaacgctggactccttggtcatggaagtaacgtgagccactggattccaaaaagagtttcaggtcctttggagggccttcaggtgtcagctgtttcttgtggcacatggcatactgctttgataaccagttctggaaaattgtacacgtttggtgatggcacatttggagtcttaggtcatggaaatagagaaactatttcatacccgaaagaagtggagtcattgaagggtttgaggacaatttctgtttcatgtggggtgtggcatactgctgctgttgttgaggttatcatggcacagtcaaatacttcatctggaaagctatttacatggggtgatggagataaatatcgccttgggcatggtgacaggtcttcaaaactgaaaccaacctgtgtgccttcattaatagattacaatttccataaggctgtgtgtggtcatactctaacaattggattgactacttcaggccatatatttactgctgggagctctgtgtatggacagcttggcaatcccaataatgatggaaggtatccacgcctagttgaagagaagcttggtggtggtggtgttgtggaagttgcgtgtggagcttatcatgttgcggtattgacacagagcggtgaagtctacacatggggtaagggtgcaaatggaagattgggtcatggtgatattgcagatcgtaagacacctacatttgttgaggctttaagggataggtctgttaaacgcatcccttgtggatcaggcttcacaactgcaatttttctacataaatcggtgtc

SEQ ID NO: 55717 - DNA, 8996 bp, Oryza sativa
caaagggaaacagagttgcatccgctaatagctcagatatgatcaagaacttggatgtgaaggcagcaaagcagacaaagaagtatgactatccaccacagttccctgcgattttgcagctgaaggacatccctttcattggggctgctgaccagcaacctaatgactccacatatagttcacctttgttgaggctgccaaatctgaattcttctagttccttgtcctcagaaagctttgatattcttagagatgcaaatgaacttctgaagcaagaggttcaaaaactaaaagaagaggtattctatattctaattttttgtggtaataactaaaatatccggggaatgcgtccttatgcttatctattatgcaggttaacagcttgaggcagcaacgtgaacagcaagatgcagatttgcagaaatcagaggcaaaagctcatgaggccatgaccctggcctctgaagaagcatccaaatcgaaggctgcaaaggatgttattaaatcactaacagcacaggtgattttccgaatttattattgcacgtcttaatgttaaattggctctagctgcatattatctgccagtttcttcacttaccttatttttacttttatttttgcattgctcattcattgaaacaaaacgttggtaagcttaatttgtgacatggacagttaaaatggcactaatttcagttcttatcaacagcaaccttgtctcttatatgtgccttttgctccatgcacccacacgtgcttggaggtgcattcagcccctataaaatgattgcatattcagttgatatggatgtttctgctcatctcattgttgatcctagttgcaccttgctagtagtcatagatactaggggtgaataaaccaaggtaaacctgatttgttctttttctactgctactgcctagctgtgctttcttcagtggaacagtgacaactgtgcttgtagataattgcatatagataattatataaatcacatatagatagttgcatgttctggacttgttatatccccaactggataatatagaaattaaaaacactccccatttttgcagctaaaagaaatggctgaaaggcttcctccagcatcatgtgacacgaagcaaacacggcagccttatctacctggtggtgcagtttctcctgatacagggagagaaaaccaaaagagatatgagccaggcagcttccagtacccacaaacacctacttctgttgcatcggcccggtttaatgggttccttgctcaagcccatcaaataagtgaacccaatggtaacacgatggttccacatgacagcaggcatgaaaacaatggcaacactaaggagttcccagttgcgcagcagatgaccaatggtgggatgacggggtatcgcccaagaacagaagatcatgatcggcgggaaacagaaaggttccaaataaacctccatggtttcaacatgagaggttctagctcacccagcaaccaagtcgaagctgaatggatagaacaatacgaaccaggggtatacttaacactagtttctcttcgtgatggaaccaaggagctgaaaagagtgcggttcaggtaaccaagattcgctactcctaaagaacatattttattttgttttctctaagctctaacttgtgaaatgcgtgccctgaataagagtagcctgacatggaggtcgaattgtttacagccggagaagatttggagagcatcaggcggaatcatggtggaatgacaaccgtgaaaaagtgtacgacaaatacaacgtgcggggaactgatcggatttcttcagtgatgacagcgtagtgtgataataccagctagaagctaaattctcaaactgattcagatctcagaagagatctttttttccctcgcctaaatgtatttgatgatgctctcttcctgactatcttctcctgtactattgttgtatagaaggaatcagaattgatgatgtgtcgtatgaatagggtaatacagtgcagtgaggttgctctgttgaccatgatacgaggctgtgtatgtctgtatgtatattcgtgggagttagtggacgagtcttgagcaaaagctccttcatttacatgaatgaaacggaatgctcttggaagtggacgatgggtttcttgatctcaaatgtgtgctaccatacgtctgaaatgagtatgaggaactgaaagattatcatgaaatgctgcttttgtctgaactctgaagcgccgaaatgtcggttctagttggtactaatgcactgcccaaggattccgtttgtggacgtgaatatcacaaagaagggaggaattcaattaagcaatggcaccacaataaatgtgtagatgcatttggtgttaattgcaagtgaagtttggcgtcgtggaaatgtaatctgataaggttggaatttgccttttagcaagagaggtcggcgaaagggtgacgcggctccatctcagactgatgagagcagctatacaagtatgcatgcgatgcgatgtcaattttcatcatccaaaacagaaaggcctatatatatgctcccgtaaagtagattatggatcaggtaaggatgacgacgcaagctcgattccttaattggatagatcctgcagctatatactagtagtagaactagattgattcataaagattggttatctgcagtgctggacttcaccgaaaattcgattctattcgatggctggtgatggaaggaacgcacctgctagtagcttgtttcactagcagagaaaactgagcttgactattgctgtgcatcagtcagccaagcaggcagcctaatggcaaggctcctttctctgaaatgaaatgaaatgcttgctcagtcgtcgttctctgtccacaccggtgcagaatgtccactggccgccggccaccgcactgatcttgtttgctggcaacgacgacgacagccgatcgaggtttcgaggagatgcatagcacagcagcaagcaagtcgtcctctccccaagaaatgaacccaaaggtgcagtgcaggttccatcccaacattccagggcaagcctgcctattctgccagtccagtcccctgactgccagcccagcagccaaaatgaactgaaccgtcggcacggcacggaaacattgagcaacagtcaatcgattggcctttttcttccttgtcatccatcgccgttggcactccatcctcgtgaaacatcgcctcacacctggcccccagaccgatcgacctatacgcagccaagcacaaagatttcactccaatcagcacaaagctcgtactactcctgcctagtagtgcctctacccatggtgaggtagaggcagactggaaatttaaagggaggaagtcccatcgatcgattggaactgatctgacaattactccagaaatccacactacctacccgactcatgacacgcacttgcacagtactggctgatagtattattcacttggaggcttgcattgcagcggcaggtcacgtcgtctcaaaaggaaataaagattgtggccatatactatcccgtccctgctgaattctcaccaattaaagacagtttttcactcaccaaatcactccaagctgcctggcacacaacactcgccaccacgatggtactacaaatcaaacacataaaaataattgaaggtacctgcattgcatttcatgacctatcagttgtcagttctactgctactgcaaatactctttggcaaccaaaacagcacgagtaatatttctttttccgattgcgggcagcatcgattgtagtacgacacacttgccctcgctgagggccactttgattcaaagtaaatttatagaaattttaaaggattttattcatatatgaatttttttctgtatacccctttgaatcaaaggaatggatcatatgaaatcctatgaaattcctatggaatatctcttctcatgtaaattttggaggaaatttaacatgagttagaacctcatggaaagaatactttgagtctttatctctccataaattcctatgtttttcctgtggcccaatcaaacaagcattcctatattttttctgtgttttacgatcctctgttttacacttgcattcatgttaaaatcctatgtttatcatattcctctgtttttttattcctgtgattcaagggggcactgaatagtgaatccgtcgtgtaaccgaagaaaatagagttgaccttatagtaggtactgacttgctctcatcataacacaaaagctagtactacgagtagtagtagcagctgtttcagactttcagcaccgagacgggatgttcaacaatgctcagcaggggtacgtcggtgaatccggtcaagaagggtttgtcctactcctaccgaaaaggtccctctggagctaatgatttcatttcgacaggaacaattcggcaacgtttttcttcttctcaagattgatcatgacgaatgcttgaatgcttgtttatagtactaccgatatttcattcttgattccactgtgtaattttaaccggtgtaccgatacaaagcaagcgaatgctgtacacagttaatccgaatggtgtacctgcaagttgaaacgcatggcccaaaatgtgtgcaagctgatcgaacagcacaaccatcattacatggagtacatatcctgtttaggactagctgctcaccaatgaattccccacttttcaactgttcaacattctgttaggattccgcgtgcagtgcttacttcattcacgccatacttaattactctaattaattagtctactccttgcgataagctagcaccctttttatcctctccaggatcagattatccagattcttgcacacgcatgcttggtactactttctcattcttctgaatttttacctcacgttccagaccacacatctctctcgtcccatcaagctagccgccgtacgagtatggcgacttcaccctcaccttcgcctcctctctctgtagacttgcagcatatatatggcaccattgtcatcttgctcacgcatactctgcacttccccttccattccttcccaaaccagctcttgcaacctcatctgcatcagcctttcaaactgtgcagtcccaaactatcaaaaagatactatcatcaatcaatggctcagctgcgcagatgcatagccatcgcgctcctcttcctcctcgccgccacattcgtcgcaagctgcgtcgacggtgcaagaaccatgcaggcgagctacatcaacaggacgccttccacggcgccgacggcgatgatgaggtcggggaggctcttcggctacctgccgcgggccaagctgatcccgccgtccggcccgtcggagcggcacaacgccattggaccggagaatggtgatggggatgagctgatcagcaagccatgatggcagagactcaaggtaacctagccacttgtggagaacgtggtcatgatcagagtctgtcatatgatagtaagtaaatagctagcagcatgtatgtatgtatgtattggcctgtcagacatatggtttttgcatgtctctgtcattaacatttttcttttttggggttctaactatacattcctcggtccacaactctaacagttgaggtttcagttactattatgtcatctttactttgctttgcttctttggttaaaggaaaagggaaagtgcttatgcgtcatccttgttttgcctactatgtatatttatcattagctgaatgataatgtcagtcccagagaaagggcaaagggaagcaccagttctgatttctgaaggtctggtgcagcaaaaatttgcagaatgattgttcaggcattttgtcatgttacaaccttcattcatattgctgccttactgtttggacctttgatttgatttcatcatatacaccaagcaaattgccatcccaagcacagtaaggccgtatactaaacagtttattcaagaaattgtcaatgaaccaccagtatcaaatctatcctggctctttcattctttttagctacttcgttcatcagcttatttgctccacgtctctaaaagtatgttatcttggcgaaaaaaaaaatccttctactccattgcttaaaccattgttctaaacaatttattgactttattttctaaaatatctaatctaccccataaatgagtagataatcatgtcaataatccaatgaaggagcttgggagatatggaacgaaagaaatcgcagaaccttccaacaaaaggagcttttagctacctcccttttagccaagatcaaggaagagaccaaaactctgggccttagcaggagcgagaagtcttaatagctggctttctttcagttagctcggaccaaaggtcctagctcctttttttttttcctttcgctttgtaaagttctccttctatattcaatgaaattggcgcccgttgattcgttcaaaaaaaatccaatgaagaatccatttcaaacgagttattaaatactatctctatttttaatagaaaaatagatgacgctatgaacttttggacaccatttatttattcgttctatttaaaaaatttacgtaattgtcatttattttgttgtgagttgtttcatcgctaaaaattattttaatcatgatttatatcttaatacatttataaaaaaataaaataagagaaatagtcaaatatccaaaagtcaatggagttatttattaaaaaacggaagaagtaaaaacaatccgtgataggcgaggataacaaatttaaataagtgtacatgtgcgttactttgttttcgctagaaaaatatggacgtgcaaatggcggcaggcagggagcactgtagggtacatcagggctggcttttccttgcttgactagagaacagccagtactacaaggaaaacattaatactgtatactataggtgtactagggctacacaaatcaaacgagtggagataaagaggatgtgatgtatggttgtgaacttgtgaattgcgatggacggagaggagagatgcaggggggaggggtgaaaaagtgacgggtcacttgagaaatgacttgtggtaaggtagatgaagtatttatataatcacagcttgagcttgtagctgcagcagtgcagtgcccatcgtgcactgcactaccacagatcgagaagaagaggaaggaagccaagcccagcagcattcagatttcagaatttggatgggcgtacaggtgcagggcgacaattgatcgtgcttgcatgtctccaaacctcgtacgatttccctttgtttaaagctactactactgccctgcctgatcaaatggcccatgccttgccgccttcttcaattcacccgatcgtgtgctaagcctcagtgaccttaaaatttttcaagtaaaatgaaccgtacaatgatcaaattcaggtgaatatattttattgtcatgttgaagtacattagaaaagttagagcttcccctgaaagagaaaaaaagaagagcttacttgacgttgtagtcaaatcaggagaaacaccgaggggttttccagctaacttcacaagatggtgggctagacgatctggattctaagcctcaccccttttaattatttgatattaggtcattccctaatattcgtgttgttgtagtcaagtcataagttatgatttgggcgaatggatcatgcgagttttcgtccgatcgatttgtactgtaacaaccgaattagtacgacaaccaagcctgagatcctcggtcttaataaaccctgcaattcaggggctactatacaacggaatcctgttgggacagaatgataccggttaggtatcaggtcctgatacgatatttgcaaggtatcaggtgatacctataagatatcaggcgattcctaccatgtatcatgtgatacttgcgaagtatcaggtgaaacatgttaggtatcaggtgatttctcccgcgtatgaggtgatacttacgaagtatcaggtgaaacctgtcaggtaataggcgattcctaccacgtatcaggtgatacttgcaaagtatcagatgaaacatgtcaggtgtcaggcaattcctaccacgtatcacgtatcaggtgatacttgcgaagtatcaagtgaaacctgtcaggtatcaggcgattcctaccacgtatcaggagatacttgcgaagtatcaggtgaaatctgtcaggtatcaggcgattcctaccacatatcaggtgatacttgcgaagtatcaggtaatacctgtcaggtaaggcgattcctaccatatattaggtgacacttgcaaggtatcaggtgatattaaaagagcctctctctccctaatcctgccaaaatcagcctccgcaaaaaaagccccaacatatctcattaccaaggagttaactatgttccttctccactaactctgaaccctagaaaatcaaagacaatcccaactgctattggttatcactgatcggaatagcagccactgaataaatcgtaaacatgcacacaaaccctagaagaagaacctggagtgcactatgggaagaaaaaaatgaccacatgcgtcggcgccggcgctgtcgttgttgacgcaggattcgccgattccttcatccacgccagccttgtctttccttcccaagcctgccttagttttgtctgaaataaaaaaaaaatcccaaaaacaacagtgtcttaaataagatagatgcgaatcggtgcatagctggaaccaaaaatggtttcccgtcgagacggaataccggtaagtagcgtttccgattcggaaaggaaaataaacaactagtaacaaacaatgatgaactaccaaattgatgagagcagagcacgcgtatgtctagtctgtttggttgaaagttttgaaacataatggaagaactgcaagaaaagtagcaatagtaataccctaggctgttgccgctatcgctggcttaatctgcg

SEQ ID NO: 55718 - DNA, 3039 bp, Oryza sativa
ttatcagttatcacgtggtgtagaatacggattctctatatcatcctaatgttcttgttagatactccaatattcagttagcacaaatttaaattctctctgaatatcactgcacatttcttggaacgatctggaaaacgattgttgaacttgttgaagatatatacatgaatcacttgcagacaaacacagtggtaagcgaatgttagtcttggtcagattcgtaagcaaacaagtagcaaataccggtgaaatttctatggcgcaactagtcaaatggaagaaacaaaagttcttctcataggatgcttaattagctaatactagtaaccattgccatcacatcgatcgatgaagtatcaataggattacatctagccatgcatctaccgatctacgtgtatagtctcctcgttgctccaaaatttctatcattttcccgtttgtcttagcgtgtactcacgttcgggcggtttgacagagacagcgacctcacgcagcatttcgtctcattctcgatcgcaagtcaaattcacaggattaatcaaccaaaactagcaacttagcgaccattagttaagtgattagccgcagattaattgcaaatccagcactgtacacctcagaccgaggcctaccgtttaccaaagttttggcctttctcatgtcctcatcactagtctttaccctggatttctctttggaatgcatcatgtcctgttcatttgacgctattctttctctgaattttgctcctaacgtttcagctagccgcatacatggacgtaaattaaagtatcgcattcaattcagatgaaaatgaataacaacttaacaagagtctgattattcactaaaaacagtgtgctgaaggcctaaaacatcgccttaatcaagcgttacagatgacaagccgccatcatccgtatcgaataattataattatattccataaactgccccgtgataatgaaatgatctatagtttgggtcagatcagacagatctggagtcggtagaggagattataatctatcagttcagttcacctagagcaagaaaacaatgagcacactgtatcagaaaaaagaagaaacaacaaacaaatgcttagtcttttacttgccacatgcaaaccttccttaattccaagtccaactgtacttgtaaacaattggagggatgagctgcataattaacaagtgtggtcaaagatgccctgctggtcattagaggtcgcctaggcaaatttctcgtttatatctgcctagtaattcacctagacaaatcttacgtctccaacaagaggtgcaggccaaaacattgagaaatccactgtaaattaagcaaattaagtaatagaggagcagcggcctcctaggcgttggagacctcacgtcactggccatttttctctcgataatccaattgttttatctcacctcgtcaactcttttctgcttcatctcactcgcttcacctctagcatcgcgcgcgcacgaactgaaacaaacttatcttataatttggtgcaagctagtttttttttaatttaaaagggtatcatgcaatgctcgtggcctattatgtgcagtactataatcttgatattattcacgaatggagatcttcatctcatttactacaaaagcactatctgcttaggcaaatcacttggatcgaagataatgtttgattttttttcttgttttctgaagattttatttacaaaatcaaccaacaaaatattttcaagttactataaatatttttgacaatgatatgataactccaatatatgtctatggcaatacgatacttcgttatggcatggctagtcaacaacagtggcctggacaaaggatttattagtattgaaaatgaggcatgaggagtgttttttttttacaaaaacaagaaaaagattctgaaaataaaaaaaaatcagttagtgctattactccctccggtttcattttaattgacgctttggacaatgacacgttctacaagatatacatttgagcttattttttattataatatatacaataaataaatgcatgtttatttttattatagtgttttgaaagacaaatctatatatgtttttctagtttctttaaactaaatatttttaaagttattgatggttaaagttataaaagtttaacctcaatcttatccaaaacgataattagtatagaaccagagggagggagtaaagaaaaagtttggggcggtgacaagagagaatcaagttgtaagattaatcaactgaggcgtcaccttcatggaaggctagcaacaaccaaagagctagctagctaccttgaccgaccgaattctttaatattcgggcagctcatgctcgtgctctcgctcatgcgtgtggactttgaatccatccacctcatcctcctcccgcgtactccataaaactactcggattcgatctcttcctccagtactccccatctcccatccaccattgctgccatctccaccacatacaatacaacaactactactcagctcaccatcaccggagcaagagccaagaagacgacgacgacgacgagctagcagcagcattgcaaccgacggcaatggaggagcagcagcaggtggaggtggaggtggaggtgccgtcctacttcgtgtgccccatctcgctgcagatcatgcgcgacccggtgacgctccccaccggcatcacctacgaccgcgacggcatcgagcgatggctcctcaccgccggcacctgcccgctcaccaagcagcccgtgccgcccgactgcgaccccacgcccaaccacaccctgcgccgcctcatccagtcgtggtgcgccctccacgccgaccatggcgtcgacctcgtccccacccccaagccccccgccgaccgcgcccgcgtcgccgacctcgtctcccgcctccgcgccgccacgagctccgctgccctcctcgacgcgctgcgcgagctcagggacgttgccgtcgagagcgagcgtaacaggaagctcctcgccgccgtcc

SEQ ID NO: 55719 - DNA, 2877 bp, Oryza sativa
tttgtacatcggagattcattcatcgagagctagatcgagcgatcgatcgatcgatgaggataatccagccctgtccgtctgggccttgaactcgcggaacacactgcttgtcctcctccgtgaagcactcaagcatgcaggcatctgcatccatttggtccaccttcatgtagaggaacaatctcataaatgtaggccaaacgggaaacttaagcccatgaagggcccagtacttctaatctcgagggccatcttaggcttggcatcatttcggcacacagcatttgggcctagtggtactgtcccatgcagccaacatcgaagaaagtctactattcatctcaaatgatggtacacgttttatttgcgtctctcaaccataaaatcaggtacaaagcgtcccttaaattctaaaatcagtacaaatcaagttccttgacgctattaaggacggtttcaactgacgtgacgcctataggacggttctatagtttcgtgggccctaggcgaactcaatgatatgggccttttaggctacttgtgttttggagagaaattactaaatatttttctatatcttaggtggtgttcttttctcctgaagatgaagataaagattaagttttttttatgtaaaacgaggtgttattaacgtataattgattgagttttaattattacaaacttggaaaatagagtaatatgatattttagaacaactttcatatagaaagtttttgcacaaaacgcaccgtttagcagtttgaaaagcgtgctacgaaaatctttatctttatccaactcttgttggagaaatgaacgggaagtgtgatgtacataaaatagttgtttgcatcattccgatagatacgattttcgtgagatcatcgttgataggagagaggaaggaggaaaaagagaaagaaaatgaagcgtacgtaggggaattgaagaaaaaaaaaagagattcaatttggttctggatccgcccctgcgtttgagttaagcacacgtatattactgtatatatttcgtgttgcacgtgtattggcttattagtttggttttccttagttggttaatttgacttaggggtgcggcatgcatatgtttatgcagcattcatggattgatatattctgttggcttgagctaattacatgcagcaaattaatcgtgacatcttcatgttaatcgtacatattggtagatagcttctactggtcgatagtagtctggcagcccaacatgtattatgtatacgtatatgtatatacattatacatcgagtgatctatctagtatagccacaagtgcaagcatatttctcttttttggttgattagcttgctgccgctctgccgtattagttaagcatataaatatacggtcgaataaacggcctacggatggccccctccttaccttctagcctgagccctagtcggtcgcatcacctgtctaggtgcctaagtcagcgctacctatgcggcttgttgacttagtctttatcccatataacttttaggtggcacatattagaagtaataataataaaaataataataaaagatagatcataaaagggactcacgtatcacatggtgccagtagaaaaatactaaaataaaatatgttgggcccacatgtcagtgggtgtctgtaaaaaaaaacactacacattagcaagggcttctatgattacagccaggtcatactaattgtggtactagtgctagctgagtatgttgaatttcaatgaagaggacatggcccctaaggagtcactatggattctcgataagtcactatgggcgctcgatgagcgctagtgcgagcaccacaaggttgcatgagacatcagcaacaagaggttgtgcttcaatgtcatcaagcaaagcatgcgtcacagctacgagttccaacaacccttcctaagctaggcataatctcttcggcagaggttgacatcgcatcccacaacctcgcatctttgacggcgagaagcactaaggcgggtctgtcgatgtggtcatgtgcaacgacctcccggtaaagttgattggcatgtcaactctcttaggacgaacaagttggtgtcattgtcggtgtagtagctcgtgtactgtgacacaaggagccatgcaatggtgagtagagagcgtcaactctcttaggacgaacaagttggtgtcattgtcggtgcaacagttcgtggactgcaatacgaggagtgcaacgcaactaggagatcagtgcatttttctacatcgagaacaatggcggtttggcgttggatgactaccctacatagtaagcaggatttctactagaaggtcacgagccccgtcatcacaatcgacgtccatgtacgagtggttatatacaaggagatcaagttgaaggaggcgtggcatcccgacccgtcatagtggaagtcaatgttggaagtcaatgccaattggagtgctgatgcccaaggcccttcaagcactacttatgtgtccggcaaaaaatattggattatgagaaactcataacacaaacgatagagagatgacggttacatgttgatgaaactacaagtgcacgtgatcaattgcatgatcaggagcgaatccaacatgggtgtgctgggggcccatgccccctatcctggtggatttctatatccaaacatgcatgcgtcatcacgaaaaattagcgcgatgacggacgaaaacgcagacaaaaagatgtgacgatcggaaagttacgcatttttaaattagttaagatatagggtgtgctaaattgtatccatcgtcacatattaatcattatcccatgttatgtaaagctgggacaaagccttttataaataaataaatcatcat

SEQ ID NO: 55720 - DNA, 1204 bp, Oryza sativa
atctgcttgcatgagcagcatctgtttcctgttactttcacagcaaggagcttcatacgtactgtacgtacctgcagatatatagacagacaggtttcagtttcacctgggagaatagcctgcatggtcagcgtaatcctagtacaccgatccatctgattcggcaccccatgcatgtgttcttggagtgtagatgcaaattgctcaacagctagctacctagctagctgtattagcgtcttcctggaggcaaatctgcacactggattggaatatttgatcagtaacatgcatagaagcacatagggagagtattaacaatttagtaattgacatgagctagcagcaatatgctgtacaagtgcacaaatccagacaagtggagtacaattgtagcatagcagaatagataaatgggataactgaagcatgagcatgtgctagttcttttgactgtatatatgtatccatagtgcagtagtatggatacatgttgctttctctctttgacattttgcccggtagctgctcgacaacagattaacgctctccattcctcccttttctgcaacacaaagtcacaaagacatgcaagcgtgcctatctttgtcttttgcacaccgactgtatgagcgaacaattattcttttaactgtatatctttttctacctatctagtatttatctactactatgcatgatgatttctgcaccttcagaaaattcagactactcaaggattaacactttcatcttcagagaaattaaagaaatttgcagagaggctggtatgtttttcttttatgcattgcccagcagcagcaggaacatcatatattatacaattcccaggcagttttcagagaaaaggccggtgctgaagaacagaatcattgctccacatggtccttctccttccttggtagactgaatgctaatctgtcaagacaaggacacaaaaaacataagacacaggaaagcaaaaaactgcatgcatgctttgattgagtgatgaaaggaaggaaggaacatgcatggccatcactaccactaccagactaggactgctactatgtccatcactaaaagcctcaaaccccagccggtagtgaacaaagtgcaaacaagaacaaaaagtaaaccggaagcttcactgcaatgtggacttcagctccttgataagttggtatatactgtagctggt

SEQ ID NO: 55721 - DNA, 20064 bp, Oryza sativa
  unsure (1)..(20064): unsure at all n locations
agctacagtattggcgcaattagagcaaccataatagtaaagtaaggtactatctataaaacatgtacatctcaataatagactagattaatagtaaaccactttaatggtatgtctacatgagtatctatagctctctaatccattgcctcgtttttctctatagactatcttcagattagtagatagctttgctctttctcttcatttaatctctttcaagtagaaaaatacgctgacatagatcttttgtagagagcctataaataaccattgcgggtgcccttagcatgcacgatgcaatgtaattacaatcgtttaattaatctgtgggggaatcgaagaaacatggatgttgatgcgattaatatacttggtgctagctgttcccacgaaccgtaggtaattgcaccattccaagtataaacttggcgtttctttcttcgatgatgccatcaccactttcccaatatttgaccggctggcatgcacgcggtgtataattagaggagatttatactcctatctcacataagaggcaacaattaaatcaaggatttgatgccatggaattgaattgaatgagcataaaaaatatatatctgattcgatcgatattaggagtacaatatatatttactgttcctccgaaaagagaaagagagaaagatagtactactacagtgttgttgataaccgttggttggttggtccagacaagttaggaaggaaggggggaaatataatgtgggggagccaatcccggcgagtttccgggtgtcctctgttacacccgcaattccatcgatcaacaacaccacactgggggggtgtaaacctttgcattttattttcttttagtatttatttattgtcccaggctgccacgcgcattggcatgctacatcaagacttgcactgtaagttgcaattaatcacctggctggaaggaagaaaacaaaagatcatgatgtgaatattcacatgggagataagatagagaaaaacaaattcaaatgtaaagaaaacaagacaaaccaaaaaacacttcaattggcaagtttagttcaagtcctaaactttatacgagtgctcttattttttaattagtagacgacgcatccgtatttatgattaattattattttagtggtaggtgacgtaccattgaacaacgagatattcgtgatgacttcgttgatacgaagatataaatagagagtgtgtggacgcgttgtgagccccgtgtttgtactatgttactaataaaagcactaaaccctctttgattttgtaagcctttttttgtcattttttcttgaaagtacccctcttatattattgttgtttttaatacataatatatgatgtatttgatattttttaacaaatatttgaccatccgtcttattttttttcacatataaaaacataagtagtgtttaaagatcatttgactataaatcaaatcacaataaaataaaaatgagtattacataattacttttaataatgcgattggtgaaacgtatctaaaatatcaacatcgacatatataaaacacatggaatattgtagtagattttgttggttatttgaagtggtaatatgattccactattaaacttagatttaaaaacttagcaaagtttgataggcacgtcggtgctttaggagttggatctggagtggagttgtggtgttgtctatacccagtttcacctcctctagtacattttgtgagagagctttgtccagctccgcttctatgttagatggtgttgaaattgtttaactgagcccgagctcaagaagagatggagttgagctgaagttgtaccaaatataccctcgtaaaagcaccaacgtataaaagccaaaagataagcctaagctaaaacaaggagcaatctaatcttatcactgctaagattttttcttaaaaatggaaatcattaattaactaaaaatatattttttataaaactgaacaagtaaaacaaaaagaaaaagcaaaaagtaaaaagaagagcgacccagcaaccagcattcattcctccgccacaacaccacgctgaccacagtccaccgtccgtccgtcacccgctccccctgctgcgccggaaacaatgaaatcgccttcttttgtcccaaactcttcttctcctctcttccccccaaacacaactgaacccaacccaacaaaccaccaccacgctgaccgccctcaccggcgagccagcgagcgacggaaggaggccgcatgcttccacaactacaacctcctcctcctcctcctcccgtctccaatgccctccgcctccactagatggccgccctcttcctcctcctcctcctccacgtatcagacgccgccatcaacccgggcgacctgtccgtgctccacgacctgcgccgctcgctgaccaacgccgacgccgtcctcggctggggcgaccccaacgccgccgacccgtgcgccgcatggccgcacatctcctgcgaccgcgccggccgcgtcaacaacatcgacctcaagaacgccggcctcgccgggacgctcccctccaccttcgccgcgctcgacgcgctccaggacctcagcctccagaacaacaacctctccggcgacctcccgtccttccgcggcatggcctccctccgccacgccttcctcaacaacaactccttccgctccatccccgccgacttcttcagcggcctcacctccctcctcgtcatctccctcgaccagaacccgctcaacgtctcctccggggggtggacgatccccgccgacgtcgccgccgcgcagcagctgcagagcctcagcctcaacggatgcaacctcaccggcgccatcccggacttcctcggcgccatgaacagcctccaggagctcaagctcgcctacaacgccctctccggacccatcccctccaccttcaacgcctccgggttgcagacgctctggctcaacaaccagcacggcgtccccaagctctccggcacgctcgacctcatcgccaccatgcccaacctcgaacaggcatggctccacggcaacgacttctccggccccatcccggactccatcgccgactgcaagcgcctctccgacctctgcctcaacagcaaccagctcgtcggcctcgtcccaccggcgctcgagtccatggccggcctcaagtccgttcagctcgacaacaacaatctcttgggccccgtcccggcgatcaaggcgcccaagtacacctactcacagaacgggttctgcgccgacaagccgggggtcgcctgctcgcctcaggtgatggcattgcttcacttcctcgccgaggtcgattaccccaagaggctggtagctagttggtccgggaacaattcctgcgtggattggctgggaattagctgcgttgcagggaatgtgacgatgctcaatttgccggagtatggactcaatggcacaatcagcgacagtcttgggaatctgagtgaactctcggacatcaacctcatcggaaataaccttactgggcatgtgccggatagcctcacaagcctcaggttgctgcagaagctggacctgtccgggaacgacctgaccgggccgctgcccaccttcagcccgagtgtgaaggtgaatgtgaccggcaatctcaacttcaatgggacggcaccaggatcagcgccatccaaggatactcctgggtcttcgtcgtccagggcgccaaccttgcctggccagggcgtccttccggaaaataagaagaaaagatcagctgttgtgttggccaccaccatcccggttgcagtcagtgtggtggctctggcttcagtgtgtgccgtgctcatcttccgtaagaaaaggggatcagttccaccaaatgcagcttccgtcgtcgtccacccccgcgagaattctgacccagacaacttggtcaagattgtcatggtgaacaatgatggcaacagtagttcgacccaaggcaatacacttagcgggagcagcagccgcgctagtgatgttcacatgatcgatacgggcaatttcgtgattgctgtgcaggtcctccgtggcgcaaccaagaactttacccaggacaatgtgcttggccgtgggggctttggtgtcgtctacaagggtgagctgcatgacggcacgatgattgctgtgaagaggatggaggctgcagtgatcagcaacaaggccttggatgagttccaagccgagattaccattctaaccaaggtacggcaccgcaacctggtctcgatactgggttactcaattgaagggaatgagaggctgctggtctatgagtacatgtccaacggggctttgagcaagcatctgttccagtggaagcagtttgaattagaacccctctcatggaagaagaggctcaatattgcactggatgttgctcgtgggatggaatatctgcacaacctggcacatcagtgctacatccatagggatctcaagtcagcaaacattctcctcggcgacgatttccgagcaaaggtatcagactttgggctagttaaacatgcaccagatggaaacttctctgtggcaaccagactcgctggaacttttgggtacttggctcctgaatatgctggtaagaatcgctttctctggaagtatatggttgttgtgttaatttggatgcttaaattgtactagttctctttgttatgtgttacagcaattatcgttaacagatgacacatgaattagatttgaatctagttatattgtctacctgtcccagtgactaagggtcattccactgttgtagcccatgaaaatgcctttgaggagttaaggatgtgctagatacaactgaattcctgatgaactaatcattcttaaaaaaaacttgtcactactagcttgcaatacactacatctcgaaccacttgacgagatggtatcattgtttctcttccatggaactgtgagaacaaatgtgtgatatcatttgatggaggttgcattagtatttgtcctttccctgtttgttatgctgccttgctattatgactcctgaatttatggttgataagttgctttaatgaccattgcagtgactgggaaaatcacgacaaaagcagatgtcttcagctttggggtagtgctgatggagctgataactggaatgactgccattgatgagagccgtctggaggaggaaacccgttatctggcctcatggttctgtcagataaggaaggatgaagataggctcagagcagccattgatcctactctggatcaatctgatgagacttttgagagcatctccgtgatcgcagagcttgctggccactgcacatcccgggaacccacccagcgaccggacatgggccacgccgtgaacgtgctcgtcccgatggtagagaaatggaagcctgtgaacgacgagaccgaggactacatgggcattgatctgcaccagccgttgctccagatggtgaagggctggcaggacgcagaggccagcatgacagatggaagcatcctgagccttgaggacagcaagggcagcatcccagctcggcctgccgggtttgcagaatcgttcacctcggctgatggccggtgaagcatcatatatctacaatacaaataagtacatgtctcctctggacctctcctgtttccctatagtgttcttgtaggtaaaagagtgcattgtccatgtgcttatgcttctgtagatagacatccatttttctttcttttcttttttggtaggattgctttcctattattccaatcttgagactgaagtttctgcctttttctagtcatcggggtcatataatgcttctttagtttactgtacttgaaaatttttgcaatggcatctggtggcatcaatgatccatatcatgagtcttgtactgtttagggagcaattagtaccaatccaggcttgcatttggcacttttctgaaactctacacaggttgcatcatgccttgataattatcaatgttctatatgatctaagcagatgctagattatctaacaattactagagcacaggtaaaatggtgagcttgcagagataggccaaagtgtgagcttcctcctgaattttgtttgcagttgcagcatgctagtactattcattttcttagtggttgtgctccactgatttggtgatctggtaacgccaatagagtctgtacaaatgtagaattggtgtaaaactagtgatggttagtgtggttagttgtgacacctaaaccctgtgttctctagatttttggcttgacaatgactgcaaagactccatcgagataatgggtgtcattctttcttgaggactcaccgttgatatcaatcgatttgttgtttaatgatgtgtcgctatggccagctagcatgcattaactttgtggccgacggagtagatgtgtcggtgtttgagtgaggttactacatctgtatacatacatgatacatggcttcttgcttcattgcttgattgtatctactgtacgggcatatcattgcaaaattttcgtcgcagtatggggactacttactactatgcacaagtatatgctgtacacccatgtgtaattgttcagtacatcgtgagaaataaatagtacttatgtgggataatcttctgaagaattttttgaagaggaacttgttgctctatgtgatttggtatcggacagtccgtaatctgtgaccaagagctctcacgctcttgtcgtgagccggtgaatggccaccacggcctcatcacgggggtaaggtaggcagcacatctgcatcacgtagagaaggcctaggagcaaaatactcaaacgccaccggtacgattggcattacacgattgcttatccctttatcagcagctgcctgagctaaacttagtttctggtccaaaccaaagcaggtgtcaagtcactgctagctagtgcatacatacagacatgtaaagaagcgtctgtgtatgtagacgacactgcagaggaatagataacatgccatttccccaactcggtgttaataaaagaagcggtaaggacaagatcacaagagggggcaggcagatgagatggaataacacaagtgtgagcttgggcacgaggctttgcatgtgaagagcagcatgaacgccatgtggtggcacagggagttctcgcctgtgtcttctctactcctctttggggcagcagcggcagtggcacggcaattattgaagagcacagccccaccagctaggctgcttaactccctctctgcccggccattgccattggcattgccttccacatggaagatttgccacttgttccagacaagaatggcctcttgttccagccaagagaaaatggcgcccatttgcattttgcatcgccgttcaatctaggccggtcagatgaggtcgttgtgggggtgtgtgtgatgcatgggtccctgataatactccatctctggtcccagattgttcagttactccactcctactatgttagtactagtatccatgattaagcattgaagatacccaaataatccatcttcagggtgtaaatacaagtagtacaatactctacttttgtgttcagttcagttattctgtctaaacaccacagcagttaaatggttcacgaaagaaaaggggtggaagttagtaaggtactagtacactactactagcaggcatcaagcctgcgcaagttcatgagggaaaagaagcagacacacatgaaataaagcagttcatgagggactagtaaattcagtcgacttgctttcctcaccaatgctcgaggtcaacctttattggcatttaagaatccccacacttcatgctgctactggtactccaaatcttgtacaatcagagccacatctggaggtggaggagcaagcaatacatcttcctaaccacatttccttttctctataggggacaatatcatgacacagtacaaagcataaagggcagtttgtcctcgcacaacaaaagccacagcaaccttcatgccttgatatttgttgtcaaagaaactctctggtccttttctaagaattccatactgagaggatgttggaggtagaaatacggtacggagtaaagtaacaagataattattgtatcagtttgcacacttcgatccaatgttgggataataattgtcaggataatgccaagtattcaaagatactagcatccgttaattcatactaataaattattgtggatctatggcaacatgagagcgctctatataaagaacttcaggaaattcgttgcagctatgatgaagttgtagttgctggatctgactgtagatatggggcaaagtgtttcagggctgcctcatatactggttttttgaattcaactgcctgctcaatatgaaattatatcagatactacagaagcagggaatcagaaaaacattgagctggtaaacagacccaccttttcaataacttgctgaggtgtcatccatgtccattcacaaaactccggcctctcagatccgtcaccattaaggttaacctcatcttccttcccagtaaatctaaatagaaacctgtttatttgcacccatatgttcacaagttacttgtggatcacaaagacaagtgggtattatcctttttctattggcatttcaatggtgcacattgcattaacataatcaaaccatgtcttagaaagttgtgatcttgtgatttagtcaagtctatcctaggcctaaataacaagtatgagcccaggcccaacccctggcctaagtgaatgagtgtgaaagatgtaaagtgatggcataaatgggccacaatccttcataaatggttcacaagtcactttggaatcatgaagtgttgaagacatgtgagtaatagtttatagcttacagacacactattagtatttgaatgctgcgcatgggcattacacaaacatacttacctgacaaatttggtgggcttttcacttattaatgtctaggataggacaaaatgatatgtctgggcccaggcctatccttggcgtaaaagtaagagtgtgagatatgtgaagttgataccatacaaactaccagccaccaatttatatcagtaatttgagcttttaggacaggtatctactggaggctaccaaaattatcagattttatccagagatcacacagaaaacacttatataagagttacagccaatctatctgagggatcacgaaccataacaaacactgaactgaaggaccttttccacacttccactaagtatgggactatctagctgtctgagactgtatggtatgctacatatcatggacaaaaataaaaaagaagcttcctaccaaaggatgcaacacagaaacattggctcagcacaagtatgatcctttggagcgagtgtaaacggggtagatagatttggctgtccatctctcacagtttagtggctcttctgatttctgtacccagcccctctccaagaagctttctatttgaatttttgcccctgatagattgaagcttcctatttgaagctgtaagcactctagatagattgaaactttccaatgcgctacagctggagaactggacaatcacatgtgtgtgcacactgtgcaatacaagcgtgtcaagtgtaacatatactgatacacacacatatgggcgcagccaggaaaatatgattcattggcagctcaaggttcaatctatataaacattctaagagcactaggtttaaggtgctggcataggcttccgacaggtatagtatcatttctaggaaagtgaggtgtaacatgtatgctgcagctgtggcatagatgattttccacattttacatatactatttatagtagttatggtgcttataacttaatcaatatcatatttagcacgaaaatcgctaaaccggtacacttcgtggacaagacagtgtttctctagcacagagacttagaacaagagcaatctggcactctttagtcataactgtgagtttctgcctggcaattaccatactatcttaaccatatggctgtttatcagataattcttgtcagactattcttgcaggtctaaacagataccacacaaatgttggttactagcatcattgttggcccaaggaaatgagaaggctaaccatttctgagcctgtcctttccagttcgttcctccccacctagcattcagcttttctttcacatcaacagggaaatcatacgttaaccaaacggggacctacatgaacatatacatgcaactcagtcagcaaaactagttacgagactgattatgacaaacaagtatcataaacacgcagtattaggagagacgctgcaggtttgcaagcaattagcagccgtttgcgtgaaacagaagaagtttgggagtgggcgaaaggccaatagctgacctcagccaccatttctgcagatgtaacacccgtttcctccctcaattctctgaaagcagcttccctcggatcctctcccgcatcaataccaccctgtggcgaacatcgcacttgcggattaacactcaacaacctctcgagacaaaacataggagcagttgttcatcacctcacctgaggcatctgccatgtgttggcgatgtcgatcctggacgcggtgaaaatctggggacagaggagagagcacacggaaaaaattggtcagttgaagcaccgacgaagaggaggggttaggtcgcgggagtggagtcgggagcgccgcttgccttggtgagggaggggtcggcgaggcagatgccgacgttggtgcggtagttctccggcggcgtctccatggaggctacgacggcgagcggcgacgcggagcaggaggaggagagcgggcgggtgaggcggagcgcggaggaggggaggagacggcggcgagtagcggtggtgcggaatcggatagggctcacgaggattggggggaggcgtgcgacggacaccaccaccatcactccgccccgcggctatggatcgccggggaagaatctctctctccccgatttgccctgcagcttcgctgacaggtgggcccgtcaagagttgggccaggcccacactattttgccacgcgtttcggcctgcaggcctaacagggagacccgggccaatataccgtcgcctgagactttgtttttttctttttctttttgcgaaactttttttaaagggaactttttgcgaaactttgtttcttttacttcatccaatcaataatattttttgtttatgataatatttaatcaaattttcgtcatcaacaatttcttagtttaaaactaaaaatgatatatacatagacttatctcgaaagtgctatagtaatatcgtaaacttattagattttataaatgttaaaagtttgaatacatatttttttgtcctacatggcaaatactcttttaatcagaggaatatttgcctaattgctcgtgcgtgtgattcgtttctctccaagataggggatgatgcaagcatggagcaactaaggtttgagtcttaggcttacctcaaaaatcatgtataaattatcttaaatgataaatcaccatgtacttataatgaaaaataataattcattagttgagtcttaagctagccctggtatttagtctttggtaattttttggctctgtcattgtttaaaaaagaaaataaaatacactgattttttttaactggacccaaaccccgccgctaagcaagtacggagcactcaactgtgttgtgctcccgttttgcttggtactacctgtcaacttgccgctccaacctccaagaagtttccactgttgtgcttgtagcgaagctttaagcacggtcaaacggggcagccaaccaggtggtttaggttaggctccgttcaaacaatttgagaaatttcgtcgaagtattcggcgaaacttgtactgatctaattcggatactggactaaaattgtttcacacaaggaaagggaagggcaggtcggttcattccagaaaagacaagcaaaggggcttaaacagacaaatattgttgggccacactatcatacagtacgttgataggagtgacggcccattgttttatatcctggaggaaaagaaaggaaaaaggtagcccagcccagtcaaagggccccccataacttgctgcgacggccatatgaatccgtccgttatgatatcctttctcctgcgcgtactctctgcttggtttgtattgtctgttggagtccataaacgttttatcacatgtgcatctattttgccatgttttaacccgtttttaaggagtagcacggtaataaataaaatgaaatgaatgcctatttattctaattaaatctttggtagtacggtgtttaacttgcgtactgtacaattgtacatgtattgtcaggatctgctttattaatgttgctggaatttatagtaggatttgaccatagtaaattaatttggaggaattgttttccgattttagatatatatatagacacattgttccactggtctgtatagatagagaaaattaactaggatagggacggataaaaacagccggaatttaaaagtagagtatttacacgcttttttaaccttgtgcgggcatacataagcagaaataaaaaaaaagaatacatctaagctgctattgctacggaggaaggcggaaacggtccgtgtatatagccgccgccttcaacgcgtttatcacgccgaatccatggcggcttcacgtggaccgcggccatcatcatcaggctgcagctgcagggacccgacccgaaccgaaccgagccgagccgagcaggccagccaaacaacgagaacgcgaggcggtcttccgtttcaccgttggcgcacaggtgtcaccgccttggccgaccacgcctcgcgcgtacggaacggaaaccggcaggaaaaatctggtactcgcaaccgtggcggccacgccggcgattgcacccgcgggcaagtaagcgcgcgcctgacgtggcacgccgatcagccagtcaccgcgtgggaccacctcgcccctcactgccgcgtggggcctcaagtaccttggcctgccttggttcccaaggaaagcgaccacttcaggtccgcccgcaccgtcctccccaaattatcatccccacccctcaaccccaaaccgccttatctcccctctataaaacctccccctccgtcccccactccccagatttctttcacagattcacgaattccacccgtttcgattcgattcgattcgattcgatgcttgtgccctccgccccgggagagactcgccggaattcgattgcttcttgctggtagggggagccatgggagagctggcttcctcgccgccgcccgcggcggtgctgcccgtcgtcttcgtcgacggcgaccagaccgtcgacctcggcaccgtcaccgtccagccctccctcggcgtccgcaagctgcaggccgtcgtcgccgacagggtggggctcgcgccgcagcagatcctggcctcgctcgcgcgcccccgccgcgcgcgccgcgtgcccctcgaggaggggaccgacctcgccgccgccgtcgcgcgcgagggctccggctgctacgtcctcgccgccctccgccgctcccgccgcgagcgccgcggcggccgctcccgccgcgagaagaaggcggcggccgcggccgcggcggcgggggccgcgcccgctgcgccgacgcaggagaggactatcctcaagcgcctccccgcgatggatctggcctccctggcctcgaccccctcgccggcggcggcggccatgttcggcgtctgggactacgaggcgcagctccaggagctgcagcggcagcgcgagtggtacctcatgcacacggcggcggcggatccgtacttcccgctggcgccggagcgcgaggacccgcccttctggtcagcgcagccgctgctgcggcaggggacgccctcgtcgtgccccgagtgcgaggcggcggcggcgatgatgcgggagccggggttccactggtgcgtgcgcgacgcggtcaccgtcggattccgctcactggtggggccaatcgagcgcccggcgaagaaatccccctcgccgtcgccctcgccgcctcccctgccgccgacccccggccgactcccgccgtcgttcgtcgggatgatgcccgtttactagccgtcgattcgattagaagaaaaaagaaatgtaaaaaaaaaagaggagaaaaaactggaattggggaggcttgcgtgtggaattggtgcaccagcgcagaagaggagttttttttttttttttttttgttatggaggaggaagcggccaagtgcgaacgagtccagaggcgctggacacgttggagcctgcaactagcttagctgttacgaagaaattttcttttttttttcttggggtggttactgcttgctgctagtgctatgtgacaggtggtatgaggtggtacgagcctgaccaatgtggctcggtcgaatccagagatttggaccaacatctctggaaccctctgttttttcttttttagtttttctgagagagcgggagagagagagagagatgcctgctggatgattggcatttgttcctggtatatcaaagtggtatatgcagaacaacattttagtacctacttgagtatgtgctgaattttgtctccagatcagtttttcttccttttctgaattctgatgtgtgtggtggaaaccgtgaaagagctgtatcgaaacgaagaagggtgagagaaaaacgacgagttcaatcggttcccgcaacgaaaccaaccaacaaaccattcgagatttttgggtggtttttgggctggatgcgtgaatggaaaaaaggtggcgaaaattcatccacaagattggccgttccaagtcgtgttttctcgacgccggatattccatagtcctctcgcacgtacgcacgtacgctcgacgacgacgtgaagcgctgtcagctagtacgtatcatccaccacgtcatggatggagccctcaattccatggaaaaatattgctgctgctcctcctcctacatggaactcaattccatggaaaaatattgctgctcctcctcctcctacatggaacggatggataatcatccatctcgtccagccatggaagcagacgattggaggccaggggtacaggacagaggtacgcgtaacgctaaaacgtgcgattttaattgtggcgtgtgcgttaatactaatccattatttaaatgccaattaacactgtagccgccaatgtctcccccaaatttagggctggtttgatttgaggcttaaattaagcttaccaatattttgcaatttcaatagtatttagtgtctatttggtttgaaaccaaattttggcatgcctaagaaaaagactattttaatagtgaacttaggctattttggcttcaatccaaacacaactttaccttaccaaaattagtcataccaaaaattgtcaaaatctggaactgctaaaatttgaaatttggtaagacctatataggccacaaaccaaaccaacccttattgtcaacccgtctcttctctctcgcaaccaaccgaacaagccaatggcagctaccatagcatagcataggcaattaggcatatactagcacggtcatggtccaaaacaatgggcagctgctacttgtttcaggggaggggaacgtatcacgtaggagtatgcatgatcgatgagtgcctgaccgggtcttcgtggccattagcgacctaatcacacaattattagcgaaatcatgtgccatctgtcacgacctgctcctccaaccgtttcaaatatatggctctaatcgaatactactacatttgtcgagatcacggtacgtagagcggatgatgtgattctcctcccttcaggtgacaagtcaaactcgattcctggatttttcaacaacagtggatcaattgattaattaaacttcgtcgagttgttttttttttaacgctgcgataacgtcaatgataaacaaattcaacactgcagtacttttctcaaattccccacgctgttgttttggatcataccaaagacccggttattgctagcaggtcgattgatgttttttccagtatacaaaacagaagctgtcaaaaaccagtcaacctcgccaacaacgacctctagagctggaagcgtcgtacttatatttattatattatgttctgtaattttatatttcttgtttacacgtacttttgtggactgccaaaatctgctaggaatgtaccaatgcctgtctaaaaacgtttccagccatggttttttcaaacatacagagattgctggtatatctaaacaaacatttacaggagcaaaaatttatatacgtaggagaaaacaagagttgatggaagacagaaggtaaagggagttaatttcgtgtttttgattggaaaaaatcactcttattttcctttattacttcagggatgacgcatgaataaaatgtgtaattatatattgttataaatacatgcaacaaaaagaatgcaatttctctaattgggtagttgtgcttagagcaagtttaatactacagcccactaatagctccaattcaaatatagccaatctaatagtcaatttatacaatagttgtttgctatactattagtatatagtcccaactgtcatgctcttctctctcatcttttatctcattaaaatatgtttatagctggttaatagtttgctattatacctgctattataggaccaaactatcaaacgtggattgttgatagacaaaataatggatgcactcaagttgaggagttacctttctctttcttctcttcacccatatttgttcctccactttccttgaaaaaacaagatatttccctctacagaaatacccaatcacatcactctcacgcacacgcacacgcaccaattggtctctctttatgtatgtctcccattcacgtaggcgtgttatccaaacgataaagtttctaaaataaagggttatttgttatcaaatattttaaatactcaaaatacatagtatttaatttacatgattttttttctaaccttagactgctaaaatcctacgttttaagtaaatatcgagggttgtttttgaaagcagaaacttactgtactttattagcagaaaacttattgttttttgaaagcagaaaacattactaacattgtgtttcataggtcctctgctataaagaagaatgaaaagttggtaagttgaagaagagcaatggacattagggtttttctgatcgttcttgaaacttttttagttttaaatgtaaaggctcgtaaaacttatttctaatttgattcttttagccatgccactacacgcggtagactaatattattgtttcgccaagcagctagatcggcgtggctaaaagattcggaaataagtttttttaggtttatttttaaaattagaaattgtaaaaagcttcaatatttttatattataagaaaaaaaagaaaaaaaatcacattaggggagaggaaatcaaattgatccatgtgctactacctgcaaaggtaccagtaccagnntataggnacccacccagcagcaagcaagcggtccatggctggactggactggacaatcccgcgtctggcggcccacgcgacagacacttgcacttgctctccgctgccgttccccttcccccctcttcactttccttcccagctgcgctaagcaatccccacccaccaccgctgcagctgcagttgcttcctctcctcccctctcttctcgccgtcggtggggtcctcctccaccctgtctctctcctcccccccagatccacccctcccccttcccgaaccttctggaaccatctggaggaggaagcaaccgcccaagctgtagcggcagcggcggccggcgggggaggagcgatggaaacccttgcgcagcgcgcggagttgctccgggagtcgctgcagaaggagccagtccgtgaccgacgccgtcgtctccatcctcggatccttcgacagccgcctctccgcgcttgacgccgccatgcgccccatccaggtacacctgctctctgctctgctcgctcctcgcccccccccctcctccctcctagggttcttcgccgtttgattccttctaggctgctgttctgatgccgctgcctctcctctgctgctgtgtgcatatgtgtgtgcaggtgaggacgcacgccgtgcggacggcccacgagaacatcgaccggacgctgcgctccgccgatgtcatcctcacgcagttcgatcgaactcgagaggtgctccatcgcttcaaccccagatttccctacttcttactagtactacatatgctattaacaatatgtgtgccccgcccgcttgtggttggttggaacttggaattgtaactgcttgttccgtggctgatgaatgcggggaacgggtagttggtgtgactgtgatcagtccattttctgatctgcatctcctggcactgggcgtatgcttagttgcaagcttgcacggtggattagcccttcattttttaagtttctaaaatgcatctttgctcccgaatatgaaccagcagtgctcaggagtgctgtggagcatgcccaatccttctcattttctcgaaggagcttcactcccctttgtcctttctctggatggtctttgatgtttcgcctgcatgttggtgggggcaattatagcttgaattatagtttgtatacatcactgtgaggcagcgtattgttggtttggtaccacatggtccacatgtatttgttatagatacattaggaaggagaattctccattgcatgtggcggtatgcatataaattgttttcttcaacatgaattacagtaagtatttgtatttcaatatgtgccttgatggctgcccatattgggtttggcaactaaatggttggacatggattttccttttgaccgatttttgaagaccttgaatccaaaaaatgtacctagctatttttcagtgttggattactttggagaaaggtccgatttcagttattgacttattgtcatctgtgcaggcagagcgtgaaatacagaaggggccacatgaaaatcttcaaggttttctagatgcagttgatcggttgagaagtattgagcgtttctttagctcaaataggagctaccgaagcagtgatggtgtgctcaaccatgtgaatgccctcctttctaaggcccttgtgaagatggaagatgaattccagaagcaattgactcagcgcaggttgtgtctcattattagtttaaatgtttttaaccccaacatcatctaacttgcattttgcaccctcctgactgattccagcaaacctatcgagcctgatcgtctttttgattgccttccaagtacgcttcgaccatcatctgaatctcatcctgaaggtggaaaaaaccaatcacattctgaaaatcagcaaaactcggaagcagctgtatacagcccccctgctcttattgagccaaggttcattccttttctggctaaattagcacaacagttggtacaagcgggatgccaacaacaatgctcagaaatatacaggtaaaaggaagataaatattttcaggctatatatctattcatcacttcatggatactagacactaaatttgttgtaatatctggaaattttttgttctgtttgtccttttgatgctcacatgaataatgaaacgggttgaaaatacatatgtttgtctagattgattgattgaagatagaagcaaggctaggcgagctattttcatacttgtcaatttgagtatatttataaacttttttggcctttgtgaaaaccatgaaaaatgatttttttagtttggactgccagttccagctgaaaggaaaaacaaaatgttctccctgtgaataagtttaaagcacttgtctcctgcattcctttatatatttttcttggttatatggcctatgtgctaactacctcctatgcgg

SEQ ID NO: 55722 - DNA, 9376 bp, Oryza sativa
catgcgaattgctgtaaggatttttctttttatgtactgtatggtgcaacatgcttctggtgacaccttttgctttaaacaggttaaacttctttttgccgcggaacgtcagctttgtgaccaggtttttgagtgcagtcaatctttgagggataagtgctttgctcaaataactaggaatagtttggctacactactcagctttggagaggcaattgctatgagtaaaagatcaccagagaagctgtttgtgctgctagacatgtatgaaataatgtgtgaacttcaagcagatgtaagtttctgattcataccatagctatctattaattgtttcattggccagccacaacccttttgtgcagaactgcgaaatgataagtgtgtgcatgctgagttaagatctgtttttaagtttctaaaaattttgagctccttatgccatcggaccaatttatggttgacgtaatcctgcagtactgatctcaacagcttgatatttttgggttgataaaattgcaaaagaaacatatgattaaatgatattgtgaatgctttgtgaaaaaaggggcaaaatgccaaacttctcactgcagatttcaaagtatgagaagtgcatggggcattatcatacttatatgacacagtgtggtgccatatttccaaaatttctctgttggtccatctatattgaagttcgccgttttaccagaaatcaattttcaccaaggtctttggaacttggactttcttgtttgcatattctttaatgaaaaacgacttcactagacaaatgttatagtaactaactaactatggagaatttagactgtcaactgaatgtaaatttattttagatatggtgctattttcttgacacggaaataagtaatatctacattttttatggattgtgtagattgacaccatctttgttggagaatcatgctctcaaatgcgtgagtctgcattgagtttgacaaaatgcttagcacaaactgcacagaagactttcagtgactttgaagaagctgttgaaaaggacgcaacaaagaatattcatattgatgggacagtgcatcctttgacgagctacgtgattaactatgtcaaatttttatttgagtaagtatatgatcatgtgcacttaatctttcctgtaatttgatagttgcattgctatactttcttgcatttcttcttcaatcctatccaccagtatgctgatatttgtgttttgcaatcgttgctgctgtatctcttctattggatagccttctaattcaccaagaccagattatttttccccagctgtatacgacaacaaatagatcactccaatgtagctgaacttcttttgtaccgttcttgcaaacattatctatatccaattttgtacctattaaatgctctttcagaatgtcttgttttgtcaagctgcaactggctatagctttgcaaaaaaaatgacaacatttaatctttcgcagctaccagtcaactctaaaacagctcttccaggagttcaaaagggaagatggaacaggttctgagttggccactgtaaccatgagtatcatgcaggctttacagaataatctggatgcaaaagcaaaacaatacaaggatccagctttgatgcacatatttttgatgaataacattcattatatcgtgaaatctgtccgcaggtatgttcttatgaagtaaggtataaacaaattcgcaatagccaataggttagtaactggatgagtgggtatagtttaatgctctcttttctttcttccagatcagaagccaaagatttattgggggatgactggattcaaaggcatcgaagaattgtacaacaaaatgcaaatcattatagaaggattgcttggtcaaaggtccatttgctagacatatttgaacaaaactcactgtttgtttctcttgcattttgttaccattgttgatgtttaataggaagagtgagcctaaagatctatgcattattccgattttacaggtcttgcaatgcctctctggtcaaggtttgacttcatcaggaggtagtggtcaagtaggaagtgagggaggcaatagcagtggagcttcaagagctgcggtcaaagagaggttggtcatgtacactaattattccagcttgcttttcgatgaatgatgttttaccatacaatttctgaaacagtgttttgcccactattttgtaaccagattcaggtctttcaatgtgctatttgaggagatttatcaaaagcagtgtggctggtctgttccagatacggagttgcgtgagtcactaagacttgcagttgctgaaatcctgttgcctgcatacagatctttcctaaagcgctttgggtatgtttctttgaaacttcattacatgtaaataatatattaatgcatggacaaggaccataactaatcctttattttctattcaaactctcctgctcatgtttttgtttctggcagtttgtcaaatgtgagttggtgcattttcttgtttgtgccagttatattatttaattaggtttaaaaaaaccatgaagattatatttacctaccaatttggtgctttatgaattcaaaattatttactagcattacaaatttacaatataaattgcaaaggcgttatccctagaaggctagaacctgatacacttcacggctgtttaggagacactccttattctccttttgatttctatctagacctgaatcctgactgtttaggctggcacttaattatgagtttgttagtagaaataacagcagcccctgactaagatcttagtcagtagtaggaattagagtgttccgggtgctttcaccaggcccagctttggtgcataccacatgccactgatatcagacctggacctgaccgactgtccctcggcaaaataattgttgcttgcatctcctctgctttgccgtttaagaaagagactttaacaaatttgcctgtcctaaaaccggcgtagccctggtccacagaattttgatgattgagcattgccatctgttcatttgtttaataccatgaattttccctcttttcttttatttctatgtttctatggatatgtatgttcactagactcaagagttcttgtccctggagcttatgagacttgtaatctataggcctctcatcgagaacagcaaggcacccggaaaatatgtcaagcacacaccagagcaagttgagctactgcttgccaatttgtttgaaggaaaacaagagcgtacttgattggggtatgtggctgcttaatatacaccagcgacgatgtgatgtcattctctgtaaattgggaccctggtagcattgcttttgtttgtgtagcgctgctgctcagaaccgttgctatgtgcacctttccttgctggggtgcatgatttgtatagatactgtcctagttgccatttattgtttttgttgatttggtaggtgctaggttcgttctgatatgttggaaactcgtgttagtgcattcattattcagtatcagcagtgtgcaataattgtccaatgttaatgcaacctctagtgcctccattttgcagttgcgggagtatagtcgcaactgtttcccacaaaggcaaacctgtattctccttgtttgtgagctttcagggtcaactcgattttttttttgacaaattagccattttcaaaaactgatgaaactagaccgtgaaaaaaaaaaaggccgtgggctccatgctcagacccctgccacatcggcgggggggaatggcttggccgccacgctggcaggtgcttagcgtcaagcgtttttttgctaacctcagcgccagaagcattggcgttgaggtcgcggtctatttgcttgaagtatttttttttcacggtctagtttcgaaataagttttataaaatgaccaatttgtcaaaaaaaaacaggagtcaactcttattagtgtcgttttcataaatattattatacatgcccttaatacggagcagtaaataataataagtctttatatttatgggtaattacttttttaacaaagcacatgggtgacttcggtaatatcaaaatatgccgtcagttttttttttacaggtgttcgtaagaaatattatacatgtgtgctttattttcttcttttctggaaaactcaaatgaaaattcactctactcctagttgttactatggaaaacagaagatatgaaccagttgttaggccctctttatttaggttagcttatatcttttataattcggggatttaaaatcctaaattgaataaaagagacataccttcatcttacgtaagttaaaaatttttcttcaacacaacttttgacttaccgttgtaagagtgacttatagctttaaaaaaaccaaacaaaaaaactgcttcatcttacggaagttaaaaaattttcttcaacataacttttgacttaccgttgtaagagtgacttatagctttaaaaaaaccaaacaaaaaactgcttatttgtttagaattagactaaacaaagagcctataaacaaagatgatctaaatcctggtgtcttgaggactttgaacagatgcgatggatcgaacctggcgtagtggatatatgtccatggtggatacaaaagcgacccgatgttaacgtgcatggactagcgataagaatgtgtacgagagagatacggaaaaaaaaccagcgtcctttcgttcaaaagcgcccttcccttatctctgcatgcagatgcagacaccaccagaccccgcgagtataaagccgtcatttgttctattctgttttcctttcagttcttcttcaactgagagagcagtaggcagagaggggcagtgagatcgatggagcgagcagccgatgaggaggcggcggcggaggctctccgcgcgaagattgagctcctgcgacaggcgatgcagagcagcgaagctatgcaaaaggaggctgccgtgataggcactcgcttgaacaaccacatggtcgccattgacgaggccatgcgccctgcccatgtaagggattatgttcttcctgatctttaaatctatctatctatcaatctcagaatctcattgtgagcgatttgcatgcagaagaggacgtacaacgcgtgcagggttcatgacaacatcaggaggagcctcacggcggccggggcgatcgtgcgccacctcgaccttgtaagggaggtaatctaatgtagcttcaattcgttcctcgatcaggtgcagattagattagctgatgatgagagttcatatttgttcaccccctcctccgtcgatcgatcagtttgttactactacaagtttgaatttagccgatattggacgaggcctgtccgatgggccggcccctggcattgaagcggaggcccacgataaacagagttactagtctacagcccatccagcccataaaccacctcaggcccactaaacaaccccaatccgggcccaatattgcgccctcgatatgcggccggcggcgtgcagcctcctccggcgtggcgaccgccggaggaggggaatgggaggagggctagcaatgccggcggcgcctagcaagcgcgacggagccggcgcgccgcggtgaggcatctgccgtgcgccgccctcccgtactctcctccctttgcttcgcttggcttgtgcggtaaaattgcttgggttttgggcggagagcgattgcggttcccccggcgtggtctcgaatttcaatccgagctttgctgcgggtctacttctgtgcctagtctgttcaccaattctgctcctacttttctgcactgtgtacctacccgcctatttgatctgaggttttgggtcatagtcgcctatgatgtggagtagcaatcgaccggcattgttctcgctttcattccatgattcactttttacattagggcacccgcgggtagtaactaattctaatcactcgtttctgttgcttgatgatgcaaattctctgataaatgcatgctaggacctagaatactctttggttgttgtcttcgtaaaaaaatctctagtccttttttatgggtgatcatgttagattgcttgatactttaccttttagaattgggttccttattactgacatttgattgattttccatgtgtacaggcagaacatgtgatattattggacagaccaaacgaggatcttaatgcctatcttgaggcgattgataagttgactagtgtcgaatacttttttacttccaagataagatgtagagttggtatgatgttcacgaacgtgttaacgaattgctttctaaagcaatccatgggttggagaatgaattccacaggctgttaaccaaatgcaggttcggttatctgtttgtttagaccccatatctatttaggaatgttcagaaattaattacttcatcagaaacctctttactatctcattttccctatagcaaacctgtagatcttgagaatattttcaactgtctatcaagtcttaatcggcaattgtcaagtgaggaccttattggcccatcagccggtgattattctgaagcaccgctaaaacagtatgctgagtgcactcttcctacactcgttgatccctgttacttgactttgctctcaaagttagcacagaaatcaattcaacttgattgccatcagaagtttatggaaatatacaggtgcaatctacaaaagttctaaagtcttttctacttgcaatattttgcttctgagtttctgattttgcttgttcacattttccatcattcccacagagaaattcgtagttcaactttggaacggactcttaagcgcttgggagttgaatatgttacaaaagaagaaatgcagcaagttgaggctcagagcatggaagctaaaatcgccgagtggacacaattctcccgaattacagtgatgctcttgccttgactgcataaagtttaaaatgcaagatgttgtttggcagtaatatctgactatttattcgaacaggtaaagttgcttttcggcgctgaacgcattctgtgtgatcaagtatttgaaggaaagtatacatggaaagaccattgttttgctgaagtaacagctaaaagcctttcaattctactcagttttggagatgctgttgttcaatcccaaatattgccagacaaactatatatacttctagatatgtataaggcaacattggaacttcaatccaaggtgaaagaacaatgatatctgacctttgctgtgtacatagttacattttgtttgttcaaagggccaaaatatgagggaaagaagtaagtttcattctgactgagtatgccttctcatttcaaagaactaaccattattcttgggccggttatgttaggttgatgcaatctttgagggtaatgcatgctctgaaaaccagaaatctgcccttactttaactaaaagccttgcacagactgcgaaaaagacaataggtgatttcatggaatacattctgaatcactcggtgacgagtacgactgttgatggggctgtgcattatatgaccagctatgtcactgattatatcaagtttctttttgagtaagtgaaatctggggattgggagttttcttcatatgacctccaatagaatatggcctaataccgttagcaactatctgacttaacagctatcaaactgatgcagctatcaatcatcaataaagcagatctttggagatccctgtgttgaagatgaaaaagatactgatgtggtctctcaaattgttggtgcaatacatgctctggagaccaatctagctatgaaggcaaagcaatacaaggaccttgctctggggcacctctttttgatgaacaacatccattatattgtcaagtatattggcaggtcagtagatatcatataaggaccaaaaatctgattagctgaatgatataactattttcttattctcagatcagaattgaaggatttattaggtgctgattggattgaaagacaacgaaggattgtgcaacaacatgctactcgatatagaagagttgcttggctaaaggtctgatcacaaaaagcttgacagcacgatttaaccgagcatctcttgtatttttacaaggttttttttaactgttctgagtttgcaggtattggagtgtctatcaactcaaggtctcacttcatcagtaggctcttcaattgatgtcactcaaggaagttttagaaatattaagaacagtacaacctccagatctgtgatcaaggagaggttaggctgaaataccaatataatcaatgtagtatgtactcagtttttggtgattcatcttgcgatttactatgttcttttttttctaactcttctcagattgaaatgtttcaacatgcgatttgaagagatttgccagaaacagatgaactggggtgttcctgacagagatttacgagattccctaattcttatgattgctgaaatattgttacctgcttatagatctttcctgaaacactttgggtactttccaatttgctctggttttacgactttgttttatttctttatcaagctcctcaagacatttctcctttggttatgttatggttatcgttttcatcatgtaggcctcttgttgagaacagccacagcgctttaaaatatatgaagtacactccagaatcacttgagcaagctcttggtaatctatttgcaaagaagttacgaagtgatcaggtcatcagggattctgattgcatcaaacatcccatttaactgtaagtcaagagaccttcctgaaccctatctgtactatgcagtgtcatagtgtgttggaacaaaaaggggtgcattttagtttcatagcgcattttacctgttaagtattgtcatcttgttttgattttgttttcagacagctagccaaatccattgtaagcaaatttaactttgggttcaataaccaggtgttctccttgcatttgtttgctgcctgcattgtgcatgtttgcattggactgacatactctttctctaagcctggaggttcagaccaagtctaaacatttatctctttttttatgaaaaagaaacaaaccgtagactgtaaactgttccaagtggctaactgcatgatcagccttgcattcctcttgagagatgcatgttagcgttggctccaatcctgaagactcaaattctcaaaccaagtcataagagtctcttcaaaaactgtaaaagataaagtgttaaattggtcctagtggacagtggatatttaatctagtttaggttattgagaaaaaaatcgatcccacccatcaaatatgtggtagatgggtattaggtgttagcctacactaacctgcaa

SEQ ID NO: 55723 - DNA, 7012 bp, Oryza sativa
attgcctgggaccatggcagaagaaccataatcagccatcatcattacagtatataccaggaccgcacctgctctcttcattctagttcttccatatccatccttttagttaggatcattctgttaggttctcttggtatatgagatgcatgagtatgaccccacctatgacgggataatatgtttctttactcctgcataaatgatttccccttctcattaataaacttgtgaagatacaagagcttaatgtacagaaagttgattgcagattgaactttatcgcctttatggtgacattgtggatgagaatccactgtattcagactaagaaatatgataacacctttgtggctgcagtactttctggtgctctcgttttcttcttagatgtcctttagaggcttggcgcatagttggtttgtgcttcaggcaaactttatattctttccccacatttttctgcttcaaacagtgatttaaaatttggaattgttttgattaatggattctgtctttgtttcttaatttggtcatttggtgagtgcaaattatatgtttcatgcatatttggagtcacctatcattcttgtgatctttcaatttcctgtcatcagactgaaaagttgcacggtttgtagtgattttgatagaaaaggacgagttcttgttagtagtttcatggcaatatcgcagttagtggagttggttcgagaggtgtcgtgcattcatgccccatcaccttatgtatggttgtataatactccctccgatcttttttgtacgaagctggttagtttaattcattaaaggatgtaggtagtactactttttcaggaagaggtacataactttgtgagaaaagagcaaatttaccattttctcttgcataattacttctctatgttcgcttcatggttgaagcttcccccattgactcctgccggaacttcatatcattgtttaattaagcatatgctagtttttttttcttttggctgggtagataagcattgctagttttggttgccatctgagactatggattatggcaagggcggatgggggtagcagggccttgagtctactattggcgcgcgagaactatgggagtcaccactaaaatatttttttttgctatatgtagaggggaagagggggctgtagctttgtctagtttgttcagactcctcttatatttcttcctagatccgtcactggagacggggtaacatagttaatcatgctagttttgggctatagtagaggccgaggatgttaacttctattacaaaattgtattaaaaaaaaaaggttaccgtgctacctacagttatatagcttgtagataacatttggcaaggcaaaatttctctgttaacttcctgcttcctgctgttatgattcgtttggcatgaaacttttgttactcgggctgtcatgtaggttattcattcgtcaatttataagataaatacatactttactgtttcccctaattaatatctgtatgacattgtcgtctcaggtttgactcctgtaggcgaagtcagcgaacgaggtagcaggctccaagccttattcatcatctgccatagctaaagcgcatggaaaccacgagggcatatttccgaatgccaacttggagcgcagctgcacaggtgagcccctaatgcaacagctctttgtatttccacgtaaccatctgcgcgtactgccgttggcatttgatgctattagtcgacatctgcccatttagcagtgattatacggcaggcatcaggtgtacagtaattggaaggcgcaccgttccttgcatcttatgtcctagtggagacaatcaattatcagaaactctggttggctggttcaaagtctcgcgcattagtgtgaaagatactcctatgtgacctttatggtaccacaaattcactgcatctaatcatacttttcttaatacaattatgtattggaagattacagtgcgcatagcatataacaagagcccatttggcttaagagacgtccctaacatgggttccctatgtgagctgtcctttggactctacctgccaacaacccttcttctctgcccttcatttccgcacaagctcaaacatggtggacggctgtagcataagaagcttccatgctgtgtgcttgtgtcccactgatatacgtgtctggctaggcaatcgtttatttcgatctattgtcattgtactgtgattgactgatttgtttccacactcgttaattacattctttaagctggggttttgttggcacatggatgatagaatcgcaagcgtgcttctggttctctatctcacctaatattcgcaaactcttatagccatatgcttgtaaattagccatttttctgagttacggtgaacagtagacaggagtgtagtcgcacgttatcctttttttctttgttttgtttgaagtgagaatgtgatatgaatgaagattacagttagctaggcaactggacaaggaagtgagagtacgggacccatttattatctttctatgggacggcttcttctcttcctgtttacctttctttcctttggatctcttcctctgatgtggacaccctacccgctcggtgactctcttacagccaataatgaatcctccttgctcggttaattacctgctgatagctaaggtacagttcgctattatgtgtagttatgttacagaggtggtcaaacgtaaaaactagagtcttcagtgcaatcgaacatcatgaatgaaacgatcggttgtacgtcattatctggacttgttggtgcttagatgcgcacgtcagaagatcggacatgtaagtatgcaatacgagtccactagctctgtttgacgcggagtcatttgtgctgatcactagtgccgcacctgctaacctactggaaagcaaggtcaatctagtactaaatgacattggaatgcccgttataacttgatgtatgtgggtgtggcgtgcaaaagaaggtttaacgcgccttgtcacactcacacaccttccaaatgatgcaaaggcactcgctcacctgcgggctgcgcccaacgttccttttagctgcttccttccctttaatttccatcgctgatggattccttttgagagaatcaaaatccttccttttcactttttgtatcgacgaaaggcgttttctccgagtccttaacaaaacttgattacctttcaatcaatcatagcttcttttggagcttaccactcaccaccatcgatcaccagctccaccatcataatccacccctttgagacatacaccatgcttacaaagctgaaattaagttaagcagcaggcgaccgtgcaaagtctagtaagccacccaaaagtgagcagcagcaaccaacaactgaacctaccctgctctgctcacactgtcagccgatgctgatcacctccttccaatcaatcaacctgccattgctgtacatgagccacaccaccatctgagctcatatataaaccccctccccacccgctgccgcgacctcctcccagccatttcgatcgatcaaggagagcaaagaggggatgtcggtgatcaaggattgtggggggcacaaggggtgcgagtgcgagaaggagaaggtgcaccggcggctgtgctgggcgctggtggcgctggtgctcctgacgctcttcatcgtgctggtggtgtggctggcgctgcggccgcacaagccgcggttctacctgcaggacctgtccgtgctgtgcctcaacgtgacgccgccggcgtccgcctacctcttcaccaccatgcaggcgacggtggcggcgcgcaacgacaacggccgcgtgggcgtctactacgacaaggtggacgtgtacgcgcagtacaaggacgtggccatcacggtgccgacgaggctccccgtggagtaccagggccactacgaccagtccgtctggtcccccttcctccaatcgctcgaccacgtcgtcctcccccccaacctcgccgtcgccctcgcccaggacgagaccgccggctacgtcctcgtcgacatccgcctcgacggctgggtccgatggaaggtcggcacctggatctccggccactaccacctccgcgtcaactgccccgccctcctcaccgtcaacgacggcaagggcagctacggcgtcaactacggcggcggcgatggctacttccgcttccagcaagcagctgcatgcgccgtcgatgtctagctgtgtcttctttcttcatttcctcctcctccttctcttcttctttttaattagtttcacggcttctcttcttcttcttgcttaatttttctcaccggaatcaatcatctcatatcaatgaagaaaaaccgatcgatgatagtactagcttcttaatttagaccgtagttggtttggagctagtgtagcttggagtgaaagggaaaattggggtattctgaaaagatgcataatagacgtacagctgggagtagacgtgaagtgtctgcataattcgatttgcatttggcaataattatattccaatgtgagtacatcaataattaaaaaaaatgttcatatgacacctgtgtgttttgctcgtcttgcctttcgattctctctataaaaaaaattgaagaaaagagactatattcgtgttagcttgtgcctgagatatttgacctttatcttggacctcatcgatcagcttttagtttagtaaagcgctcctttgaaaacgaaaatctaataagctagcgatcgatcgatgagagagtttgttacgagtgtggaccaatgggcagattgctactagatggccttccccgttgtgtgccggggagccactgcacgtcactgcacatgccgatggcgactcactcttattatttgtttcgccatcttttgccaatttttcttgcacagtgattgacgatatgtcatgcatttcctttttatatatttatcatcggaattatggaaagctactttgctagctctaagcacgcgtcaaccccagcatcacagcatgtgatgacttaacagctagtactccctccgtttcaaaatatttgacaccattaaatttttagcacatgtttgaccgttcgtcttattctaaaacttttgtgaaatatgtaaaattatatgcctacatcaaaatatatttaacaatgaatcaaataataggaaaataattaataattacttaatttttttaaataagacaaacgatcaaacatgtgctaaaaagtcaacggcgtcaaatattttgaaacggagagagtattagtatacttcattgactactagcttgtgattctttcacaagtagtaagtaaagtggtctctgttagttcttcatggagactagatgaggggtgctaaagcttctactatggagatcagtgtcgtcatgatcgaccaactcatggtctaatacaagtaaaatttaattgcatgatggagcattataatccatacatacactttgtgatctcgcgtgttaatgattaaaatgcgtgccaatttggcatggttggtggatgcgaccaaattaaaccaaacgctacatgtgcttttgttagggcactcatagtagcttacacagttttagttggtggcacacacgtatacagatcactactaccatctgctcttcaaaaaatatgttctctatatagatttagatcaccatctttaattaatcttagtaaatactggtacaggagaatggagagtagcagataacgctttcagttgcaagtccctttcgctcgattgcctcgcaccaacgtaggtagctatagctgcttgccctttgcagagcatggttgcaaaaatattctgcagaatacctgctggccctatcaaaatcaattcgatcgatagcctgctttgaggcttgaggtttggttatacagtacacatactttaagagtgtttttaagtggagggaaaaaaagagaaaattcatatacgtaaaacgatacgagccattagcatatatgattgattgattattgattattttaaacttaaaaaatatattaatataaattttcgataggtcaaatcctatcttagatagtaatattttaggatggaggaagggttttagagaacttatagcaactttaacttatttcataatctatggcttctccacatagttagtttgtttgcatagagtttcataatcaatagttgtaaaatccaaaataatataaattaagagccaaaagttgaaaaaacctgatttttttccaaattttcaaaagtttgatactcatcagctgcttcttacaatctcgagaaccccaagaggttcttatactgtacatagggtggtaatggacctaacattttgaccaacaaaatgtgagggttgggtccaaaaatggttgggttgaaatttagtagttttttttttgtgctaaaaatatttaagggaggtgggttgtgaaagaatccatgggccctaactgtacaccatgcctgctatgtatattgaactgtacctttctgtgtggttgagatgatgatataatgctgagacagagatagagctggctccatgcatgaagaatgtcgtgcccataagggcttataatttgggggcgtactgcctgcttacctgctatatatgtactgtagctaagctaagctagtacgtatgcatgtatgtattcgaatttgaaaaggttgatcataagcaggtaattataagcagggaagcaggtatgtatgtacgtggtggccggtgggtaaggttaggatgagcggtagagtgaggcactagtagcacactgtagtctagtcctgcaaagaaagagcttttgatcaagtgcgagtgactttagctgctagtttccttgaggtttcttcgaaagggggaaagtgaaaaaggcaagggtgattggctgctatctaagggaagaccctccatcacagtcaatatatatatattcggcaatgtatcccaaacaagatgagaatatgagattgag

SEQ ID NO: 55724 - DNA, 740 bp, Oryza sativa
agggtgtcggaggtggcgagcgagaaggcggtgcgggtgctgcggtcggtggcgaggcacgcggcgacggcggcggtggtgcaggagatggggcagacgggggcggtggagaagctgtgcgtggtggcgcagtcggagcagtgcggggagaggacgcgggagcgggcgcgggagacgctgcggctgcacgccagagcgtggaggaactcgccctgcttgcagcctcacctccaggccctctacccttcttgctgatcgaattctgattcatgatcaccggcctcatcactagctagctaccaacatacagcacagagagaattgaacacttgttcgattcttcctttcgctcgattaattttattgagttgagatcgttcgatgtagtcctatgaatcaaagtgtacagatcgacgcaatagatgaactaaatcatgcgcgagctttttttgtttgggtctcgaaatatctccttataatcgtctactgtcaaattattcttaatttcgatcttggaagctgagttctgtacataaaatttagaactatatatagctagtttttccaccatcatcgatcgatcatagacgaccagagtgctggtcaattgacatgcagaaacgcccagaggtctttcagctagctacataaggtggtgggctagccgacctggattaaagtctcgctccttttatttatttgatataaggttattttttaatattcgtattttttttcta

SEQ ID NO: 55725 - DNA, 1247 bp, Oryza sativa
tttttgtccagctcactcgtgtagtactctagaaaagaaaataccacaagtcgcaaattaatgctactcgtatatccgacctgtcaaatgaggggaattcatgcatgattgtagccagcgtaattaaggagtgatctgcactgtttatcgcatgtgttgatgcatgatcaaactgacactcgagtaccaaggtccaatccatcaaccagtcaatcaacctaccctactcgtatgcagtcatctgcagagtagtactgtagcaggcgatttgaggctaacatcatcatagtgacacgatcacgctctgcagtacaatatcacaaccaccaattcaagtgcgagatagtaccctttgttgctagtctatcgcctcttcctaagggctgcaaacaacccaacccggaacctcgtctaaaatattggtgcaaatacacacatttccacagtgcaaatacactcttttatgtggcttaactggttgaatgtactgtaggagtaaactgagcccacagtggacatgacctcacgcgtggacacgggggagtgggacggaattcatttccccacctatcctcagcgagacatcacttctcctagccctcccctccgtcgctctcggcgacggacttctcgaggccgtgtaggcgcgcaccctcgccatggctgccttcctctcctcctcctcctcctcctcctccccctcctcctcgctacagtagtccacgaaggaggtggccacggccgtagcggagaagcgacccgtgtgggggggaggggagggagaggaggcaaggcggcagcaagcgacctgccatggatttctgttcttgattgttctttcaagatggatgttttttcgatctggaattactagcatgtctgatgtcgtggggattatggagggcgatttggggaggtcacggggcagtgaagaaatgctacccacagtgggcgtttctcggttttccccgtccgctcgcgcccttgccgccccgaagttttgcgccgctcagacaagggacgagaaacctagctgaggcacgggcgtttgctccacgtcgacccgaatccgagctggcgcaacaagatcacgcgctagctcggtgcactgtgaaaggcctaaggccgtgaactcatggatggtaggcaaaataggacaaaatggcatcatcaggcaaaaaaccgacctggaggtctaagggcccctttgaatcacatgattaaaaaaatataggaataggaaaaac

SEQ ID NO: 55726 - DNA, 1354 bp, Oryza sativa
caatttacaaataaataaaatttgaaattaagaaaaacatgggaagaagagtttaaagtcaatataggaatacaatttagaagtaactgaaattcgaaattaaaaattaaagaatattgaaagatgagtttagagtccacatagaaatacaattagaaataataaaaattcagaaataaaaataaataatattggaagaagagtatagagtctatatagaaatacattttactgaaaattcagaattaaaaaaaagaaatattaaaagacgagtctagagtccatataggaatatatataatttacaaataactaaaatttgatattaaaaataattaataactaacacgtataaaaatacaatatgaatattacacattagcaattttataaagttattgcaaaatttaaaattatgtcgtcattttaatatatttgaataatataatgagaaaacatatatgctattatatgagagaaacatactagttattaatcaaaggaaaaggaaaattcgtggtgaaagtcttcacgcgtcacgcgtctttgcgcgataaattgactacgaaacgattgcttgtttgagctaaacagctcaatacccggtagagtttggacgaaatttcccgttgaaacgctaaacaaatctatattgaaagcgacacgtgagcgacgtgggcttgagtgaatcgaagaaagtggcaagcaagcgcggcacaagcgaacgtttcaacggtgacgagtcgccccagataaacaatgccgcgcgccccccgccgttgcaatcagacacgtacagcgcagcaggctgtgtccctgcggtttatactgcttcttcctctttgattttggggtttgttggaatcatgccaccttaattcggtaaaatttaagatataccacccgtatctaaatgatatgtaggacccacatgagtcaatgacatgtgtgtcagggtggcatatcaaaatttgtgtggcatggttcaaattttcccttgattttgggtgcgctcgttcctgcgggcaaccgctcctgtcagcttgttttttcactcgcatgctttccaaactgttaaacggtgtattttttcaaaaagcttatatataaaagttgctcaaaaaattcatattgatttatttttttaaaaaaatagctaatacttaattaatcacgcgctaatagctttgtcggtgatatgggcccgggggtatcatgtttagagggaggaggttgccccccaatgccacgtggccctcccccaaggggagtcaggcccgaggtggggtggcggccactccctgatcgagactagagggagaaggctaccccaagcgccacatggccctccccc

SEQ ID NO: 55727 - DNA, 1731 bp, Oryza sativa
atgtgggcccgatcttctgtcctatcattctgggagttgggcggtgggagtttagtcacgttcatacgtcgccttaacttcccactttcctcccgattttcgaggcgctgtgggctcgggagtttagcccgtaccttaggccgtgaacttatttcctgtatatactcagcaaacattgttagattctctcgggcccgtgaccttacgccgcgtaccttgcttgcccctgccttttgttaacctctgtttgcgttctacttcatctacccaaacgattattttcacatgagtgtgaggactgaactttccatagccaacaatctttacccgcgatcaaactaggctgggcgccgtagccagccggcggggccaaagctagctgctgcagaagagtcagcacaaggggcccgggcgtcgacggcgaccagagctcgacgcagggctaggagagagctaggaatcgtagcccccacacttttagcaaagaatcgtttgaatggatgaagcgaatacaaactttttggtaccaagggaggtaaaccagcgcgcgacactgggtaccgcgggaccgcgaggaagagatgggcgagagataaatataagcaataataattctatgtgagcgattatcttcgcgcgagtgcgagaactaaactttccatagccaataatcttcacccacgatcaagccaagctgagtgctgtagccaaccggtggggccaaagccaaccgctacggaagagccagcacagggggcccagacgtcgacgacgcccagagcttgacgcagggctaggatagagctagtaatcgtagccccacacttatagcaaagaatcgcttatatgaataaagcaaacataaaccttgcttgcatgtcgcgacctttcaaacttttagctcgaagagggcctcccatcatgggttcccaaccattttgggaagcctacgaccacttagcaaacgaggtcaggttcccacgagcctgtgtccccacgctacacattctgtttgctctttcctttcggtggcctccttccaatatctcattttctggtggaggagttcattctccgataagcctgctccgttttccgtgccaaaaggattatttcccgtccctcactctcgattgggccctttatttttcaacttgtcttcgcctggtacggcgtcagcaaggactaaacatccattaacaaaaaaaaaccttaagaatttgatataatcttgatcatcatgggcagagtttgggatgcgaaaatattagcaatatcctcgtggtggttgctgcagcaaaaagaaattggcctgcaaaagcgtggcgcgtgtttttttttcttttttttaaggtataggacaaaacaaataaagcgagagttccctgcgtttaaagtggtgtccggtcaaagaccaggcatccagcggagcgtgggttggggtctcaaccaccagccaaacgccgccacaacggctacaactccaccacactccccgcatcatcagggtcgcacacacacaccaccatgtcatgtgcccgcccactactaccacttcgcctccttcccatcgagggcgaggcgatcacaccacgacccggccaaactttgttaacccaaaccaaaaaacaacaacacctgccaattactcctcgcggttgctgccgtcctgcaatgcagccgaggctatcagcagttaatcggccacgcgctttacacaattattataaa

SEQ ID NO: 55728 - DNA, 1086 bp, Oryza sativa
ttggcttggatggagatggcgacggtggagggcggcatcaggcggaggcaggccgggaagcctccggcggcggcggcgttgggggcggcgggcggcggtggggcccctttggccttgcctcgttgcttccccggagccatgtctgacggtgactgacgacaatctggtcgagccgtggagacgtagagagcaaaaaccaaccgatatggcccagtttgggcctggtcgctggaactgggctgcggcagatgatactttgcaatcaaggcccagcccatcatcaccttggcaggatgatccatcaagctaggagctacagccagcgttgccggcagtaaacaatccaagaaaaaaacacggggagttctgcacatcttgaacaacaacttggcactgaatcctttagatgagtgtttttttagaaaaaaaaataccactaataattttatggtagaaagactttcgtgataactgatactacgcgttttcccaagaacaggccaaaagaaaaggtgtagcagtagcatcttcaggattgccgaaaacttggcaataggaacaagttgttagagaaaaaaaaactatccgacctgccggattcgaaccagcgacctaaggatttatctgcaaacactacagtcctccgctctaccaactgagctaaggtcggtttctgaaaattttgttgaaccatatgatacttttacacgtcttccgcgtcaaagagctactcactctctaaattggggattgtgtacatgacattctatgctacctctcacggtcgctccaattcagaattcggtaatgcaagtagaattgaattgagagaaagatggtgatggtcaccagtagtccctgcaagaacaggcgccattctgaaacctgtggaacctgttggcgtccctcaccaccaccaccctcctcaccaccgccgacaaccctttcaagaactcgtggcagtcgccgcatacccgcaggttcttgtacaccctcaccacctcgccgccgccgccgccgccatcgtctccggtgccgtcgcgcagcagccacagccccacggcgagcctctcgctgtgttccctc

SEQ ID NO: 55729 - DNA, 8650 bp, Oryza sativa
  unsure (1)..(8650): unsure at all n locations
gtagatcaatcgctctcagctacgcgacatcaacacggcgcccgaatctgaaggtccaggaatggcactgctcctgatcattgctgctagcaaggagatggattgcaaatgcggaaaatacctttaaggcaacagaacagtgagaaacgccgagggatcttccagctagctccacaaggtggtgagctagacaatttgggttcgaagcctcaccccttatagttatttaatattaggtcattccctaatattcgtgtctttttggcaacagaacagtggattgggggggaagtcttgaaatgtttggataggagaccgggtttcaacacagacaaacagtggatatgaaaatgcattttggttgctgtgtacagaactcccaacttatattcacatttttcgtgtaaaaagtctacaggctacagagaagactacaggaaaacaaggttttgaacacaaagaggtacctgcatatgtccaagtacaacaaacaaacaattcaactaatcctgaacttcagatgatattgctaagcttgcataggctcttcagtaaggcgtctatggtctgaggaagctgtggctgaagaactcttggaaggacaaccttttcactggaagcaattatggaaatttgttagcttcgcactctccatattttcagtgagaggttgtaacaagatcaaaggcgcacctggattgctacacagaagtctggtgcatatatcaatagaatcaggacgtagcttggaaataacgacttctgagaatggaagagacacggttcggtttatgcattgaagcagctgcagagacaaatctgtgatgagaacttattgaagtttagataagataaacaaggttgaagagagaactagtagccacctggacattgcttctaccacggaatggtggatagccattcaagagctcgaagagaatcgcggcgatactccacaaatctacctgcacacaacatacatatgttcagatttctcccgtttgtgtgtgtggcaaagagagttagccatgtgagtacatacaacataccccaccatcatacttctgaaacagcataacttctggggccatgtacaaacaagtgccacaatttgtatctgtgtattccccgggacgaagaactctagagaccagaagtaaaatttggattagattgtcttatgagtagcacgatgccttttgcaactaatacagctttttaaagactgagtaacctcaacctacaggttatgtatgttgagcagtgtaccttgacaggccaaaatcagatatcttgaggatcgcattgctgtcaggagaagagagcaggatattctgcggcatacaacagttttatcagtcaacaatggtgtctcaaatcagttagagcttaataacacaagtaattaagagatgaaaagagagagatttgtggacctcgggttttaagtccctatggacgatatggtgtctgcggagcacttgcaagccagctcctaccacaaggtgttgggcaagcataatttcttacacatgattatcttcttgttgtaattgtaacacaactctactgtaaactgtgacatttctcttaatggaaatggaggactaaggccctttgatccaaaaaaaaaaatttgtaacacaactaactaaggttgcgggtaatgtgatagattgggggccaacaagagaaaaaagatgctactagggctagaaatgaaattgatatggcaaatattactaggtgaattaccgatctgtctcatgaaattgctggcgacgcgctcctctaccctcccgttgcgctggatgtaggccgccaggtctcctccctcgcacagctccaggacaaggtacaggttgctctgggtctaattaaggagaaaaattcactaggattggtnagagaagggaagaatgaagaaagacgtatggagaagacaaaaggagacctggatgagtcgaggaggcggatgatgttggggtgggtgacggcggcgaggaagcggacctcgcagtcgaggctgtcgcggagggtgctggggaggccagtcagccgcacctgcttcaccaccacgggggatccgctcgaccgctccacggcgcgccacaccaccgtggacggcggccggccgcccagccgctcccgcagctcgtagcctcccaccgtcgtctccggctccggcgtgctcgccatcgcgaaaccactggaaaggaaatggatggattggattttttttcctcctcagttttcgatctcatcagattttggcccaagcaactaactgggccaggcccagcccaaactgctattttctttctttacccgtgtcaaaacatactactccctccgtttcacaatgtaagtcattttagcatttctcacatttatattattgttaatgaatctagatctagattcattaacaacaatataaatgtgaaaaatgctagaatgacttatattatgaaacagaggaactagtttttaatatgtttgaattgcttccagttaggtgccaaatctaactagagtataaacaagggtttgggatgctaccaaattaagcttgggcatagccaacaatttggctccaatcctatagacaagcatcaaaatggaattcagcaaaagagatatggttcttcatctgaagttctgaagtctcaactaagttattgccggatgtacatgagccaaaattgcacaggctggaaacacaaaaactagagctgtattaaaatatcccagtggctgccgccttgttcagcgttcttctaaatttagtacacatattatatgacaaaacagaaaactcataccaatcaggtgtgagtaaaaaaatattatacatgcaagcatccgacatatatacaaaatcatttctatgctgccgtgctagcaacaaacagtagcctggtagttttgaagaaaacctctaagctgttttcacaaaggtcacaaggagcccatgtattctctatcgcgccgatttcttgttgtatctcttgctattggagatgttccgacattcctagtctttgtgaaaccctagcatacaggatatgcagtcttttacagcagttcttcagagcatgaacctagatacttcaaattcattatttttttccgatcgtcgtttcattaaacctaaagtgtacaaagttcagaaatttaccaggacatgccgtaagatatcttccaattctacagtaatctctgagaaaaggggccgcacatgaggattttcatcccaacatcgttcaatcagtttggacaacctcggatgcaccttcggtgggatctccatgcgcattccctaaaataattaaataagggtcaatgtttacagtcatcccttcatccttgagcatccattatttgttaatattatttactttttttaacatccaatgtgttatgttggagcttattggcatcaaatacatacctgccttactcccagtgcagcttgcaagggtgtcagattttcgtatggtatctacatagcacatgtattagtggttattacatctgaccatagttcactgctgttaaaaaaattgagaactatgaaaacgtcacacaatgccttgccagccacaggttacctttgtagtgaccaactcccatagaacaatagcaaagctgaagacatctgccttatggtcataaggcttatggtttattacctggtaacacacgcgattctaataagtacattgcacatgcatattgtcttagctttgcataactcttctaagtatggcttttgcacactgatccaaaaaatcagtgcagtaagtaaatgcaagcgtgatcaatatgtaagccaacatgcttgcaaggacagcatagtcaggtagtctgtgtatgcatacatgtgaaaacagtaaaatagtgcatcatgcatctgtatatgtgcctaagcctggtgaaatgggcttgtgaaactgaacttatcattagcaaacagaaaagactttctgttgcagtacaaaagtcttatcgagtaatcagaaaggaaaataaagggaaaaaagggacaccagaggataaggaacaaaaggatcaacatagtacctcaggtgccatccatctatacgtgccagtttcagcagtcatttctcccccttgagatcggagccgagagacaccaaagtctgcgatcttcacgacctattaagaattgaatcagtgcttcgacatccttcaattgataagcaacttcgaaacaatatgcatacttgaccagagccaattagcaaattggcagtcttcaagtccctatggatgatattattctggtgcaaataatccattccttttgagataccaatagcaatcttaagaacaacaggaagctccaaagtattgttttgcttatgaaggaagtcatacaaattacctccgggcatgtactctggatgagacacacaaataacaaagcaaaatatcagttgacatgaaataatcgcagaaaagaaattgcccgataatagataccctagatagataaatgctctacattgagctgacttgatcaattcggaaaactcaatacataaaaatacaacaagcaatccatggcctatgctcgtttgtgggattgaagcaagaaaacagagtgcacccttggaaagttggaaatcggaactgacacatacaaacatttttttccctaaaaaagcagtaagataaatatataaatgatctcatggctacaatgatactactactaacttaactcatctagatcgctggctcttgatattatgtaagaaatcctatggcatgacaagggaacagaataacagtattgtacataagtaattatttatttactatccatgcaattcttgtccattatctaaaaaaagtataattcttgtcatcttctgaataaataaagactagactgtacgaaatatttgaaccaaactcccatgtgaatacgatgattcagtaaagaagatgcacaaatatctttttttaagtgactagaaaagagtttagttgggattctgaacacaagttcacttgcagtaaaatgaattaacaccctcctaataaagctcttcaaaacatctaaatatttaattaacagcaagattggacaaccaataccttactgctaatcaattatgcaatgggagtaatctcaataaactaatgtcaagttaaaacgtgtggatgatacatgtatcttataaatccatggatagcatctccttatttataggtgctatacaggatgagtctgatatgaactttgcagctaggggcccagaactcatcgccttgcaatacaataatagaaaaaaatactcatgtgatgtgtaaacaatacagaaatttggctggtaatttagaaaatgaaaatttgtgtgctcattaggaacgaagacttatttcacatgcatgaattagaaagtagtaattcacaggctaattgaagggtgggtagagacctgttgataggaatagagtagcaatattcttctgaccagacatatcttgcactattttccatcatggtgtagaattctttatgcatggacgcaacaagcaaatgtaatggttacagtatccctcctatagacttagctgctcttgaagtccctaccaaaatggataaaagacaggagttatcccccgtctttcgagattttttgtttttaacaattccacctaatgacgctcaccaaaatgcaaaactaaaaatgttcaatcaacagttatttacattagatgccaaggaaactggagatgaaaaaccaagcacattggttatacccagacatgagctcaatcttttagccaccaacgctactcagattgtaaatatgcccaagcactgctatctgaatcttgagaaacaaggattttgattcctacgaaaaaaatcagcaggcaagattatcagcaatatttgtgtcacctgttacaatgagatactttcgatgctttgtgcaagctccataaaattggacaacattttcatgatcaacactcctggacatgacttcactgtattagaattatctggaattttaaatgattcaaagtcaagtctatgcatcaaagtgatttcaaaagaaagcttactttaaaatcattatttcttgcaagaactccactttcgaagaatcgttaacatgttcagatctaagaaattttaccttgcaacatccacacccgagataagttcctcgatatctgcagccgaggatacaaacaagaccacttggttaatgaactgctgatcttgctagaaacattaaaaaatatagaataatgcacacagcaatatgtctccacaagttgaaatcagaaacccagaacacaactagctttgtgactatttgttgatagtgcccccttgtgaaaccatttgcttgtaaacagatgtaagaaaggtcatgcaatccacactagcagttgagttgtacctgttgttctaaataactacctccgttctttcctaatattcattattcctaagtaataagagttgcatgtttcttacagatccccagaagatccggatgcaattttctccccaatttgcagcaaactcctgtcgaattcagaatctcctatcttttcctgcagctctagaactttctctgattgtgacaaatttgtcggattagacaatgagccctacatacaagaagttcaattctgtaaaggaaaaggatagggatggcatattcatttcttcaagtcttgtaatgctgacttgagagtatttacaggactgcatttaatgcaaaaaggaggtaacttgcaagcatgttgacttcctaaccagcaagacacctttaaatttcaagcaatcgtgttgattaaatggagaaataggaagaaccatacatggctgcttgcctctgcctctataagcttctgaagcaaaccatccgtttcctgcacatagtgttaggcaatgttttaatttgtggaacaccttgaagcatagtgtacttaacaatctgattatctaattttatggtttcccaccataagtagtcatgattaaaagttcgaaacataatttgtagagttctgtaattgtgtgaaaaaaataagctataaccatgacgatgctctaagtttacctctgtatcccagccatcaacaacaaacacatcgagacaaaagccatctgatgttgagaacacatgagcttcacggatgttcaacccaatatcagacagtatcgcggatagctgtaaaacaatatctcacagttcaagcggtgacacaagaaggtgtggtattcgtatggaggtctctaaatagaaatcacaaagtacatggccttgccttactgaggagctttggcttgtctatggaagaaaaaataatttcatgaacacggacgaatttcgagtcccttctgcaaaattaagagaatggttatggacaaatcatgtaaaaaatgattaaagatgattgctcaggcaaattaagagaatggttcacgaaaagaaagcatataatacatgagtgctaaactagtctggatatcagaaagaagtccatataaaaagaataggcaaagaagacgttactaatcatttcaaagaattatatgagaactgttgtgcaccgatgtagagagcaaaggctcatatccacaaaactcaacaattcaaacaaggctgattagagcaactagcctgattgcatataactgcagtaacaccaactatttttttttgcggggagcagtaacaccaactataaaggttgctcttaagtatcatgacggaagctttgtaccaaagaggaacacagtgttgttttatggacagaacaacctttcagtcaagttagcacccttctggaaacataatctatgtttatacaaatgaaatggaaatttcgcattcttgcagtttttagatcgaaccagatggttgaaacctgaaactgacgttccggattaattgattgttattatggtatagatatgtcattcgcacagcacaacagcttagtaacaaaaataccttgcagaactggcttcgaagtcatccacaccttttcctctctctagactcaggtcttccatcatcctttcatatggctcggattctgtgaattcatcatctctgtccaatattcacaggcacaatcgatgttaacacgaaagatatactgataagttggcttgatatttacagaagaagaagcatttttgtttggacaaagagataccattccgaacacgaaaagaaaggtacatacactccactgaaatcaactgtgtcctcaactagtaaagtatgtatgtatgtatatatatatatatatatatatatatatatatatatatatatatatatatatatatatatatatataaaagcattggaaagttggtgacctatacctcaaattgatagggagaaagcccccaccattaccgttttcagttggagttgatccagagtctacccctatgtagcgggcatggaagattgggcgcttttcagggtcggcgcagtcgggagaatcctccggtgcagcagcacttgctctgccttgctgacatccagatcgatcaaatagctgcacaggcaagaagattgcactttgaaaggcgagaaaagcaaaacaactgagagacaggcgagaa

SEQ ID NO: 55730 - DNA, 3834 bp, Oryza sativa
attcttcaaattttatcaatgtgatctcagatttaggatcatgccaaacagagcacaaaactcacgtatttacaagcggagaaatcatgtgtctgctagcctactccaattgttaaatacagtgtactactacttgttataacatcaatatcaatgtcaaaccttcgttttatataatagcaacggccaaaattcactgctagattatgctaacctgatagcaaatcaatgttaagttattagtacttcattactcacatacataagattctagcaactggatccaagataccacgcttgaccgcatccagttagcttctaatttcaacgatgtgccttgcatgcttaattcactaactaagcaattgataaacaatttactagtttgcatcaacagagaaagagatcgtacttgctccaacttgtcccgacgtgtccaacacgttcctcttcgacgtaacttgtgttttaaagttggcaatgacacggagttaattataactgtttttcaagtgataaacacattgtcaatgtcaccactgtgctggggcactactcgagcaaaacgcatcaagttgcaattaaaaaaacttccggtgaaagaaacataaactcagaagaataatcaacctcgatgatattacgatattttcattgattaagagcagcaagggccaaatcaaatcttcaggtcagaagcagcggcagtactcaactgctagagcagtaatcactgtcaattactaagtactccctttgtttatttttaatttaacgttggcgtcaaacaaatgagaatggaggaagcaattaactactccagtagggaatacatagctatagcgtttgcaatgtacggcagcaaacagcaaaggccaaacctttgtttccaagcgtatgtatgctagtcaagaatctaattaagcaatattctgttctcaaaaaaagaaaaaaaaaagaagaaagaaagatccaatattctaataaccggactccagattctaagaaagcagtttcgtcgtatcaatcagaaaatagtagtacaacgcagttgtttctacataccataattgtagcgtacgtcaggctgcacgcttggcttaacttgatggattagtgccaacctacaaatactccttccatgcatacaacgatcatacaaagggtaccgtacaaggtagtaaacacttatgccttctttcaaacgggagagcattttgaaggatcatcttagggattgagctagattctaaaaaacaaaaggaaatacaaatacacatttctcttgtttcaaaggaactctcctttggaactcaggattaaaaaaaacatgaaaagaaaaaaagaagtgttggattgaattgtcaaggcttgttaaatccttaggatttcaaacaatacaagaattgatctaataaagttgtttggagtttcctagggaaaaagcacgagaattttgagagaggaagacataggaagattcccatgaggttggaatttatgctagaaaccctccaaaattctaatgaattgaggcaattcataagaatttatatggttttgagatgaccactcatttgttccaaagatatgcatagggactatttccaccggattcaaaatctccaaatatcctttgtttcaaagaagcccctatatggcgcatactgtaatataagttgtattaccatagtaatatatgtggttgtatcagaaacagcttctatttaacagttagctatgacatgagcttttattgttctaaatttcaagggatagcaagtagtaccactgtgtgaactacgtattagttagaccaagcacaactagttgttgcaagattttgttgttgtagctgccagaaattgctttcagctagcttctgcgtccaaccataacagtttttaaacgtagaaaggaagaaagtcgacccaccatattatgcgcatttgtgctgtaagcaccggaacaaaaacgcatcaagttggaataatcaagttccagacttcctgttatttggcaaagtattgacaaaagctggggtaacctgacctgaaatggatcatgacatcggcacaattaaagcccacgctttgttgtcgccacctacaaagtacgcttatgctgcaagtgcaaattaaaggatattactgtcacttccaaagtaattatgtcacgcggtagtgacaaaagctggagtaaattccgtattatcgcgcagtaagtaaccagtagtgtgaagaagctgtggccggctgcgatagcgatgtgaaggtgaagccgctctgctcaaaacaatccagcagcaactagcagcagcgagtaagttgatgggaaaacaaacaaattcagtagaacatcaaatgcagcagcagcagcttgtgccaatccaatccaggattaggtaagaatagcacgggatcaagtggacaaatcggacagcagctgctgacccaaaagatcacactgccgagtcatcccaccttactatattgtgcatacatcaatattagcagcattttttcatgccaactacagggcttaccacttaatcagagtgggtccttgcatgctcttatgaaataaataatgatggacgcatatcacaagcactaaagccaccagagcgtgtcattatcagatcaccggatgattagcacagccttgccaattatcagccgaccactaacttgtgacatcataaaccacactaacgataaaacttttacagtgtaacaaaagatgtgatgtgaagacagtttttcaaaatttaaagtactattgcttccgttaaccttccttcacgagaacaacaatgaatcggcatggcacatcagaaatattcaatcggttgatcgtcgtgataacaacgcttccatggctttgaatagtagtttgcttacatttgtatgcacgttccaatttttttatactaaccttgaaatagcacttacgtagttcggtgttgattttggcacataccgtacaatacaatattggtagatgacgactggcaaagcatttcaatacaacagcaacaggttcgcaacaataataatgccaccgtgctactgctcatgtggacactttctagatgaacaagtaagcaagagttgctacacatgaggttgtataccagaaatgaaaattcccaatttgatgtaaccagaagacctatgaaatagcttaaatggacaagatagagatctatcagtcccaacagtacgcagattccagtttatgtaattgcttaaaaaaattcaacagggtgttagactgttagttcacctaaggcattctgctaaactgctgccaaacataataaaagtgtccattcgtctcgagcaaactagcatggcttccccagactagcgaacatcaagaacacaggtaaataatactagggagcatgttcatgtacagagaaaaccagacataccaatttatagctttcagatcttagagaacattttgaaacagggaaaagatgcatgaaaattgaaaaggctcacaaaatcagaactctcataactttcttatttcagatcactcaccagctcagtagataccagaaagtaaccatttaagaacaataaaacagaaacagtgaagaagttataacatagactcgcacaaaaccaccaaattttacaagatgtatttagctcaatatcattaacaccaaactgtggtttagtagaatctgaatatctgatgatattcaggaagatgtgacatgcccatagatctgccaaattttcagggatcatatccaaatacatcttgtaacatttcatattcagtgaaaggcttatagcatggcacagcaacttg

SEQ ID NO: 55731 - DNA, 2783 bp, Oryza sativa
  unsure (1)..(2783): unsure at all n locations
tgcaattgcagtatggtcggtcgaaattctggtttctatggccaaaaaaatctttcttgtgtgcttctctcccactgtaaatatagccactgaatttatggtgcaggctgttcaattgcaaaatggtcggtcaaaactgtggtttctgtacccaaaaaaacttgctcgagatggaaacacccagaaaaatattcacagagagaaagtacgttctgtctaaacagaagcggacctgtacctctcgttcttttgggcctttcggcctcgtctcctccttttgggctgtctgtactacgggcctcccctggttccttcagaaatactgggcttactgttgaggcccacaatactacaagaatatggtgagcccatcttagcatgggcctcatttttttcctttcaaaaacatctagtagtaccagcagcagaataaattcagtttctgttctttttgttgtagtacaactttgactcagttggccacttggcaagaaataattctggattttgaatcattcctgtagagagagctggtgtacggtgcgaatgctatcctccatactcgtttttttttatcatattctactccaagaaaaactgctatagctttccccccatatgcgacatcagtactgtatgcacgggctggcggtaaatgcgaaaagggtaccacactaccactgcatatgtgaagcagacacgtagtagcagcgaccctgcagctgcaaatgggcggcacatgcttatatttacaccgccacaacagtaacgtgagttgttggtaggataattctagagctccatcggtcagaagcagcaatgaacccatcgacacaacacgtaccagattgcacccaaaaaaaatcgcaggatctagcgatctcagatcaaacacttcgagaattacactaccaagaactcgtacaacaagagaggggtagaagaaatactctctcgggctttctctctttggcaaagcaaagcaatcccaaaaggaaaagatacaaacatcgtcttttccctcgtctttttcttcagtccgcttacggacactaataatggagtattaatctgcctttgcaaccacaaactgacggcgaacgcatccacacacgccacggccacgccattgtaaaaagagattcacatcgagctagtaatatcttattgttcataaaatgcgcttcatctctaacctcgctctaatacgggacacgctagctaatacaattactactagaaagctgcataaacgcacagctttatcatcaactaacttttttttcgtacgtggagtacgtaattaattaactcgatcagcacaagcccccgccattgccatggattggagcttacgacgacgaggcgcattgctggcgccggaatccgagcctctccttctccaggtcgtactcgatgtagtaattctgctgctggaagctcccaagaatgatcgccggcccgccggaggagactccggcgccgccggagctggttgggacgtcgctcaccacggcaaggcagatggcctcggccatagccggagcgccgccgctcggagccggtccggccaccacgaagtagttctcgacggggaggttcatgacggagccgcccttgaagtggagcgacatctccggcagctccatcgtcttcgtccccggcggcatcgcgaagcaggggctgaggccgaggccctcctccaccaccttggaccggctgtacctccctcccacgggcgcgaccaccgccgccgccaccggctcgaacaccgtgcggtcgaagtaggagaacgtcgtgccggagtcgacgatggcgcctcccccggcgcccccggcgacgaacgccctctccggcagctgcacgctcttcccgcccaccgtgatggcggtcagagccaggtagtagtagacggagtacggcggcctggcgctcgcgctccgagccaacggggcgtactgcatcccgacgccaccgtctaccacccgcgccgccgaggatcagctcgccgctgacggcggcgttgtcgtcgaaccggcgagacaggaggcagtaggagaacttggtgaggccgagctgggacggcacagacggcgcgccgcggccgaaaccggcgaggccggacggcggctggtgcacggacgccaagctgcagccgatgacgaagttcctgacggcgcggccgggcgtgcgcagcgtgtcggagatgagcaggccggcggtggatcctgagccgtagacgacgaggtagggcgggcagacgttgttggcgttggcgttccgtggcgtgcagttggcgccggggcaggaggaggcggcgcggcagtcggagaggtggtcgggggagtggatccagaggcaggaagggttgcggcagccgatgaggcgggaggaggaggagttcttggggtggaagacgtggaggggggaggccgcggagagggaggagcagttgcggcactggtaggaggaggtgcaggggacccaggagaggtggctgccggtgtcgaggagcacggggaggggttgcggcggcgtgccgagggagacggtgaaggcgtagccgccgtaggagtgcgggtagagcgaggcgcggacggacggtggcggcgcggttccttggcgcgagcgcgggcgcgggcgggcgaggtgcgcggcgcgggcgagggaggcggcggccaggcgggagagcgggtgatggtgggggtggtcggtgtcngcggggacgggcgggaggttgcggtatagcgggagcgtgatggcggtggagaggagggggagga

SEQ ID NO: 55732 - DNA, 2752 bp, Oryza sativa
atggtcggtatcggccatgccacgctttcacgtacacttgagccgcgcgtccacagaaacatgatggatagtaattagtgccaccaatgcatgtggcacgccctcggatgattggatagtagcgcacctattcctcccttccagacactagaagcgtagtacgtgccctgccactgcgggttcttatcatcaacaccgccatgtgatgctgctgacgaattcatatgcgatgcttctgctatatgcatgttcttctaccgcgcatctaattaacgtcacccgtgaaattagaaaggattaattcatccgtcctccgccacgactgctgcaatgagtatcgccaccacacagtacaactgacacagccataaagacgaaatgatattgcaccttcaatgcacatctaccgcacaccccagcaacgcatctatcctagccagtctccatggacgtacacaaaccaactcgtacagtagtcatccttcttagaaatttcccgaggcgacaactatcgacaggcaggaaccgcagcttttgtttatttctctccactttcaccaattcaccatgcacgccttacttttactttttttaaaaaaaatatagtacatctttggatggacccgcgtccatcagattagatccaacggaccagatgtaatgggagctgctatatcataagatcccgttcgaacagtacagagatcggattttgatacctcatcctatcagccgatacttattggtatcatatatgatacttattgatattgtatcaatgctaggctagtactccatccgtctaaaaaaagacaaaccctgatttcattgcccaacgtttgaccttccgtcttatttgaaaaaattataaaaaaaaattaaaaatacaagttacgcataaaatattaatcatgttttatcatctaacaataatgaaaatacgaattataaaaaaaatttatataagatggacagtcaaagttggacacgaaaatctagggtttgtttttttttttacagagggagtagctgatacccggttagtaccacgtcagtatcttttttttctccccctcgatatgttctccgatgacaacgacgtgctgcccagtgacgtactacctccgttttttaatagatgacgccgttgactttttctcatctgtttgaccattcgtcttatttaaaaaatttacataattataatttattttgttatgagttgttttatcactaatagtactttaagtgtgatttatatcttatacatttgcataaaaaattttgaataagatgagtggtcaaatatataagaaaaagtcaacaccgtcatctattaaaaaaacggagagggtatctctcatctccggcgagagcgacgtgcccctgttgacgcgggactcttctccggcaagacccccttccttcccctaccttcctcttcggtgacgaaccctccacctcgcgtaggcatgcttcattgtaccggaagaaagcacatcgttttgccgacgagaagctctggatttgcaacaaaaggctggagcaaactggctccccaacccacacccttatggaaccctgcaacaccaagaacatgtcatacacaaaaacaaaatccttgaccaacgagcgctggggctcgccagcctgatcgccgaacgcaaccatagccatcgccgcccgtcgcaccgctcctctcctaccgtacaccctggagagatggggaagagagggagatggagaggagagagagggccgctgacatgtggagcccacatagataccactcgccatgtcagctaaaaattggtcactatattgcagatggaccaaaatttaacatggtattgtgaatcgagggatatgctatacattgtatttctgttgagggatgaagttcacactccgcaacaacttaaggggcctaaagtgaacttatttcgtgtgcatatgccaccattttctccgtgggccgtcaacgttgattcacatggcccatctactaggccgcagcccagcctactaaaccagtaagccctagctccgaacaacccctcgtctgtctctcttccccaaaccctccacccaacccgcctcctcgagcgacggcgcagccatggcggaagcagcagcagcacctcccgccgccgccgccaccaactacgaggtggacctcggcaacctcatggcctacgacccgtcgcatcacctccccgccgcatcctcctccaggtccgcacccatcgccgctactgctattgtgccgtgctgctttgattccgtgaccaagtttcccggggttgcgcgcagggaggagctgagggaggagtgcctgcggaaggggacggagctggcgcaggcggtcgccgacgccctcttcgcgctgccggccaccgaggaccgcgacggccccatggtccgcctcccgccgcccaccacccgcttcccccgcgagaagcatgtaagacccgaacctatcgcttgcatactcctctccaatctttgtgatctcccaagtatcatttgctgctgctgatctgctataatcatgtatgtggagccctaagcttagcttcactagtgtgattcgttcgtgtgaatgaaattgatacttcgatagttctccttgtatggttcacatggttctccttgctgacttgctgcggccataacattgagattctcacatgttcgtactgttattgagtcttgtgacggaatttcgtagttatgtccaacttgatgcagc

SEQ ID NO: 55733 - DNA, 6265 bp, Oryza sativa
agccccctactaaatgggagcagtttgcgaagatgaaaggtgaacttttttaaaaagcaaacgttttgttcttgttgttgcctaatattaaatgtatgttttctcattaatgtccatatgttctcacttctcgatggatatatgaatgctacttgcagggatcacaaagcacaagaagaacaaacgtgaatgggacgagcaaactcaaacctggaagcggacttatggctatgaccgtgttaatgatgataaagacattccaatcattgaagccaaggcgacagatggttagtaatttgtctttctttaactaccctcttctgtgacaaggatattaccttttcctttgttcaatagcctattgcagttatcaatgctacacactcttcttcttatatacaacattttatttgttttaaagctagcgctcgtacactactttagttgaccatttctaaatattgaatgcttgccctcaattcatcttagatagagtcattttcttttggggtccttgtttgcaatgacacttgttctgaaatatgcatgtctcctaatcctgattcaccaatctgataccccttttgttgtaacttttcgctacagagcctggtgttgatccttttgctcaaagaagggaagataagaagaagcatgttgaaaagcaagaaaagaacagactagaaaacttgaaaaaagcagccaaagttggtgctttgcctaggttgttatcctttcctagtagacattgtatttatcttgtacattccttttctgtgttggtaaaccaagagccttgtgtaaatctgcaacgtaaagtacatttgtacaatggcagctcaagtttttcatataatatgtctttttttttatttgcagtcatatacaacttgctgcaacagcgttgcctatcacgggaactaaagcagacatacccaaaaaatctagaaagaaagatctcgaggatgttgctggcatggcttcatcagcaacagctagtggtgggaagttcgatgaaaaattgcctggcgagaaacctccaaaaaatcctggcaaacatagaaaggtttttaatctgaagttccctgccttttatgtgcaactatgcaccattaaaggattttataagtgcattatctgaattgattcttttctgcagttcctccctgttgttgaaggaaaaggaatgggcaaccaggagaaacagcaaaatgacaaaatcttgaatgctctgctggccaaaagttctgaggatcaaatggatgttggcagggtaatattcaggattaaatatcttgaactaatctgtatataatttattatcttggtattgccatttgttgacggggtgaactaacagcatctatctaaaaatttgaaaccaggcaattacgatgtacaaggtgaagaaggagaaacaaaggaggaaagataaggaaaagtcttcttcatcgaacaagctgaagccccagaagaaaacactcaagaaatcttcgaagaaaaaggcttaggttaattacattcttcggacctgctgtaggaggtgagcatagttttcgagactcaaggagaattggcaaattttgctgtctgtttgtccaatttgaacacatcggagaaatcttgttattgcaattgttggttatgatgtaagaacctgaatgctattataacatggttgtcatgaatatgcaatacatatgcattataatttcaaaagttctggagttcgttttggtaacttgttatcaatctaaagcaaggaacagttttctgatcttatttagttcttggattttggtaccgtgtaactgtgtatgtagtacctagcagatattttttatcctcacaattacctgagttgaaattgatatgcctataattttctagtaaggtattgaatttgcgaaattctattgtgttgttaccaagctactgtgtcgtccctctgaattaatctcaggaccaccacgcataaaacatgttagatttgacctccattgtaaaggtgaacatttgtctgtgtgtgcaaaatatggtgtggtcacgacactggggagtagccagtaggggagtagatcagtagattagggatggtggtggtaccagttcgaattaggctcatacaattgaacgacaattcgctgacatactaccaacctcagatttggtatacaggaagcatgttgttgagattctgtgttaatttgcactagtggtagaccagcatgtctgtgtgtatgtatagttgattgcttattccttggaacagcatatgatttgggcgctgtttctgcctccccttgggcagtgttgcctggtccttgccattcattgtagcctctcccatggtatcttttcggttgtagggttggggcgtttgccagtagagttcgccgctatcgcccccgtgatttcctcccaggatgccaccaaaaacagtttgctttctgctgccactcatctatgattctattccagtagccaagttatcttgttagcttgtggagatatccttttgttttcgagagaagagaacatctcaaacttgaaatctgcatgcaactattaaggagatcggcctggggatcactggttttggagtgtggaggagtgcaagggcccctgttttttttttctttttctttttctgatgatcgatgcatgccatgctgctatagctgggccaagagctgcactgtttcggctaggctgttgtggtttggttgaggccgcatcaaacagtggcgtcttatatattggtgcgcccacacatgcaaacaaatttcttgagcccggcttcgtggtgcgccatccaaatcgtagtgtctccattttggcgtctttcacatgcacaccctatcatcctttcctttccatgctcaaccaagtcatgggtaaataatatatacggccttcagttaaaatttgccaaagttgttttcttttcttttagaaaaaacacaatacatacgtagatgctcgtataaacacatgtagctatgaacatacacgcacacactatctctataagcacatctctgaagttgatttgagcgagctagttaggttattgctttgtttttcgcacaacactcaaatttgtcgaagttgataggcgtggggattttgaaatgttgttacttccttagactacccgcggccatttttggcgcgagtggcaggtagtctgcagagttcactgaaagagtgaagcagtacatactactagctgccatggcatttcaaaatgaacttctgctgcgtctgagccatgagtcctgcgttcctgaaccccagggtgcatgagggagtagtgaatggatgaggcagtactacttaacagtagtatacccgcatcttacaatagagcgcgtttcgcgagaatagcatatttttggtatgtacgtatgtcccgtttaaatttcacgagaaaagtatgttcaattccaatgtggaaattaacatgaacattttctcacgatctaaattagaggcttaattagccctcctttgaaatagaggggtttcaaaagttcgtaaaattactgttctctaaaggagcccttgtaagatctaagatgaatttgggcatcatttaagaacactatatcacgaaaatcttttttttgacagtgcaatgtctagcgcaagttgttgataacatgatggatagattatattaagacgatgcaggagagaaaacgacgggtaacaactagtgcacgcagaatggagtacgtagtacacattgacatttgacaggtgaggacgaaatctcgatctctcgcggcaaagcagcaatatacagcaatgcatctcactccaacccaatcaaacacacacaccagtcaacactgctacagcatcaatcataccatggccatggcatacattatgcatgcttccaagatcaatcaatcaaacgtagtctctcgcttaattgctctacctagctagctaatacagtagtaattattgtgctcatggatgagctatagccttagcttagttaatctggctgcctttctggagaggcagctggaaggcggaggaggaggcggtggcggaggaaggagaagacgcgagcgccacgaccaagtcgacgaatgctccgacgatgaagccatgggtcttcttgccgttggccctcaggtaccagccgagctctcctccagccacccccagtcatggcccccgccactcatgtggctcatcaccatctcctccatcgaccgccggaagtctccgtacgggtcggccgagtcgatggacatcgccgtcgccccgtcgaacgccgccgcgtcggcgtcgacggcgcgtcccttgacgacgatggagctcgtcgactcgggctcgaagaagaggcggcggttcgacgaccggagcccgcggatgatcacctcgtcgtcgtcgtcgacgacgtcgttgacggcggaggcggcggaggagtaggagcggcaggtggagtggtcgtcgaggaagaaggccgggttcatcacgctcgtcttgtagacgcagtagtcgtcttcctcctcctcctgctgccgccgccgcttgctgtcgtcgtcgtctgcgcttgctggggcgtcgtgcctggcgaaggagagcgtcctcgcctgcgtgcacgaaggccattgccacgacgacgccgtgctcgacgacgacgacaggctacaggcatcattgccgccgccgccgccgccgccgccgccgaggaagagagaggcaacaagcttccgaaccatggctagctaactcctagctagcttacgtgcagctagctgtgtgagagtgatcgatcaatggatgaagcttaagctaggctatgtcggatgtcgctgtaaactgagttggccttttggtcggagcgagctgcgcttagctgtgcttttaaagaggctgctgcggcgtgtgcaagtagctatcaaagatgcgagcgagcgaaagcctgtcttcttcttctcttgcattgcatgttgtttaattaattagcagctacctgcacttaacacgtctaatctaatatgttagctacccatcacacacagcttaattggcagctactgatactaatgctacttaattataactgaaacttgtatgttgtcggtttacgctgcaactggagcataaaaaaaaatgtacgcatgcaggtaaggtaaggtaccaagtacgtaccattttgtcattttgagaacgcagatttgcagtcgtggctgtatgtatgaatggccagcagcaaacagcatatataccacattgatacggatgaattacatgaccgggaggtggaaccgcgcgctaattaattaattatatcatgtgtaatcgcacggccatctgatccatgttttcctgtattttataagaggtagaagttgctagctagcttgatatctattaattatacatgtacagtttagtccactgctcgcattgttctctaccagcaatacacgaagaaagcgcagcgacgtttccctgacacacaattgatcgaaatccaggatcacacgcaggccggtcaggcagcagaaaatgctagtagctctatagtttaattccccttgtgcatgcgtatcagaaatgaatactacatgctgctgcgatggtggccgacttgtcctctatgattgtataaatggattggatcatatatatattgattcatatatagggtggatgcggctgtcaatgcaagaactgtgcagccatgcatgcaggagggaggaggtgggggacatgcaagcggtgtttgctgaatttctttttgcttttcatgtgtacttctccgtgcctgatgcttgagagaattatttgaacttgccaagatcctagcttagcccatctgtcatgtctcgacctacctagctagtctcacccagtcaattaattaattggatgctttagtttcttgatctccctaagcaaaatggtttgcacaaataaactagctgatgaactcaactgatgtttgtaattagataatggtgatcaactcaactgatatatatagtgatatgatatcatctttactagtgcctgcaggccatgcactgttttagcctttagacttgagttcagaggtaatgacggatgaatagagtcgtctgaaacctatgtcttctcatgaagtttaatgaacagaaatggcagtacataaaggcaaagacatgatatcagaaatactaaatgcgtttctctgatgttcccgtcctgattttgtatctatggtcgcgacctcttgtcgtaaacttccttt

SEQ ID NO: 55734 - DNA, 873 bp, Oryza sativa
aatcattttatcatcacttaagacagaatgtaaataaatcattataatttaatttacaaactttaaatttgtcgtggattaaggatatggagttttgccaaaacacccataaatcaatggagtaagatttgtaggagtattttgtttgcaaattaatattaaaaaaaataaaagtaaatttcagcaaactataacaatagctgatgattttatcataaaactgtaaccgtaatagcttgatttctctaggcttatttgctaggcacgcactcaaaaatacaaaattatgtcaggccacatgttagacacacaccgttatggtttactctgaataaagctgtagcaaagtgatagttttatcaaatggaatttactcgaaaattaatcagtgcaagtttaggggaactactactaccggaggtcactgcccggtgggccaggcaaagagagaaggagatggaaagcacggcgggcccaccgtacagcgagccgtactctgattccaccctttccagcgtccgtttgtccaatctccggtacttgcggaaaggactggtggtccccacccaaactctaactctccggcgtgcgcccctcccgccgccgtccgattgctccacgatgaatccagaccgtccatctcgccccccggaatcggataaggacaccccctccgccgccacgcgtcgcgtccctactggatgcagtaagaagctatatctcctgtggcgcgacggcgcagaagatcctcctcctcctcctcctgcttccattccatttttttccataattccattccaccaaagccaaaaattcataataaaaagaaaggaaaaaaaagagaaaaggaaaatctccctcctcctcctcctg

SEQ ID NO: 55735 - DNA, 890 bp, Oryza sativa
tgcactgcatatgcgtcgtcggtgtcataacgcccgggccgctccaccgacactcatctcctctcctctccctcatctctgttcatcgtcagccactgatcgaattgattagctagctaggactaggaggacataggttcagtgactaattacccataaagtttgcacaggatttagccagtctgatcaatcaatcaacgtcaaccaatcggctaattgatcaattggagtgcggctgcaagctgatagtgtgatcgatcgatgcataagctacttgtatgtgacaatcaatcataagacgaaacacgcgagcattatctgacccacgaagaagaacacagacaaaatgtgtcatgtcgtacgcgtacgtggaacaaacgacaatggatccagcacgtatatggagtgtaaacgacaatggagtactccaattagcactgcagtataagcatgtgttcaaatcgtattagtattaggactgccattaattaaccaagctagtactgatttttcttttttgaaagatcggcattattaatcatcattaaagttggtattgtcagagcaagcagctggctggtagcaagatctgccacggtggcgtcgtgagttatccaaatgagataagcatagtttaacagctgagattccattatattcccatgctgtcatgctgatgctgatatatagtactccctccgtttcacaatggaagactttctagcatttttcacatacatatagatgttaataaatctaaacacatatatatgtctagattcattaacatctaaatgaatgtgggcaatgctagaaagtatatgtctagattcattaacatctaaatgaatgtgggcaatgctagaaagtcttacattgtgaaacggagg

SEQ ID NO: 55736 - DNA, 849 bp, Oryza sativa
ggtagtgcgcctgtgcgctgctcgtgtgttagatggcggggagtgatctcctccaccagggaaccgtgaagcccccctttgtgagttcggccgggggcagcgtgtgagattctagggcttggtgagcgaagctgtgtgatctgagggggttctatcccccaaagacgatgagacaaaaaaggtttatacaggttcgggccgctaagtagcgtaataccctactactgtgcttgattgattgagtgtagaacacaagtgctcggggttgcgagacccaagtgccggttcgctcggaagtccccccctctctcactaggcctggacctctttttatacctcaaggggttaccacattggcccaacaacctaacttcgtcgagaagtattacaatctttgcattaaatgcatgtcttgttccttaactttgaagctgcatacacgtcgcctcggtcgtggggcctaccaaaccatgccgcctgacacggggggcgcccaagtcattcaccatttaatgggtgaagacttctgggctcctattacaccaggaaacgggagcctagctttgatcagagcgggagggccgactccggctgggataagaggatgagaacctctcaccatcattatttgatgggacatgtcaggctgcacgccgcctgacacacgagcagcgcacaagcgcactagccagtcccatcggtcattcgaccagttacagaccagttgagtacactgcacgccgcattaaatgtggcgtgccgcgaccgctcgggtcgccataaatacgggtaggtaggcatatgtaggcggacacctaacccaccgtacatggtgacctagagaggggg

SEQ ID NO: 55737 - DNA, 1155 bp, Oryza sativa
agcgcttcggctacgcccccctcgactccttctaccagtccaccgaggcatccaccaagctctcccccgccttcaagggccagcagccgctccaaggcgacatcaccgccgccaacttcaggtcgcagcagaccgccggcaagttcgacatcgaggtcaagctcaacgccaagctcagggtcaaggtctgggccttcaaggttcccggacccaaggccaagatcagctgccccatcaccgtcccagcgtccgcccccaacgcccccgcattccagcgcaccgactgcaaagtctggttctgatttcgatggttggttccgcttcgcatttggggattactattagccagcactgcttccagtatggacggatggattcttttgtttctttcgatttgttgatgagggattagctcgccggatgttgctgtacatcgctgtggtttaggtggttacatatcttctagcccttgtagctagcgcttgtcatgcacatattatcgatccatgtcttgttcttcttagttttttcccctttcttttgggtacggcttacttactgctgttcagatcatatatgactgtatgttggttgatacattcagagattttattcaggatcacctattacttctatgagtgacatctattatgattccttggttgattctgagttgtgccacttattacgagtgccttcttactgagataccagtgttcaattgttcatacatcagagcttctctgcttttttttttcatttgttggattgatctttgccacgggcaagccgtgacgtgatgaaattcacaggtcaggtgagcaccccacataatcgtataatgaaaaagtttcaaaactttaccttcaaaagaaagaaagaaagaaagaaaatcgtttgtttcagaaagagcatctccttttcacttttcagtgcctctcctctccttggtgctggtggagtggtggatggatatctatccaagtcttgccgaggattttcctttcttctaatggttggaactaatccaagtgtgggcgtggtgacagcgattcttttgtgtttttatttaggtttgcgtcgttgtcatccaagcatagagacacaaacaacatcgtcgttttcattgacggatgcactcgcgacaggccagca

SEQ ID NO: 55738 - DNA, 14686 bp, Oryza sativa
aggtatggatcttaagtctttgtccatcaagtactgtgtttcgtatattttaagctaatgatctcagtagaagttgatgggtcttgagtgatcaatgatgccgcttagtctcttacagattctatattatgataaaacccacttatgtgtatttcatttccctgtttttgcttatgatttcagctcttcaagaatcttgaagcatgtggtcgtaaacctccaagcaaagatattgtacggaaagttgaagacacatatgaaatgcttggtctagtagaggagaaaaaggaattgcttgagaaatacaaggaattgtttgacaagccatcaagtaatgatagaaagaaagggcggcagttcaaaaaggctgagaagaacacgaaaaccggctagacatgtagtgatgcctgcacctctaaaatctacagcatcgagcttccaggatggcataagcttagagcttcacagtgcaggttggaaacatctgaatatctgccagtctcttgcccttgagtttcacaatgcaagtatgtatcccccggaaaaaaaaaatagagtatgtacggtagtacagttgttggaatataaagctgtgatcattgtttcctacaactgtcgcttcaagcattgttgtcattccttttgcctccgtccagatttgtttctgacagtgtatccatactcagatcagagcctgatgtgatgcagcaagcaatggtatttgctatgccctctgaatgttaatacatcccgtattttttaactgatgcttccaacaaaacactgctctgaatgttaatacatcccgtgttttttaactgatgcttccaacaaaacactgctcgtgttcaatccttggcacatttgttattccgtcttcctctgtccagatgtgttactgagcgagcatccagaattacatgagaacctgatgtgatgaagcgagcaaattgttggtatttggcgtgccgtctgaacatgttctcttgttatttgatgcaaccattggcacatcggttaatgggccaacccaagaaatatatatactactccctactccctccgtttcaaaatgtttgacactgttgactttatagtacgtgtttgaccattcatcttattcatatcatttgatttattgttaaatatactttgatgtacacatatagttttacatatttcacaatttttttaataagacgaacagtcaaatatgtgctaaaaagtcaatggtgtcaaacattttgaaacggagggagtagctcgctgagccagccgattgatctgtcaatctctatgacaggattagttgagatggaatcgtattcgctgttgtctcctatttcctttgtgtacaagttgtgcaatctacggtgtatataatccgattcaggaggtgtgcggctaatataatccgatacgatttcgaattcacgacccaagagtttgtatataatcggatcgaggtgtgtacatctgatttgtgttgaagatccaagagtagctagcaacctgatccagaggaagacgaagaacatggcgatgacggaggaggagatgccggcggcgaagaagatgaagatgacaaaggaggaggtgttgctggcgtatctgtcgcgcgaggaggaggatgggaagaagaggaagaaggtggtgaggaggctggggaaggaggaggtggagaggctgctgtcggtgacggtgacggtgaccgtgccgaccctcagcgaggaggcgatggaggaggacgatgaggacgacgaggaggatgtgcgggagagggagatgctgctccgagccgaccggacgctgagggaggccgtcatgagcatgcgcaaggaccaggacctcatccgctccctgttcgaggccaagggctacgtcgacgtcctggacgaggtctccgacgacgacgacgacatggagatggagccgttgtaacataacttcacctgtaatctgaaatataccggaataaaacacataccagctatttcttttgattacggatttaatttttaagtagttaatatgatattgatttactagaccgtcatatcagtgtcacgtaggacgatggagccatcatgtaaactgctaagggattcgatttacactagttttaatagtcgatggatactcttctgtggttgagggatgaaaatgaaagttaagtttttcctaacgcaaacagcgctgattttttttatgtaagcacatgcatacaacctagtaatcctatctttctataaagttaaggccctctacatcctaaagctcaacatgcaaagatgctacgtcatccgctaacatttactacatctcaaatctcatgcaagcatgctaatttattaagttttagagctttaaaatgcaagcatgttaattaaattatcatcccacataattcacataatatttcaatatatctctccatcactttttataatatcctatatgcctatatagttcatctcacttaaattttagagctttaaaaaattcaagcatgttaaatcatcattccacataattctcaaaatatttcaatatctctctccaagtctccatcattttgtataatatctatgtacctatgcatgttatttctctcttctgtcattaagctatatcatctcaattgtttttagccctcaaatgattaatctatggttggaattatctctcttattttcttctctcataaaaccacatcatattacttttaaaattaggtcattattctatataccatttaaattatgataaaccatatcaacttatgcaagtttctatcatctaactatattacacattatttatatttcttaacatcataccaaactcccacagcaacacgcggggtttcacctagttacaaaaatgagcatgcaacaaccacatatataggcaagacgctcaatgaagcacggtgcatccattgatccagttgatcaacaaactattggcccgctgaaaacgttagcgcaacgaaccgcgtccaattggttaattagatgcatcattacgcgagcaaacatgtttaagcatggtttgattgtgttgttttcgttttacaacttattgtagcatatgtatttcttacattattttctaaaacagaaaacattatttcttaatgtaaacgaaaacattatttcttaatgtaatccgagtattgctattggctgaaagagaaaaggagaattaatactatcaggctgctcgcactttaaaaaccacaaaacaccccgcaaaaaaaccgcaaaacaaatagctcatgaacttttgttagaaccggatattgacagtggtcacgtgggtaggttggttagaattagaattccaaacaatacgtgctgtaattactgggctgcgcgcatgtgtcagcgagacacggaccggtttgcaggaggacccaggccgagtccgagtccgatccattcgtggtgggctggaccgagtcggaggccgggatgcgaaaggcattaaaggcggaggcggtgtcgaactcgaacccaaggcccaagatacaaagaagaagaagagagcgagaggagaagtaaacccaatatgtagctccaaggatggcgtgtaggatcgaatcacaagaattaaaccaactagatgggggtgaatggttggtatacccaaaaaccaaaaacttttagcggaaataaaagttaccctcgaaatcgacggaagtcggtctgaccgcccgtatgtcgccggtctgaccgccgcttgccgccggtctaaccgctgaaacccggtaaacacaaatcgaagaacttttaaagtggatgacgactttattgattctctctatgtttacaacgtgcaccaacagcactccttacaaaaatttcgactaaacttgaaaccctaactcaaaactcaactcaattgctctcaaaagcgataccgggaagcctcacgctccccctctatttatacatgaggtaggcagcctaaagccacgaaccaaactcatactaagaggcctaaacaacttaggaaaccctctagtacaagaaagaaactttacataaccaatcgtaccaaatttgaactccttccaaattcgactccgtatcccatacgcacataataactccatcgtatgccatatgaaatctccatcaaccacgtgcatcaactctagcctaagtatcccgcatgatctctgatcaccacggacgtcgtcttatctccaagccgactccctatcaatcaccgcaaatactctcccgaggcatcgagtcacctacacatgaaataaataaaaaaaccatattctgagaccaagttatctccaacttgactcattagtagcagacaacagtattacatacgtatagtattcatcgagaagtcataatcatgaaataatcacggatatccaaacaaacaacccgaaaccgaaaccgacacagtgtcggccggtcagaccgtgggctggccggtccgaccgctcgatcaccgccggtctgaccggcatacacagcccggtctgaccggtcacatgaaataataaaatcctgcgattacctgtgaatccaatcatctccaaaaccacttcgtgaataaattccaaataacaaaaccaataatctccaatgtctaattgttcatcacagaataataatcaaaaatacctttgattttatatggcgatgatgagggggtgcgccgatggggagaagcggcggccccatttcgagctggtgtcggcggcgaagaagaagaagacgacgacgacagaggatgatcatgaggaggtgttgctggcgtatcggccgcgcgagaaggaggacgggaagaagaggaagaaggtggtgaggaggctggggaaggaggaggtggagaggctgctgtcgttgaagctggccgtgccgaccctcagcgaggaggtggtgatgcctatgcctgacgacgacgaggatgatgtgtggcagaaggaggtgctgctccgagccaaccggttgctgagggagagcgccatcaggatgcgcaagaaccaggagcttatccgctccctcttcgaggccaagggctatgtcgacgtagaggatgaggtctccgacaacgagatggacatggacatgcagcttgtctaacataacttcacttcacctgtaataatctgaaatatatatatactgcaatctggaatacatacgggaaagttctcttaattgttgtgttgggccctctagtgcaataagaatcatgatgtggtcgacttttgtacccatgaaggctcttgaagatgcaagtttctgctttcgaaaccccgaaagatgacgatcaaacactatatgtaccgtgcatgtctgcccgggaccgggaggctaaagtgtgtaaactactcctagctagctagctagacgcgtttaactggagttccttgaaatatcatctctgatttaatttgttcgtacagagaattgccaaattcttaaccaagtgatctgctcatttctcactgccaattgatctgctttgcaagtttgagttttcttaggtgtgatgtgtgaagaggatctgcttgctgtatacagttttttttctctttttcacggagagttaataggtcccttaaaggcggaagaggatcctctcatttacttccctatgacttttaagtggcacaagttagtggaaagtaagttagagaatcttaatcccttaacagccatgacctcgaaagagaccattaattaattgagttccactacgatactctctactagtattacggtactctctactggtattacgaagcaatctaaaccgtttgtcccatttgattaaagggttcagatttatttataatatcaccttaggtaatggtaaaccggtagtagaaacgtgaaggagcattattataaaaaaaaacggagagatgcaatcgtcattttagcagtgactaaatcttttttttcttctttagctttttttatgaatatgggcaatgccaatgtaatggatggccatatatcaatctagacgggaaaaaacatatgacaaagctatccctaattattatattaataaattattgatttacccttaataataaggcaaaattggttatatgcctaataatattgatagtattataccactaggagagagtataggagcgctctaattaattatcatgttccatgtagtacgtcaatacaattagctagactggtagagaattactacagttgtttcaattcagtaacacgtacttgaggacagcacaaattaattaatttcgatcgctgcagttcactgttgaaaagttaagaatgtactgaccatggccatgagcagaacaaataatagtctctttggcctaacaattactaccaatctctaatctctcttttagtactactagtagcacagtctacacagaggaagtgagattcagaagagcaggagtaaatgtactaagtatttactccatccatccatccgtcccaaaatataagacttataattaattttcttacatagtcttatataatatactttaaccattaatacatttcatgttaggtttctgacaaatatgaaattagcctcgtatgaaaaatcttcaaaatataaatatagtgatataacgtacatatataatacttaacataaataaatatagcctaattttattttttttaagaaaagggagcgctctgtaatttgggaggagtatttatttagacaaaggaggaagtagtacatcacatcaattaagcaatagagcagggagataaaatagttagtatgtttgattaacaatggggaataaattcatttgaggtctcttaattttacacttaatccgattttcatccttgaacttcaaaaccagatataaccagtccttgaactttcaaaaccggtgcaaacgagatccctcggtggttttggcttacgtggctggtttaactaggtcttcgtcccacgtggtattgatgtagtgcttacgtgccaattccatcctagaaaagtaataaaaaccgtggtcccacatatcaattaaacacaaaaattaataaaaaaaaatggtggaacccacgtggatcctacatgttattctctctccctcttcttcctcatcctcactcctcttttcttcccagccatggaactagctcaccttcctccccattctcgcgtgcccgcggcgggcggcccgacaacatgaaggttgtggccgtcctcgggtgcttctcctcgcgctgtggcaccgcctcacggtcgtcgccgctgccgttgtcgtcgtccccccagtccccgccgccactgaggacgacgacgacgccgccgctgataacgacgcggggtcatctgggatgacgcagccacatggaccagcacgaagttaacgaggtctccatctcctccctttggacgcatggcaacaagaggagaggggagaggggagaaggaggcgtcgtcgtccttgggctggcctccgattgctcagcgtcgtccgcgccgccaacgttgttgtcgttgtcctcagccgccttgcctctcgcctgtgctccgcctgccgcccgccctagcctttgcctgctctggccctcttcttgcaggagagagaaaggggatagggagagaacaccgcggcgcgggcctgggcgctggaggtgcacgcgctgtggaaaggacctgacgtgacgctgtgggtggcgccggccgttgcggccgccccgcctcctccctcccttccctaaccccacacactgtcctcctcgcctcatccctctccggccgccgctcgccctaccctgcccgatccgccccgcccatagcccgctccagccaccgctcgcccatgctctgccagccggccacaagcagggggagaaagaggatagagagatactaagagagagagacgaggggagagggaagaagggaggtgtaacaccctgaaaattcgaccgacaaaattaaaactctaaaaatgcgggctttcaaaaactttttaaaccaattgcatcatgccgactttattcgcctgtttcattggattttgatgtcggagtctattaatcgcgaataatgaataactagctaggaacaaaccataaaagaaaatctagttgactaaataaataattaaaatataaattaaaataaaggttaggtgggtttggaaataaataaaatattatcgcaaccagattagcaataattaaattttagtacgatggaataaccctaattaaaataaactatataaacagaatatgagtgatattaaattaaggaggattttagttaggataacacaaatgtgggatgtacttcatttatacaagatttagaaattatgaaatcaaatttactttgaaaataacctaaaatcgggaataataggaaagtgcactattcattgcccgcaaggtgttcgatgtggtccctagcctttccccttctctcccacctctcccctagcccagccccctcctctgccccgcgcgccgcgcgcccggccgccccgagccccgtgccgtcgcatcgccgtcgcgtcgcccgttgccaccgcgtcgccgtcccatcgcgccgcgcaccgactcgtcgccactgccgagccgtcgccgtcgtcgcctcgcaccccgtgccacgccgctcccccgagccccgtgccgccgctgttaccgcgccgcgccgcccgttccatcgccgcgcgccgtcaccatccggtcgtcgcgtcgcctcgcgcctcgcgcccgcgcgccgctcgcccgttccatcaccgcgacgcgagcctgccgcctcgcgccccgcgccgctgctgtgagccgtcaccgcgcgtcgacgtcgctgcgcgaccgtcccatcgctgcgcgcgtcccatcgtcgctccgagccgcgcgccgccgctgccgagccgttcccatcgccgtcccctcgcctctgccgcgccgcaccaatgtcgccgtcgccaccgccgcaggtcgccgtcgtctcgcgcctcgtgccgcccgccgtcgcgtcgccgcaaccgtcgcgtcgcctcgcgccgcgtgcccccacctcgcgccccgtatcgccgtcgcgtctctcttctcccttcccccccccccccttagctcttcccctcccctatataagcctcactatttccccctcttcccctccatctccacccctctcctctacccacactaccgcgccgccgcctccacgccgccgcgccaccgcaccgccgttatcgcaccgccgccatcgtgccgccgcgccgccgccctcgtgctgtcgtgccgccgcgttcatgcccccgtgccgccgccccagtgtgccgcaccgtgcgccgtcgtcgccgccgccgccgtcgccgtcgccgccgtcggtgagccgctgccccccccccctctttcttttgtcgccgagccgagagagaaagagagaggccgagggaggaaaaggagaggaaggaaggaggaagccgggagggaggaaagaaaggaaaaagagaaaaagagaaaagagaaaagaaaagaaaaaggaggaggaaagaaaagaaaaggaaaagagagaaaagagaaaaaggaaaagaaaatttaagagatttagaatatttaacatattagaaattaattataggattaataagaatatcgttagatgaactcctactatttaaaataccaaaagtactaagatttgattatagaattaattatttacgaattaaaacaattagatgaatcttaatagattattatagattatttttagtaatgtctataggagatcaattcgcggtaataatttagatcaattcgcggtaattattatagattattttgggtaatccctataagtaatcgattcatggtagaaattcggatgtaatcgctaggaattttagacgtatattatattaatcgtttagtcatagactaaattaaattgtataatatttctaggatttcgtccaatatttaactcgtaatagaaatttctaacctattatatacaatgctcggggaaagtaaattattgacaacgaaataattatacccgcaaagtagtttaaatcgaaattgggtttgccgtagtttgcagatagtaaagttaataaaaaggaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcccaattgcgaaattgttttgtttacaaatagaattgcatgcaatgatgaacatcccacttgtgattatgccatgccttgattattgtttacccttaaatctttgtaaccatgtttacgtatgagtccctagtcaactatgacaattgcttagaaatgctattctagaattatgcatactcatatttatcaaatgctatatgcttgggcaattacctttgggaaggtaattgagatgcggcatgtggagacatgagcgccacattgccatgatgttgatgacatgatttgtgaaaggaaaaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggagacagtatccctgcatagatggttcacccctgagtgaggcaggtgcgctacgatgggacagccgttgaggtagggccaagaggcgtgccctacatcggtgtcgccattggtaggactgccatgagtgtgtgagagagagaacttaacttgaaccataatttaatatgtgtgtgagacttccctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtacgggtaaagtgtacatccactgcagtgtgagtaaaccaaatctattcgaatagccgtgctcgcggttattgagcaccgggacatgtattacacttggctagactctaaattcttaacttgtgtgggatgggatattgcatggtgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggaactaaaatttgatcagtctatgataggtcttaggcttgtgaaaatatttgcaaaacgcagctttatgcaaaagaacctaaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttccgattttcaaaatcgggggtctacaggaggatagaggctgacatgtgggtccacggtttttattatttttccaggatcgaatgccatgtaagtgccacgtcaatgtcacgtgggacaaagacctagttaaaggagccacatatgcgccacgtcagcccaaactgcctggggatctcgtttgcaccggttttgacagttcagggacctggttgtatctgatttttgggttgaagaacgaaaaatcggattcggtgtaaagttaagggacctcaaatgaacttatttccaacaaatggtgagggtgtgggattgcagaagtagaagtaggaagatccatccgggtatggtctagtgggctggacttgtccgagtcagattacatccgagttagaggattccaaaaattaagcccagcccagaggtggtgatagagtcgagtcgaaccaaccaaaagaaaaagaagaagcaaagccccaaaatcgctagcaatggagatggagttagatggggagagtacatgcgctgctccatgcgagaagaagcggctgattaattccaagctatttcgagtggggtacggtctcagcgacgaagaagatgaagacggatgaggtgttgctgccttgctggcctatacattgctcggcgaagggaagaagaagaagaagaagaagaagaagaagaagaagaagaaggtggtgaagaggctggggaaggaggaggtggagaggctgctttcgtacacggtggtcgtgccgaccgtgagcaataaggtgctgggcagcgagacggtgcctgcacgacacaaggagatcctgctccaagctgtcgactccatcaagaactctgctgtcaccatactagggatggacaaaaagctcgggctcgtgagctcggctcgggcttggctcgagctcgttaagctcggctcggctcgaagactaaacgagccgagcccgagcttcctccacagctcgtttgcaaatcgagccaagcctgagctagctcgcaagccgctcggtaggctcgtcaagtctgtggaaaacatgagtacatgacctgacctggcccattaacaagttgtatcagtctggctcatgagaaacagagaaccctaccctaccctaaccgctcgccgaccctccccattctccatcccacgcaggcgcaggcacgccgccgctcgcgcgcacgactggcatctggtggcgactggcgagaggagttgccggacaccgcctccgtctcctcccctgcgccaccgacccgctgtctccctccccagtccctagtcgtccctcggtgccgccggcccgccgcctccctcccctgcgccaccggcccgccgcatccctcccctgtgcggctgcgccggctccggcctccctccccagcgacgcttgatgatcgacggctcgacgctctgtgccgccgcagcgccgcctccctcccctgcgctgcctccggcctccctccccggtgccgctcgagctcgacgccccctgcgccgccgaccctacttgctgcttacatcacaagccggctcgagcttttatacgagccaagccgagctacactttttgctcgttccatttatcaagccgagccgagccaaagcctgtttttgaccaagctttctcgcttggctcgtttccacccctacacctaggggtgggcaaaaaaagaccgaaccgaaaaaccgaaccgaactaactgagaccgaaaaattcggtcacaaattcggtcatcagttgtaactaaccgaattttacacggtcttttcggtcatctcgttcagttaaccgaataaccgaattgaccgaatcactatgaaagcccaatacagcccaatagcccattagctacagaaaaccttaacattccatcccgtccccacctccttcccactctgcccggtcctcccacaaccccacttgcgcgttgtgctgcctcttcctcgcgtttctcctcctcctctccgcctcttcgatctctgctttctcctcctcgcaccacgccgctccgcgttccccacccaccgcgccgccttcaccgcgcctccgccatctcctcgcgccacgcctctccgccttctcttcgcgccgcgcagcaccgccgccttctccccacgcgtctgcgcgcccgctccttccgctcttccgccacttccttcgaggctgatgggagacgcgagatggatgggatctggactttctggtggagtggttgagatcgacgggatccatggctggattgatttgcttgatttgattttttttccatgaatcatgctctacttgctacttgttggtggcatcatcatattttactcattcatcccagttgctttctcatcgatcttgtacagaggactcaaaaaattttttgcaattaatttttgtgctaagtttggtctataactgagaccgaaccgaactagccgaagaccgaaatgctcggtcttgagttttcttgaagaccgatcggtcttgtgattctaaagaccaaatttttcaaacaccaaataaccgaaccgaatttttcggttagactgaatgaccacccataccaccatacgccagaggcatgatgtcatccgcgcccaattcgaggccaagggctacgtcgacgtcctggcgaggcctccgacgactctgacactgaccaggagatgcatccgctgtaattactatagacgctgacaaactccactttacttgagcaagtttaatagtatagccaactattagctctaaatcatatatagccaatttatacaatagttgcttactatattattaatacctg

SEQ ID NO: 55739 - DNA, 3953 bp, Oryza sativa
attcctgcagccccgctcgtcgtctgctccatcctcctgcccctcgtcttcctcctgggtctccaccgccccggtacgcgcgcctgcctcctcgcctcggatctgttctgtaccttacctacatgctgctcacctcacctcctgcttgtcttttttttcttaactgtcagcagggcatggatcggaggagcgcgccgcggttgtcatcagcactgtacgatttcatcaacacattttttccccctccttctgaatttcatacatgctacatttcgaaattacttatttttttctcattcttctgacgcgcgtgtgtccttttaattaggaaatggggtttagcaagcacaagcatctggatgggaggatgaagcacaagctactcaaggtaatgctgcttgctgattctgcccattggctgactcataactcttagtcgcccagctttactgaaagcataagagtgcatacgaagtttgaaaagaaacaaaaaaaaaacttgctggggattccagcgaactgggaagaattttcccatttgatattctgtcctgccaattggaagatttgtgtgactctggagtaagaactgaccttctgaacataaattcccaaattttcaggcgggttttatgggtaggtttctgtagtataaggaaaaaaaaaaacaagacggcatcggttcatgcactctgcatgtgtgtgcagtgtgcttgctgactctttactgccttctgccttgctttgcaggggtattcactctacactgtaagccagggctttgttgctattctggtattaccaccccaaaattgttctttgccaatgacactgacaaatggacttggactgttgctgctgtgagcaacatttctgatgaactgcacatctttccattttaactggtcttatttcttttatgtttttcttttgggccttacattgttgccttgctttcctcctaactgctgttgtcacacctaattttcaattaacatgctgttgtgaaaaatatatctactaatttaccctgcggtacttgcatgtaaatgtatatgtcctgtgactcatgtaactgaaaactgctctacagcactgcagcagactcccaagtggggcttcggtcgaatactatcgcagtatgccactacggctatagtatatttgctattcgtgcctggtatcgtcatgttgggggtgtaacatatggattagcagttttgtactaaatgtattgtattacaaattaataccaagtagatgaatcagctcgtatgcgatatggtttacactgctgcctaaacttattttgaatgtgcactgctattgaaatgaatcacccatgccattttgatatttgcttggttacaataatctttaagagcttgctccactgacctctcaaatgattcctattattttggctaatctcctttttgtggaaccaggatgtttctagaaagaaaattcctggatctgatgggattttgggtgagaaatctggtagtagatcaaagtccaagaatgtttctaccaaatcaaaagaaaagctcaagggtgttttctctttagttcagctaaaaaatgagaccagaaaaaacaaaggtaagaaatgtcagatcagattttgcagtgtgttactgcatttactttgtaaaacaagaactgcaagataccaccagcatccattttatagtatccaatgttatttcagaacttcatacacaaagaagataccagttaaaggacttatcctggagatcaaaggtaagaaatagtttctatatttatttgcaatcttgaggattttaatatatgtgcatttcatcggtttggagtaaccaacggattattcttgtctgtgagcacagttagttataatgtttgttcttcttgctatgataagttgattagtaatggtattttacagtcaacaggatcttcaggaagacagatagtgaatgtgaaatatttgagtaggaacatttttttgatttccagtgtggcatcagtaataatgtacacatttgtgttgattaaaagtacaataattttgtactatacagttgacttgtccttttggccatatttcacaccttaaaaattgcttcttagatatctcactgttgccagtactttcaatcagttaagaatgcacatacttgacatagtttgcagcacagtatagaactgaattttcctctgaaacttagttggttgccccttttttttctgctgttactaagtttattatatggctcagaaccactgagtaattttatattactctgcaaatcttgtacacatgtgtttggtgcgtctgtttgttaatgctttcgcaaatcacaactgcattatggacataatgatacattagaaaaggctttttcaaatttcatattttttccttgatataaatgaatttaaagacaatagtagcacaataacctgataggtgtttgtgtaggatggatgccctttccttttctgccacaagactctgaatctgttctgtgacaggatactactattgataagaaagagaaccaagaagtcgagcatgaggagaaccccaaatcctgtgaacttgaatatggtatctactgtctctggtctgttgaatataaggaagtgatgaaagatttattgtgaagaggcttaaggatcaactttttatggcaagagctcactatcctagtattgcaaagctgaagaaccaggaaacattcacacgtgaactgaaaccaaacatccaagagcatgaacgcatgctcagtgacaccattgcagatgctgatcttccaccattgtgagtccaatcttagtaatcaaatctatatcttctgctttgtttgtaaaaaaaaaaaacttatacaattaaacttcataacaaattatatgagaattagcaatgtcaggactgcttcttttgttataatatttgaccttatttacattctttttatactttttcagttttgcaaagaagctagagaaaatggagcacacaattgaaagagccaagtcttgtgaagtcggctgcacaagtgttgaacggaaacttaggcagctacttgatataactgaagatgaagcttatttccatacaaggcagagtgcatttctctatcatcttggggtacaaactatgccaaaaactcaccattgcttgaacatgagattgactgtagaatatttcaaatcaacgtctattcatacggtccagtcaaacaagcagaaacttgaagaccccaccttccatcactatgtgatattctccaagaatgtgcttgcagtttcgactacaattaattcaacagttatgaactccaaggtatttccaactgattgaaaacattatgaccaatgagtaatccatctcagttctaacttgcatcctcttgacacatttcaggattcgggtagcattgttttccatttgttcaccgattcacaaaatttttatgcgatgaagcattggtttgacagaaatatgtatttggaagcaactgtacatgtaactgacattgaggatcaccagaagctctctaaggatgttgattttcatgatatgaaactgttacgacctgctgaggaattccgtgtcacgtttcgtaatcattctcaatctttccagaagcaaatgaaaactgagtacatttctacttttggccattcacatttcctcctgcctgaccttcttcctagcttgaatagagttgtagttctagatgatgatttgattgtccagaaagacttgtcatctctgtggaacctcaatatgggtggtaaagtggtgggagctattcagttctgtgaagttaaattaggacaattgaaggcttacaccgaggaacgtaattttgacaacaattcatgtgtgtggttatctggtctgaatgttgttgaactgaaaaaatggagggatctccacattaccagtcggtatgaac

SEQ ID NO: 55740 - DNA, 17598 bp, Oryza sativa
acatgattatggagttagtcaaaccgatataaaaaggtctgttactctacactacaatggtgtcatgaaaccttggcttgatttgggcatacatgattataagggctactggaggaagtatatgaccaacgggaaaggtttatgacagaatgcaatatacattaataacagtaacatgagattcaccacattctacatttctgggattttggagcaacagaactttcgggaacaaagagggttagagtgagataaaatctgatgcagcattataatgaattgagtatagtaagggtggcatggtggcactacattaattccaaaatggagataggatgaaatgtttttgtgccagattttaagcaatacttcatagtagctaaagatggtagcaggccaccagcatgatacctttgaagtagatccctggttaacaatggtgtatgttgattccttcaccttttacacgatttggatggatcttcttcacatttaccactttaggattgcaaaagtgcagttccctggtggtcatttttttcgtataaattctttcatgtgtatctttgctcgttgtataagagctatactgtataacttgggtgttgactggcatggcatgtacagatgtagaatgccttaacccgaaagcattgggtgattctttctttcttcttcaaggctgagatgtaccatgtcacaccaatgtcaagtttcgagatctttgcattttgtacatcggaaggattcttgtatcatcagtttgataaaagatacatagagctaaagcagacgtcgaaacattgcaaaaccagaatagcgtgattgcatactgcaggttcattacctttacattttgtcttcagccctgtgttcattgccatggtttcctaactcatctccctcgttttccacgtgcatgcttttcaaactgataaacggtacatgttttgtaaaaaattaatatagggaagttgcttaaaaaaatcatattagtccatttttccagtttttatagataatatttaattaatcatgtgttaatctatcgttctgttttccgtgcggaggggagaggttaccaacctctccaaaaagaacacagcaggacgtcctgtaaaggtcactcattcacatttatcaacttgatatgttgggtcatcattgattagcaaaatataacattagtaaggttttattcagtctgacaaccaaagcaatagcatgaaagaattttggttttgatgccaaaataatgtgccctaccaaatttttagcaatttgaattgtactttggctagtttttggtttgctaaaaaaataccaataataacacacatatagattgacaaaaaaaaattggcactaccaaatttttctaggttttggtattttccatattaattttggcatggtagcaacggaaaaaactgaaaaaaaaagaagaccagggcacacactacaagattcatcccggtctcccgccgtatagtaggtgaggtgaaatatatgtagtataatacagatacatcgatggttgacgggatcgtcaatagctaatgacactcgatggttcagatcgttaataattaatgacagtttgcagcatcatactccctctgtcccaaaataagtgtagttttacactattcacgtttaacgttcgaccgttcgtcttatttgaaattttttttatgattagtatttttattgctattagatgataaaacataaatagtactttatgtgtgactaaatatttttaaattttccacaaaattttcaaataagacggacggtcaaacattgggcacgaatatccacggctgcacttattttgggacggaggtagtactactaaggagtacatcagtttcaactagaggttgttggagtcaacgtagcccttggtccgcagctggtcgagagtgttggcctgcatctggcggatgagttgagagctggtgttgagagcctgcacgacgttggcgagggcttggtcgatctccttcagctccggggaatcgtcacggatcaccggaagaggaaccggtgccctcggcaccatcgacagcaggtgctgcacccgttccatcggcatcctcttcttcttcacagcctcctccttcttcatcctcttggcctccttctcctccgacggcgtggagcacctcttcagctcatttgtcatcgccacacgatttccgtcgccacccatcaatcttcttctctttcctttaattcctctcgatcgagcacgcagatatcaatcgatttgattaatttccttacgattttcgggatcgatttcctcgttgcggcggctctagggtatcttgctgcccttctcgatcgagcggatataaaccctaccaccgggccaccggcctgttagcaaccaaatcaccaaacaacaagaatttcaccacgaacaactattcagtcaacagtgctgtttttggaggtggaaaatggggaaatacagggggctagaaggttctggaagctagggaatgggaggtggaggagggaatagatactcgacgaggatccagcctggacccaatccgccaccgccgccgattgccaagccgcctaggttggtcgtcgtcctgccttttctgttcgtccttgaatgagcagcagttattgctttatgtattgctcttcctaggtttgcttgggctgggatttgcgtagtggaccagctgtggtgcagcccaacaaggtgtctaacaatcctctctccttgaattcggcttgtccccaagctgatgaattaaaacctcccggatcccatggttgctccaaatatttggtgttagacaatggaacatcattgaagaagaatagagcaggtagctttagcctcaataacttcttactccatgcgaagtcctcctgtgtgatgcgtgacaatggcactgttatgaattgcttgccaacagtgattcccaacaatttgatatgctgcaaacaatgacaacctcgttagatcaactgcagagtccacccatgttcatgattatgtccatttattggcatgccgatttcatcagtcgagcatatgcattgctcaatagattctaatgtatttaccacctctgtagaaactaactcaaaagtatatttctcatcacgaattgaattagcatcttcttccatgtctttcacccttttgcagcctttttcatcagcaatcaaatatagcaaatctctttcagcattcaaaccaatgtaatttgattccaaacatgactcagattctgatatcaccatgcaaattattctcatattccatttctccactctagtttggtagtagttgagcaacatccccctaagatcaacagatgataaccaaacatataatgatttaggatcacaaataactagattgctttccttgctagcaagtgttgtcaaactgacctggaaagttagatcccaaaacttctgcattttctgctcaaagcaagtgcaagtttcagtagtcatcattttcttttgctcattccaaggaattatacttgcagcagaatcagtagtgcaacatttcccttctctagcttctagcaaaccaactaatggcagccaaggtggcatgccaaatagtctcagcttgtcacatgttttcctttgaaggaaatgatcatagaaccaaattgcccagtactgctcagctccacaaccatcactcttgcaagaagtaagtgactccaacttaagtagcagttgtcctttctttccatttcaacaaaagatagccccgaaagtaaatattcaagttcaccaacagcatacataccttccttgctagtggctgctataaggttgatcaaaaaggacaactcacttttcactccaacattgagtctcagctcattgctccacaaaatatacttccaatgaaaataatgttgtgggaaccaatcatccatccatattaatattttgtgaaggtggacctttccatcacctggatcccacactagtggccccaacatgacatgtataatgttcagcgggtttaccaatgaaaattgcttgcccacaaagagttgaaaccatttcgcttcggttggagggggccaaggtggcagtatatgtacttcagaacagctgcagttgaatgccagccatgacattaactgtgactcccatataatgaactcttgatcccttgatgttatgggtggccatggatcaacttcaaagtgttgcaacagcagttgccatggaactaacaaatgtcctccagctgattccactaacattggggtgcttaagaaggacaaataagacacaacctgagagttgttagacccagaacatttcgccgaatacctagtgggcatcaatgtgtaccgcttgatgtcggtgatcatccttggtgagaaggcactcaatgatgcaatggatgctggaacggtctcaagtacaaccgacttggtcaggaacacgatgtcgcctttgttggcgtcccacttgacatcgaagcccaacatcgaacacttgccgtgcgtatccttggaatagtcagtggtggcaattttggtggtgctagttgcaccatcatcagctaccaacttcatggaggccatgggagtggtggcacatttgtccaccgcaaccacggtgagattggctcaatgtcgggactagagcatttcgtcgagcatgtggtgggcgtcacctttgactgctctttcttaactgacgctggcaagtcttttgcctccttcccaacttccggtgtgcatgcttcaaccacatctatgagagaccgtatatcagctctagttctccgatcagcctcctctcgcctcagctcgtactcctccatccgcctcaacagcaaatccaatttgtcttctattgccatggcaccctacttgaagagaactttctcaactagaccaagagctagatggggggaaccaggctggctctgataccaaattgtttttttttactaactcaccgggggggggagagattccccacctgaattgtcattgcataatagattgaaaggttttgttacaacagattcagagtttgaagtgcggaagagaaaagatgtttccagacatctattacatgtcgatcttgcacagctagtgtttctgcccaaagggttgcttcacttatcgctcggtgtaaacaagcagctaaagatggttgctgccctctgaagaccacatcatgcctatggttccaaagcgcccaaaagcataagatgtagaagacatggaggtgtttcgacggcagtaacggtgaattgctcagccgatgaaagagttgcacatcttggatagctggctgaattcgcacttttgaccagaagtttatcgcaaacgggcaagtcaggaataagtggtttgttgtttcgtccccgctactacagattgcacatgaagctgattgaacaattttcttttttgatagattcatccttgtcgacagtctgtttcggaccagtagccaagcgaacaattttaccttcaaaggcgcccgacagttccagattatcttccaatttggcgatggcatttgtacagggaatcttgcatcatagatttctttggttgtgagagaggtcgatcggttgttttgccagacatcgttgtcattggtcagagtaaggtctgccaccattgcctgaaggctgtgaagttccgcatttgcagcctctgaaagtcttgggacaaacattatcattaagcctcttgaaagaacatcttttacagtagcatgacaatctgttgtgtgagaataaagagccgggaagagatttgctaactgaagaatcccaagccaacagtcatgccataatgaagttctagagccatttccaatctttaccgtcatcagcttttgaagctccggcaagaatttctgtaacgaagtccagtgttgtcctaaaggaagggatttcagtagagattgcccatcaaattctttccaaatccagttcgcccaggaagattctgaggagaagaggctgaataaccgcttcaggagaagagcctcattttgaacttttaagttttttactccaattccacccagttcctttggagagcaaaccacatcccaggcaaccaagcaacgcgctctagaacaaacatcctcccccgtacagaggaatgcccgccttcgcttatcaatttcctcaatcaccgaaggtggcagcttgaaagcagacattgcatagacaggaaggctattgaggaccgcattgattgaaacgagacgctctgcctgaggagcgaagcttcccaacctgctaagaacccatccaccttgtttagaagaggctgagatcacccgtagacaacttgtgcacagttagcgggagacctaggtaagacattggccagttttcacgcttgcactgtagcagttccgacaaagtcgcttctttcagcagatcaacatgaagagagatcatagtacttttcgcaaagttgatatgcaaaccagttgctttggagaaactgaggatggaagattttagggctcggacatcatcttcttctgctctataaataatcagcgtgtcgtctgcatattgaatagttgcgtaggggcgatcatggtatattggatgtcttaagcttgcatttctttcaagcagtcgctggagcacatctgctaccaagataaaaaggtatggagaaagagggtctccttgacgaaggccccttcgacaattaatccaactccctgggattccattaattagaaccaaagattttgaggaggtgagcaacttgttaatccacccgatccaattgtccgggaaacctctgaccgctagtatttttagcaggctttcccaatttactgaatcgaaagcctttgcaaagtcgagcttgatgattaaagtttggcatcctcgcttgtggcaagcttgaatcagttctgtcgcaaagattagattttcaaaaatgcaccgaccttttagaaagccagtttgatccatgtgaatcatttttgtcaaagcaatttgtaacctaaaagccagcacctttgatagaattttgacagagcaattctgtaaagagatcggcctgtacccatccactgtgttttctttacctggcttttggataagaacaatgaaggctctgttaattctttccagttgaatagcgccctgggagaagcctgatgctagatttaggatagcctccctgatgtcgttccaagccgcctgatatatagaagctaggaccaaaaccgtctggtccaggggcactgtaagaattcatgcccttgatagctagcagcacctcctcttgtgtaatcggcaaaccttgagtagccagcatgttagagtcgcattcctccgacaagtagagcgctgaaagatcaacatcccacaccggctgagactcaccccccaaaagattttggtagtaggagtgcattaggcgcgctttgccattgtgatccgccacctctgtaccgttgtgcttgattgatttaatccttgatttcctgaaattttttgatgcatgagccttaaagaacgcagagttatccagacccaactttattcttctgactttccccctctgcttccaatatgagagtctgctctgaaccaactgtgccagtttattctgcactagatttcttaaacattgctcaccttgagataaaggcctgaattcttcgagaatgtccagtagatcaattgtgaatttacaattttcatcgagataaccgtgtttccggtgatccttcatccattgtttgatttgtgacctggtgtgtttgaggtttgataccaaattgttagtaaccaaatcaccaaacaacaagaatttcaccatgaacaactattcagtcaacagtgctgtttttggaggtggaagatggagaaatacagggggctagaaggttctggaagctagggaatgggaggtggaggagggaatagatactcgacgaggatccagcctggacccaagccgccactgtcgccgatcgccaagccgcctaggttggtcgccgtcctgccttttctgttcgtccttgaatgagcagcagctattgctttatgtattgctcttcctgggtttgcttgcgctgggatttgtacagtggaccagctgtggtgcagcccaacaaggtgtctaacacggccttccaggtcgagtccgactacgccgttgcatcactatacacgggcaatacaagtccgaggcagagtctaattgcatcgaccaatttcaggttcggagaattaaacaccgcccgatatccgtataatccagccgttccagcgaggttgggaaattcgattctgaatccctgatatttttcataggacgtcggagaaagaaataaactccgaacccccttggccttgggtgagctcaaactcctccagtacagcgttagcgtcgcttctctacaaccactacaccccaagtggatgcagctgcctgaaagggtccttctaatgccttacctctgcttctttgacagtccaagagaaatgcaacatgaaaaatccaaacttgcgcaggaaaatataatgaacaaacactgtctagctgtaactggtctgatctgaactggcatgcagcaaattaatttgcaatgcatctcttgccacaaagcaccagcaacactcaaaatcactcaatcagggaggataaaaaggacaactcttggccaaaactatcaaactataggaacaccagcaatcagttgccattgtatttcaggggttcggagaattcaactccaaacccccacctcccgattccagtatttgagggattcggagaattaaaccccgaccactacgtaccgctccagcatggtgggaaaattcgactacgaaccgcctgataattttaagggggtcggaaaattgaactctgaacctcctcgatcggcatcgccgtcgctagctcagcacaccagatgctgacgaaaaaaatgcagtggtgtaaattaactgacacggatcggacgagaagacgccgacgctgcccctcgctcaaattcaagcaggtgttgcgcaaatgaaaccttacagaaggcaaagtatactataagctatgtgtacatgtgctgttaatttaggtggtaacgagaaattcgatcatatgatttccggattacatcattatactggtgtgaatatatattatcgtttctctgtatattttgacagacgtaggaggatttgtaggcaccagcaagaaatcaaacgatcaaacaagactcaagcaatctagtatgttaaatgatggaaatcatgctccaacgacaattggaatttccaggaatctaatctaatctagtgaaacaagactcatgcaaagaatctagtaaacaggctgctgcaactagttacgatcacatgatagtaggagagaaaaaactaaggtaaaaaaaattaaagcattcattaatttgaaataaaatagccttgcttagatagttaggttgatactagctagttgaaattggggaaattaatcggcgaccaaggcgtggacgtagccctttgtccggaggtcctcgcgggcgttggcctgcatctggcggatgacttgagaattggtgttgacacggttaatggccctgatgaggagtcggtccatcctgttgcgcaacgagttgggattgccgtcagagtctgcagagaccaccggaagaggaatcggctccatggtcacgaacgatagcagatgctccacctgttcctccggcaccatcgtctgagtctccttcatcctcttagcctccttctcctccgacggcgtcgccttgcagcacctctttagctcatggctcccctttgagcaacccgtcatcatcgtaaaaaaaacgctggatatgaaagaaagggctttcatatcgatatgcattaagagaggagtgagtgtgttcgctgggaatcgaactcaggccgtagggcgcaccaccgcagaccctagcgcagttctctacccgtcatcatcatcggacgatgatttcctgtatatatgatttcgagctggttgggtattggaatcgatttgtgaattgctggacacgagctgagctagcgatgctggtctgcatttatatatgcatcactttacctgggcgaggcaaaacaagtaggattcgatcgagtccaattgcatcacccggccggatcggcgttcggtctcttaatcggatcggacgcaccgcaatatatgggctatggcaagtgtaatactagtacgtatttttggtcgtcgtcgtcgtaataaaatctgtttacagatataatacagatgctactaatcagtaataaaatctgtttccacaccaccgaattaagaagcaaatatcatcgtaatgtcatgctcatctacattatattaatacagttaggagagatgctgatgcttgaattgaggcacgcagagcagggcctagctaggctgttgaggccagcatgtcgtcgtcggcggcggcgtatttggtgacccagcagtcgacggagcccttggtgcggagctcctcgcgggccctggcctggtcctggaggatgatttgggtgttggagttgaggagcagcacggtgttggcgagtatatatgtcctcgaactggttgatctcggggtcatcggatcgtggctttcgatctcgaggaaacgtcctcggcacgaacgacagcagctgctccacctttttcgtcgtcatcctctccttcaccttcaccatcaccgtcctcttcttcatcttcttggccgcctcctcctccgcgttcaagcacctcttcagccccagcctcgccccatcagatcactaaattctcactagaacggataccatcatctcaatcgggcggcaacccctatctcaatcgggcacggtgtccgtcacaggctaaaagtcactgatgtgaaaagttatctcaatcgggcaaacggccgtcacggatgaacctatcttaatcgggccctaattaaagcccattactgatagctttgacccagacaacatgtcaaactatagcccgtcatggatgacctatctcaatcgggcctaaactatagcccatcacagatgacccttatctgtgacgagcattaactatagccctgtcacagatgagtcatctcaatcgggcctaagttaacagatgagtcatcccaatcgggcctaagttaatgcccgtcactgatgagtataaatctcaatcgggcctaagttaacagatgagtcatcccaatcgggcctaagtttaacagatgagtcatcccaatcgggcctaagttaatgcccgtcactgatgagtataaatctcaatcgggcctaagttaacagatgagtcatcccaatcgggcctaagttaatgcccgtcactgatgagtataatcctaaaaaatataaattttatttctagctagccttgccatgccatcccgccccactcatgctaatccttttttttttttgtccttgctcatgtgcacgaagttcacttcccgatcggtcacccatcctaaaattgctccaggcccagtacgcttaatcggtcacccatcctaagatcggcttccagaagagtagttgtagcttcttggtatcagtgttctattaatcctattaagccctaggccgggatatgtcacaccccaacatcccccattcatatacattcattcacatacacaaccatcaaaaatcataaacaacaaaattgtatgactcatcgagatctacaactgtatcggtcctttgtacaaataagttttatttgaacaattcaaattttgaattttcaaattttgacaacttcgaagaaaaattagggttaataaatgattttaaatggaaaagtcaccgaaaccaaagttgtagagctcatcgaggtgcaaaatttttattttggtcatttctccatctgactctatttaaacaatttgaaatttaaaattcaaagtttgagaaattcaaatagaattttttgttagggaacgacttcaactgaaaaagttatcaacaacaaagttgaataactcatcaagatctataacttttattttggtcatttttctatataacattttttgaaccgtttgaatttgaatttaaaaatatgataacttcaaacaatattttcaaatactaaatgatttcaactgaaaaagttatcaacaacaaagtttaataactcatcaagatctataacttttattttggtcatttcttcatctgataaaatgttaggaacattgttcataaattttacatatatgtgtatagtttataaatccagataaaagatatgtcaattttgtgaacaatgttactatcacttatacaactttattgttgatgacttttccatttgatattatttactacccgtaaaattattttgactcgtaaaatgaattattatactgcaagttaattattttgctatagttcaacttacaaatataaacatttcatatgaaaaatagaaaaatactcatcggtgacgggctttaattaatgcccgatagagattaagtgattaattcatgtcaaccggggattagtatatagcccgtcactgatgagttatctgtgacgggccttaagttggtgcacgtcactgatgatggtcatctgtgacgggccccaacttaaggcccgtttgagatatggaatgttatctcaatcgggtctaaagttggtgcccgtcacggatgatggtcatcagtgacgggccctaacttcaagcccgtttaagatatggaatgttatctcaatcgggtctaaactacggcccgtcactgatatgtgttatccgtgacgggcttaagttttatgtctatctaatgtctgtgcgaccatatctcaatcaggctaaaatgcccgattgagatgactttcttgtgacggcccgctatttccagacatgttagagcccgtcacagatagaagggtctgtaatagtgtctccagccatatcgctcgacacctcgatctcaatttgatttgcggaggggtggttctagctagggattaccggcggctaggcttctctctctattttatctcgtgagtacgcgttccgacttccgaatcagaaacatattagaacacacgttcataattatgttgggccgcacaagggccgagcaagataacattggtagcccatatcaattagtattactctctattaacttctttttttttattttggtcggatcaaattaatcgccacttgaatcaccgtaattttgacaatttgatccttttaaaaacttatttgaaaattagtccgtgtcaaaaaattattgaaaaataggtcaaaacctcagcgccataaattttggcgctaaagcctatctgagttggacaccacgtcattggtggggcgctgagctcccatccatctaaaatgttacataagtgagcaccttaacagtattgtttgcttgctgtagtggatggattgttaggtttgtactcaataggtgacgggttctagcccttctacctgcaccgttttttccttcgtaatttaatttcctttttatttttgaattgaaatatcgagaagaagtgtatattagaaaactcaaatcatctctcttaagaagatatcctcttatttaaaaataaaaggatatcttctcgagggacaaaaatccatttccatatattagcatatatgcttgcaaatgaagagatccctgtgtgtatagtgtaaagtgttatgtcacgtatccaaactcaaatcatctctcttaagaagatatcctcttatttaaatttaagaggatatcttctcgaaggataaaaatccacttccatatattagcatgtatgcttgcaaatgaagaggcctctgtgtgtatagtgtaaagtgttatgtaacgtatccaaccatgcaggtaattaagcaaaaggattgattaatttatccaaatgtacaagcgtcctcgttccctactactacctctatattttaatgtatgacgccgttcatttttttccaacatttgaccattcgtcttattaaaaaaaatttatgtaattatcatttattttattgtaatttgatttatcatcaaatgttctttaagcatgacataaatattttcatatttaaaaaaaaattaaataaaataaataattaaacattggtcgaaaaattaactgcgtcatacattaaaaatacatacggagggagtacttaatttcctagctagcggcggggagatctcgcatccccggccggccccgtagagagtgttaatttcctactacgtacgtgtgccccttgttaatttacgtacatgaaacacgagaaattcgctcttaatttctggattactacaatatatatacgggatcctaatctcactggtgtaaattaagaaagccttttaattatttggagcgacatatatcaaatccctcgtttacgcatacatgcatggatacatgctatatatatttcctaagttaattccttgattgcatgcatgtgcatcactcgatctgtatcagtatatattgaaacgcgcgctgattggctccatcattagctccattattcctatctagctagtacatttctcctaagagtacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagttttgctctctctcttcatttaatacattctaagtaggaaaatatgctgacatggatctcttatagagagcctatagataaccattgtgggtgccctaagatacatatcaagatatgggcgacagcttgtcttgtcagaggaacaccgacgacgacgccgctccgccgccgccgctggtgcccgtcggcggccagcagcaggcggagtacatgagtaatcagcaggtgaggacgaggagagagagaggccagccaagcagcagcagcagcagcagcagcagaaaccggggcgtgggcgtggcagatgaatatcaaacacgacgcggccggtgttgatgataatgttggctttcccatcagttcacagccccctacgctgcgtcctcacaattttatgagattttgcgctacctgcaaccgcacacttagtccacagatgaacgtctacatcttcaggtacctagtagctaattaatttgttgatgacaattgacaaaccttatattctttttctttcataaatgataataactttgtatacatgcacgggttagttaattgattttctaatctccatacataattaacttgtacacatgctactaattatgatcacttttacttatttaggtgaaatcaatttatataacttttcatccgcggttcttttcatccgtggttggtagtgcattttgtttttatagatagggaagatttttatttgtttgacatgcacgtgtgaattcttttttaaaaaaaaacaagaaagaaattattgttgaacaattgtaatatatattgtacaatgagctaggtggattgaaaacttcacctccttttatgcctctcttttttaattttaaggtgttgtaacaggggagagagcgctttctgcagcccggaatgtcggcaagtacaaatggacgcctatgctcgcatacaggatataattaattcttgaacttgtgcaaggggtgatcatcatattcaataacgaagacagaataatgcaatttaatttccaagccatatttagagaaactgatacccttatttgtaatatgcatgtatccatcccttcttaaagttctagaaggatatccatgaatgttcaagcctttacgatctcatcgtctaagctatatggttagtgaatgcttcatgcaatcagtgtacatctgtcttacctatctactccgaagtgtgctgtctatatgcatgtaatgctactcttatttatatgatatggttgttgtttaaatgtgttctttcactatgtttaaatttgagacctttttgacgtacttgattacctctagattcaaataaaatatcattgccccaatatcaatcgacctaatttgcattctatagatgtgtatgaatcgtataaaaaatcacaaatataatgtgtaagaactttatcaaaagaaactacgattatatatgcaagccaccggatgaagtgaaagaaattgttggggtatggtcttaattataataccaaactgtaagcatttgcgttaaatttttgtatagaatatgtgagctagtcaccatacgacacctttgaagtaggctgcagtttaccagttaccagggtgttatgttgattacttcacctgttcaactgcacttttgggtttgcaaaggtgcagctccttgcaagttgtcattttattcatccaattctttaccaattgcaatcctggctatttttcggtgcgttgacatctttataggcagaaaaacgatgtttgttttgctctttggcatcaaattaaatggtatctttatgtcctgcatattccaatatgtttttgtttgcaaggaatttaagcactcagatggcaacactgcttgtgccttgtcccctttcactataagcagggcattgtggcttttggattgctctaagaacacatcttgtgtaaaaatttcatacggtagataagaacgcataaatctgaaagctcacatttatctccagtaaggatcaagctaaatctgtaagtggtttctgatttctgtgaatataaatcgtttccatttatctacagtaattatgcaagcttttgttaggttgatgttgttttttttataaatgccccttcaatgactggatcatgtgtatttttctatcgattctacaagtaaagagtacattatcaagtaacaacagtagagaaaatccaatccaggtgttacaagtcatgaaacttaggaccatggggataatgaccttccagaggacacttgcaatgcttctgcaactcaaggtacttttccatatcaaaactattcttggcacaaagctttctgtgtcttgacaaatacagcctttccatgaagtcctcatatgttggatcccttgaggtaatgaggaaatatgcgtaaccaacgagtaggccagatgcagttgtgaagaaggcaattggctccatcacatcccatgaaaattcccagaaagtaaggcggaagaagagcccaacttggcacatgaagaaacctagtccagaccacaggatgcgccgaacttgcttgtgtgccagcttgtcgatctcttccttcttctcctggagcttcttcagctcttcttttcttgaatcgttctccggtgagagtgcaagcggaacagctcttctaacaagctcaaccacctaaaaattgtcaaaaaagaaaaaaaaaggcttcagtttaatagcacaagtgtcaccgagttctaaaaattgatcaggcaactaggcaatttgggagaaatgtcaccttctcggggtggaggtaggccttgtcgcggaacagcagcacgacgccggcctcatccatggc

SEQ ID NO: 55741 - DNA, 2724 bp, Oryza sativa
tttcctttccttttcagtttttatttcctttttctacgtgctagtaaaatcttgaccttttcttttctttttttcctttttttttttggaggatgtcgccatcgccaacgtgctgtgatctttacttcggaaagtgatgacttgggatcatggacaagaatcaacaaaaggatgtgccgttacttgtgtgctgttgtgatgttgtccattcttgcgaggttgcacagagaattccaatttgcaaatacatcaccaactgaatttatggggatgcaaaagatttttctttgatgaaagcatgcaccttgtgctgacaaccaagtcggtcatccttttgcatcctcatgccttatgcagttgtgctcttactcagtgtatttagggcatgtttagaagggctttcacttctaaatataactattgaaagtggagtttggagtagaactatggagcatccacaccgcctcactagttatttttttacgatcactctagtggtctagcccctttttcttttagactttagccttagaaaaaaagtgaagctagaatctgatcaaaacacaaccttatccttgtcaaacttaattcgcgtctttagaaaaagtaaagcaggagcttaagcccaatcaaataaatccttgttcttgtcaaacattatttgttgcagttatgcagtattgttagcgaattccacagacactgtacgtatttttcctgctaccgctgatcagctaacagttgtatccaatgtaacttccatttttacgctttcatagttaggccttacaccatgtcaaatcgaatgtttaaacacatgtatgaaatattaaatataagctaaaaaataactaattgcacagattgcgactaatttgcgagacgaatcttttaagcctaattacgtcatgatttgacaatgtagtgctataggacggattaattaggcttaataaatccgtctcgcagtttacatactgaatctataatttattatgttattagtctacgtttaatacttcaaatgtgtgtccatatatctgatgtgacacgccaaaaatttataccctggattaaacacccccttagggtgtgtagttcacgccaaaattgaaagtttggtttgaaattggaacgatgtgacggaaaagttgtaaatttatgtgtgtagaaaaattttgatgtgatgaaaaaattaaaagtttgaagaaaaagtttggaactaaactcagccttaccgtgaaattctagcatgaatgaatgtcaggttaccagatcagcggataacagagtacgggaaggcatggcaggagagactgcagtgtacagtaagcagtactccgtactggtctccggcgagtgaggcaggggtaggcaaggtttactaccaaaatgaataccttcacccaactcctcttaattctgctcatcatttcctccaattaatattgctaccaagtcacagacagacagacagaaacaagaaagccgagttccatcctccactcatccccgtctgctaataggattaaacttgatcaggcaatgtaattgtaaccccttccagcattcaggccagcagttcaaggaccaatgtcattaaaaatcagaccatgagctttgttgactgaaaactgtaaaaaatgaggcgagtttcagtctgcagttggtgctgtccctgcaactgattgtagagctcgtttgttaagcccgtccgtcaaatagacagcttcagatcaaagtatgcagagcaatttctgaggcatttggtcttgtcatcgcggagtggtagcaacaaacaggtcgtccggcggggccatcgttcacttcagtcagaaatgctgaattgattttatctgacgctgaagcttaggagacgatctttaccagtgctagcacattaacagcgatccgaaaaatcaggatcacaatcatcattaatggcgatccaaacaagataagctaggggggctttctgaaaaatgttgtcgattgcggcctcgtagccattggatgctttctctgtggccaccgtctcctctaccaatccaaaccctcgagagagacctcgccgccgctgtggtggtcgtcgtccatggctgtcgcgagcccaccgccacatcccatcttgtgccactgccgcccaggcgcccatcccatccggatgcaatggcgaattggcgatggctgaacaggcgacgcccgatggccatgagatgcgatgtgtgcgtgtcagcttcttcttgctcttgtgcatgtaaacccagcccaggaagggatcgtcagctcagcaatggcgaaactgtaagtctgcagtagctgttcttgtttcattttttttcgggagaatagctactttagtccctaaagtttgtctgtaggatcagtttagtccctaaccttttaaatggtccaaagaaattcttaacctttgtcataaagcctagaatagtcattgggtccaccaaaatcatcatatggatatgccatgtcatcattcatacaaaatctaagatgaacagtccaatttacccttacatatatcatagaaaaataaatataatggtgaattagacataaccataggaaaaaaataattcttttttcacccttttgaggtatatttttgctcttacatatactatatatttttttaaaattttccttttgttttttattttcctatgcgtaagggtaaattggataaatcatatagattttgca

SEQ ID NO: 55742 - DNA, 1423 bp, Oryza sativa
ctttctgattgctgattagggtagtatcggagtttcaaccgatcttatctgatttaactacttttattctatatgcttgattgacatgttaaatctgccctttatgttaagatattgtcgcatctaagtatattaagcttatgtttagtatattctacttgctttaaaatcttagtatagagtagtatcggagtattagccgatacatgctagatctacctgatcggctatgctatgaatgtatataatcctactattaatatatatttcgatctaagtgatttatactgtctcagcaaggcgaccgatctatcacaatcatttgatttaagtatatattgatataaggattatatatcattaacatctacagccgatcgagtagatttagttctggtttgcttattgatatttgtcggtcgatgtacacatgacaacggcttgaaataaatgatatgtcatcggcacctagccgatcggctatcatttataggattaattgtggtttctttgttctatttcttgttgattgcaggatcaaatcaactggcacgctcatacatccgaagacgagctttggacctgcactggagttaagcagatctcccaggcctcgtgttttctgtcaacatatatttactgagcatagtgattgcagaagcattatattgaagtagctaaattttgcacatacttaacagtcttatgccacacatatatatcatttggttactgctagcttgctgcctgtcatatgggcaacactgtgttttatttttaagggaaaattgcaaaaaccaccctcacatatcactctgggtttgagatgttccctcataagaagatttgttgcaaatccccacctcctaattcaccttgatttgatttaggcaccttttctctatacatgcatgtttcctagagaatctcatggtgaaatcaatcgagtcccactcggcaggaacaagaggttatgttatttgttctgtataagacgatctttgtgcagtaccaagaaattaacaacaccctaaaacaaaatttccattgattacattgccaaaaccaaaaaaataaccacttgctaccatgaatttctaccctaacgaggatgtaatctgatagtgctacatatgaaaaaccaactctctgtaaattgtaatgccaacgaaatctcaaattttaccaacacccaagaacttactgtatgtccgttccgcgatcgtcgaagtgaaaccctttctagtcgcttggacaagagaaagcatcacaatcggcggcgatcttcgcagctgttccgcccgctaccgccgcctcaatctccactcccgactcaaactgactcggagggaacggtgtgattaactaggtctcggcgtctctcgctcccgtcaagcgggacttggctaatttctccacgaga

SEQ ID NO: 55743 - DNA, 5092 bp, Oryza sativa
aaaactgattctttggtgcaaggttttgtgccaagcgtgaaacgctatgattcgctttgtctcttaactctgaacgcgcaatacatttagcttgtagtaatatatgcttcttttattctactttctacactatctgaactcttagaaaaaaatgattatgctacgattgtgtcaggtcaaatactcaaatgtgcaccagatgttcagtcttttacatacaagacatgcgtgctcatgacacacaaacacaaccgatgatttctgtgatagtacgtaattatatatagaaagctgctatatattcaaacatacacaacttggagtctaggacaaagagcatggccgcctcgatctattgatagctcgacccattattaacatactacttatatatcatgatactcagttatactgtaataaccagcacacagacatcgatcatacaacaatcgatatcctaacttccaaagtagctagtacatcgatctcaagatcatttgtatatttctcgaagccgttttttgggtgacacagcttcaatagctgtacccaatggccaagccgcgtcaatgtagtactccccatgcttcaccttgtctaccagcgttatctccttacttggatgtagacctgacatccaattatatatatattaattagtaaactgcatgttagataaattgttcaacaatttacacacctatatatgagttctttttctttagagttaatttcttatccatggatatatattgtatctccattattagaagctagtgtacgtaccgaagccgtcaacgagcaaggagtattcgtagataagatccatgcataagtaggcatgatcacgaacgttggggtattctacttttgcttctttgacactcagtttacaaaccttttctgcaacagccttaaacgttgcaggggttgacttcgcactgggtgcatcgctgttgatgaacccaacctttatcccggtccgatcaaaatgtatgcattggagataaaattatcaggtaaaagtattaatttgtatatgtaacataattacacaaacaattaaatgcacatatttaggggtatatatttacataactagttagctagtagccagtctgaagcatgcctgagaagttaaataatttagttggctaattaattaagtaatcacgacgtacatgggaggctatgtagtagaaggcggacgcaacgtagaggtcatcctgcctgctccgccaccaccgttccagacgccattgaagctgcagttcttggtttcgcagggcgcattcaccttcagtaacttcactacttcttctctgcacttgtggtagtctgcaccttgtggtgcggccgttgcgtcgtactgcttgccgttgtaggtgaagttaccttgtttttgccaaatcaacaaaacaaattaaatctcacttggttcattaagcactaaacgttaattgattatatgaatcttaaaggattaaagggtcgatgcgtatagtaaacagaacaagtaataagctagtatctaggtaccactgaatccgcgcagcatgcagttgctaaatggtccatcctttctctctaggatgtgcgcgcgagaagcaaaaccgccatagtgcaaatagctgcaaattgttgattgatcttagtaaactacggttcaaaagactatatatgcattatttttcatattttctacagtaagttcagatattaacaggctaaagcctacaggcttcaatagttcagtttattcagtattcactagtacagtgtgtgcaacaaatgaattaatgttgcactttctaagtagtatattattcaccagcttgcagtggatccagatataaaattaaacaaagatcaaattatacttaacaagagcgtgaacttattaattgacctgtgcacataaatgttataatcttttcccttgagatactccttcacaacatagggatcttttccttcgggcacctttggagcggtagcagcggtgtttgatgagatggcgtatgccatttgtacggatccacctccaagatcaaccacccctacggttttagagtagtctcctcccaatttatccaggagataattcagagcaacccatatgtatgacccttcctgggatccctcaagaacgttgatccagttcgggttatactgatatttgctcttggtgtggactacatccctaacctgtattaagacccagagtactaattaaagggattattaagaacaaaaagttattaagaatcaaagcaagaaatggttttgagttaaaaattttgtatgatatgatgtatatcattgtggaattgcacgtaccgcttcaagaatctggttcgccttttcatctccaataagtctgagtccggcagttgcctagtacatgtttgattgaattaacaaagaacaaaatttagagagtacaagaagtcaggccattttgtttcagaggaaacatatcatcgttaacattttgtcagtagttttaagaaactatttcgtcagataaaccatcatacggaaacatccgtacgtattagtaattttaaattaagttcccgatgcaggtttcgtttaataattagataaagagcaaatcaatttagttgtgtacgtaccccaagtttaaggggagttttgttcataagtctggcaggaacaacggtgttggccttgtcaagcagaggcaatatggagtttgcggcatcctgaggacgtccagcgtaggagctcagcccaggatccacctacaacaacacacaaattaattagtcagtcagtagtaggattaaaatagctcaattaagtaggtactaacgaatcatcatatattaataagtacttcctccgtttcatattataaaactttctagcattgcccgcattcatatatatgttaatgaatctagacttatatgtgtgtctagattcattagcatatatatgaatatggacaatgctaaaaagtcttataacctgaaacggaggtagtagattagattaatgtggttaccttagcgaagagctcgatgttgtcgccgaccttgaggaggtccagcttgttgtcgaacctgaagacgtgcacccgtgtgccggtgctgccggcgtccaatatcacggcgtacctccccggccccgccgcctgcccttccacgacgccgcctttccggccgagcaccgccgtgtcgtcagcaacggccggcggcgacaaagccagcaggagaagcatggccacgacaaggtgatcagccgccattgctaactagacaaggtgaggcgcaggtgctcatcaacagaatgcaaggggcaggttttaaagggagaggggaattaatggattactaacgtagagtttactctgcataattcagtccctaatcacagtgtccacccattagcacagtacaatactcaatccgtattaattgtatttactgtaataaacagcttttagacggggccgtgttgcaaaggtttcactgtggattcacgtgtgtaatcctagtgcgctagctttattgattttgattgatcagaagaactgattcttggtgcccagcgtgaaacacgatgattctatctgtctccaactctccttacataacaagtttaaatcataaatattttcttggaaagaaaatcagttgattgtaaaagaaagaaaatcagttgattgtaaaagaaagaaaatcagttaattgtaaaatataggattccatttccgtcaccgtcagattagacccctaacatcttagcttcctctcacacggttgggtccgtccgtccatgacatcaagggggccctttcgatgcaggcgctgcacttgtgggatcggcttgaggcaattcagctacagccggattccagggacagctttgtgtggaagctttcggccgacggaaactactactcctcctcagcttactccatgtttttcatggggaaaacaaaggtggtatgggtggagttagtctggggggctaaggtcactcctcgctgtaaaatgttcatgtacctgacggctcggggcagctgcttgacctccgacaatttggacaaacgcaggtggccttcctgccctctctgttcgtctgggccagaaaccgggaaccacctgtttgtcaattgccctttctccaaacaggtttgggcgcaactgcgactccgcctccgccttcagccgcaaacaccaaatatcccccggtatggtttcctggtggctgcatgaacacgagcttcataacaaacaagggaagaaggtgtttgacgctagactcttcctcttctattggctgatttggaaagaaagaaatgggagggtcttcgaaggcgtttccaacttccaagacagcaaccgaggtggcagaagccatgacagaggagtggtggacttggagagatgctggtttaggtgctaggatcgagtctgtatagtcctcctgtggtattagacttggcagtggcatgtgtatagctatgttgtgggtcttcttccctgtggtacttagctcagtctccgctctgggcttggcgatggcccgactctctgctccctaggggagcgttagccttctccgtcaagaaccgttattgttgtaactgataatcttttctctcattttaatacaatttcgtcggcttccgctggcccagcgaaaaatcttgcttcctctccagaagttcactttatcttagtaatggttgccccttgttctctaattgatcagacaaaccaacaaaaagttaactatcctaactctcttcctttcaaatatattccattatacttgaacgcatgtattggcgctcaaatcttttacatgttcgcttggatcaaatatcaatcataaagggttagaaataactagttgttgttagtgctatctatattcaaattttaattgtttgtcaaatatgttgattattttccaaattatagcaacatagattaaaagaagagtctatccacattagtatttcttgaattgttacgacttgtacctaacaaaacagtccatatcagttacaatgtgctactccctccatttcacaatgtaagtcattctagca

SEQ ID NO: 55744 - DNA, 5001 bp, Oryza sativa
ttgagggaagcggctcgctccgcctccgcctctaccgccagccacccaagctcctctcccctgctctctcatccttctctcctcgaggtatgaagacgccctcccatcatcgacaacagtggagcagcgccctcccagcgactccaccgcctccagcatcattctcggtgtactcctccgccaaccgcagacgccgccgccagtcggccgcccgagctctttcctcctccgcttccaccgccggccgcccgagttctctcccatctccaccgccagctgcccaagcaagctctacctttgctgtcggccgctcaagcgagagagagagagagagagagagcagggggattggggagggatttggttgagggagagggatggcaggtgggtctagagagtttttttattttctttgctgaccggattgccacgttggtgccacgtgtgcaagctcaagttaaaaaccgcttaaaacagtgctcaggggggttatttgttcggtttgcataattgggggtgaaggatgtctggttttatagttcaggggggtaattcgatcgaccacgatagttcggggggggggaggggtaattcgtaccttttccttaatgtgttcatgtgttttttccttgatgacaagatctattcatttagaagccaacaactacatcgactctagattgttactttgaatttcattgtttgtttactttctacgttgtctaaacctaacaaggatcagttcattataacatatgcttgcataacattagataagtcagatggaccattggatcttttcatcttaaccttgttgttcgcttgcaatgatcagtcaggtttcctacaatgttaaaacaaaatagttcaacacttgttcttgctatgttcaaaattatgaggtagaggctactgatcacagatataaacattactttgcgtcgatttcagtctattactcaagatgcacaagcatgtctaaacaaactctctttgtaccataattttcaaaatcaactggaacaaaaagcgagaggtgagagcatgcatagcttaggagagagggtggtaatggttgaagatctcatccatgcacgtccatccattttacctttggtggccgctccaagaaacttcgggcagcatgcaacacaccatgcttaccatctctatgcaataggtgtaggtagtagtcaacacaacttaatttggcagatactatatctacgatacggttcatctaccttgttctcacctgaatatgattgatgacatattttgtttttttttttgccaagcttttgaaagtctagtgacacactacacgcgtgacttggtcgatactaataataactgaggtacgcaatcatgcatatatatatatttcttggtttggaactaaaaacaagtggagtactagagacaagcctttagtggcctcatcatctatcgtttagtgattgaagtggtctctttatcactgtacataatggcagcaagcttaagcatatatatactctcgtaaccatggtgcccatgaaagaaaatggcttaaagaaagaatggaagaaaaatggctcctagatggctagccatttcaagcgaacaattgaacatacacaaagccagcacaacaaactttttaaatttcaagttttgtatgcatgacttccatattgtgttggacttatgagtgatcagtgcaacctgctcgtgtggaagcatctttattgaatgttgatccttaatgaagtttaggttcaatttagaacgaaaaacacttacgagttgtgtattcttaggttcattatgggactctatgcagataagtatttagggagtagacacatactcacatcacaaaatagtaagcacgttactagatgcatacacaccatcatactctagttatgtgaagcaagcaatcaaacgttcataaaccaaagtaatcaaggctcgaatttagatgtcatatgtgccattgggttgtattcttttcttaagggttcaaatttggaaacacgtacgttcaatgcatatgcgttgtttcgattttagttcaaattgcagggaaacaaaatgtgtgccaactgtcttcttggttgattatgttatgccactcttttcttggttgtgcatggacaactaagcaattacttaaatcaaactatatgtgtcatacttttgttgttatgtaattaatgagcaaatatattattttaattattcaattccaagcatcacacctataaatgtccattcttaattcaaaatccagactcataaataatgatggaagacactattactttaacgagtagaatgcactgctctatgtggaaaccttaggtgtaatcaataaatcactaaacaatactaacgcattgtttttttacacacaactaaactcccaattcatgttgaatagtccactaactttgtgtagaaaagtctaaaaatatagggaaataacaaaagtcaaatcccacatgaaagtaacgcatagagcaataaaactaaaacttgggtcaagcattgaagagggagccaaaaaaaaggggaaaccgcccactttccctcttcccaaagccaagcgaaccatgctatttaatccactacactatttgtgagccttttacaactatgctcccactccgctccactccactggttttttccattccctttgtccccttttcagatctccctttccctctccaagaaaagaaaccatcaaagaagacacaacgagataggggggagtggctactatcaatctccatgggcgcctatgaggccaccaaggtggtttttgcccggttgcaagcgcttgagcccaatcttgctccaaacatcattggcatgctcctcaccaaggataacaatgagatggacatgattcgtctcgcatgtggccctgacaacctcctccaatctatcattgccaaggtgcgcaccgacctcacaaacaagccttcccctcctatggcctcctggggcttcccgtccgatataggtgaggaagcatctttctccgttgacaaggtggggtgtgatggaggtgaagagttctcctctaaggagtatgattggaggttacccatcggtggcaatcaccatcggagctttttgtcaagcaccgtcgacacccttgggtggaagccatgtctatactcccaaaggttccatcttcaaccctataatatcacatttcttagatccacacactaatctctattgtaccagcggagtgaccacccatcttggtagcgacgacatgcaagagtactcttctcgaccacctcagatagaccaaagtgacctaaccaacaactgcagtgcacgacagatctacttgaccttcccgcctgattccatttttagcaaagaggacgtctgcaactactttaggtatcacatgttccaccatagtgcccctattgatgtgtcttgtttcaatattggagcatttcataatttaatgaatgcaatctgttttggcttgtttgtgtcatgtggggcaaccagcatgtatgggatggtgcaagatgtgcgtatcccataccaggagaagtgcatgtttggtttcgtcaccttcgcctaccaaaagacagtgaagctaattcttgccaagggcaacccacattacatctgtgatgcacgtgttcttgtcaagccatacaaggagaagacaaggtccccaacaagttcaggcatgttaatcattgcctaattccacttcgtatttttgcacatatattaccttttgtgagtacttctattgattttcttaaaaattgcataaagtctattgattttattaaaattgcagaaagtttcagcaaagtgactcttctagctacatgaatcccaatagattgctttattttagggggccctttgacctgcgacgacaccaaataggtgaacagtgatatctatgtggtgcttgtgttttgatctcttttttttaacaatttacaaggagtgttacattgtgttagggccgagaattttgtatagggacattgctagtcatgaggcatcttttaggatgaagcaagatgaacaacaacatgcgaccgagctgcaacgctgttgcttaatgaggcttccgcttctcaatcttcaggattggggccatcatctcagctctcccatgggttcacatgtgcttctaggacaagttgataacaaatataatattaatgagaatgacaatcccactcatttggaggatgtcacatttcgaggtctagttcttggtcgttgtaatgtcttgtctattaattatgttttttcggaaagtttattaattatgttgtactaaggttgtgacttcttgttttatttatagacaataagctgaagaatgagtttgctatgagggaaattgcctctactgcaatctccacagcagccaagcgcacggtcatctctacggaagaggggaagagagaatatggtcccaaggcagcaacacctaatgatgcttgtggattcctggaaaggtaagatgatgatagaaaaaggtttgctagatggacactaaaacgtaggatatttattttggaaaaaggacagaatataccattaaacttgttacctcttttatttgctatatttttccttttttttcacatgtatgttatataattctctctgacttaaacaattcttgctttagaagcaaatacaaaagaagataaggagtagacaattaataatgttgatcaaatgtttttcttgattagaaggaaccaatgggaaaagaaatgcaaaggcgaggataggataaagcagttaagaaactaattagcacaataaatgcctattattaagtagtttttgtgcaagtcatgctagttgccgaaggactttctggtattgatatgtttgttgatgtttgtttttctggtattgacatgtttgttgatgtttgttttgtagtggaatggagtacaatttgcctcatagccccttctcatctcccaccaaggc

SEQ ID NO: 55745 - DNA, 1089 bp, Oryza sativa
ctctagttcttgggtatatggtattactatagtaccagtcttttagctcagtgtcaagacaaagtatcaacttgtatgctcttttaaagtatgagtcaatataataaaaatatatcgtagctcatgtagtagtaacaaatactagcagtctagcagtgtgaagtggaactgctacatatacaaacattgaagagagcagtatatcagcatctgctactaaccaactgcttctatttagataaaaatgcttcgcgaattgcttgatacctgggccgtagcttgtccagaggcagcagatgttccttcacgagtggcaagcccagaaaaccctccatccatgcagacagccaagggaacttgtcgctggtgatcagcctgacaccggtgatgtcctcatatatcggaatcacatacgacagggagcccagagacaagtcgacgaacccgatcctctctccaccaaagaatttcttctcatcgagcaccttttccagaaccagcagctgctccatggcagcttcgtatgcatcctcctgctccttgccttgtgtggtgaaccacttccaaattggaggtgacagctgcaattgtggataaatgattacttaaaagtttagacttgagaaaataaacaaaaaaaattgctgaccttgtccagcccaaatttggaccagaaacgtgccatggcacattcatagggatcttcaggcaagatacggtatctcaaatccttccagacatcatcgatgaactccagtatgacgtctgattcagcaatcggcttgccttgatagatcagcacggggaccttcttatgcacggggttgcactccagaagcaagttgctcttgttcctcagatcctcctcgatgtagtcatactccacgcctttgatccttagtgcccacatcactttgacaccttaagggcttgaccatatgcctaacagcttcaccttctcagctccatcttctagttcttggtgatccatggttgggactgcagagcaatgttgtgagtgagggtttcagtttgaacaatttggtactagataccttcactggtagtttggtactagtggttttcttg

SEQ ID NO: 55746 - DNA, 2913 bp, Oryza sativa
  unsure (1)..(2913): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatatacaagacaagaatagaaaattgattgtgtgctttgcacctgatagagatctactatctctcatttgttttccggcctgcagtgcaccatttcttatcattggcatcagtctaatccaaccaatgttgcaatttgctccgtgaaataattagtgacagtacaatatataatggtgcaaagtgcaacatttgcacaaaaaaatatatgatcacaatatgtatagagaactaacaggagaagtctcataaataaatggctcccaaacatgtatgtgccacaacatatcaacaatcagtagtagttagcaccaacaaattaattaacaaaacaaacacgacctttgtatatacaaaagaaacctattaagcaaacggaatatatatagacgaatgatctcgctagctacctaggaagaactaaataatgaagcagtcaacaaaaataaattgcacacacatatattcctaaatctcgatgatgtccatgttcagtacgtaattcagtaatgcagtagccgagcacaaaaattctcagaacgcagcagcatgcaatatatatgtatatgtgatcattactgtcgtgatatgtaatgatccccataattctctatcttgtactgcggcacgccaaggggattctgctgcgtaagcccagccatcgccgacttcgataaacccttcagcttgttgctgctcggcagtagagtaccaaaattcgggacagcaatgacattttctagggctttcaccattgctgcctgctgctgctgcaagttgtagtagctgcttccaattccatgggctcctccagctccaggcgtaatattccaagaagagacgtgctgctgcagaggagcactatagttgctgctgctgctgctgctgcttttgttgatcaagctgtagtagtttggctgctgctggaagctaacggcagtagtattagtcgtcgtcgtacttgcagaaacggaataaaccgcgttgttgttgttgggcggcgccgacaagatgttggaagagttgctgacgaagtagatgctggggtcaatgatgtcgtctagctgaaagaagtcatcgccgccgtcgatgtcgccggcttgaacgacggagctgccgctgttgggggtttcggcagagtactgatccacggctgcatactgtggttgctgctgctggttgttgatggcttcgtctccctgcttcttgtggaagaccttgcacacaacccattcgtccttgggattcagacgaaggtttgggtggtggttgtggaggttggcgtggagacggaactcgtgcatcacccagttggtcttggtgcccttgggagccctccccatgtagaacaccagcgtcttcttcatcccaaccagctgcttcttcttgttgctgctgcctccatagctgcttgtattaacagctgcaggctgcctgaagatctccctgtccttgccggtggccttccagtagccctccttggtggcccggttggttcgcatgccagttgggtatttcatgtccttgtggctgaagaagtaccattctttttcccccatcttcgccttgccttcatcaaattaatatgaaaaacaagcatattaacatcaagatctaattaactacttgtgcatctaaatataagcttttggatcgaagaagaaaagaaaaacaaatttgacttacttggaagatcccatggctcgcacttgttgaggtcgacctcgccgatgggcaaggaggtgaagctagggttgagcaacttctgcaggaggtagcttaagattacctcagcgtccgtcgggtgaaacctgaagcctggaggcaagaacaagcctccatcttgctctaatttcacaagggatgtagtagactccaccatgctagctagctagcttgctccctagcttgaattgaagctagactgaagatggaggaagcactagctctagctagaggagaaggagaggaggagatagcttggtggcacaagcaagaaaggtggagacgacgcgcgatgaatgggaaatggaacagaaatgaaggggacaaagccagcaagttttataatgctttgagaccttttccatggttttgaggggaaggccacaaaaatcttggttagcaaggaagacaagtcctcactcggtttcattatgataaagaattaatatatgtactatatataaagtgtggctcttgccaaactaagtattttgtggccgtcaaattaatcagatttatatatactacatgttgtgcttaattagatccccatctatctatattattattatattcttcttctataatcttataatccgttttgccagataatgctggtgacagctacggctaggaaccgacctaaaagaaactaactgtccggctggaaggcttgtgtggtacgattgaggactacttaattaatttccatgtatagtgctcagaaagatacaaatcactgttctcatctgctcatggtataatagcatgccgaaatttgttacagatgttcaaattaaatttatggccttgtttagttacaaactttttcttcaaactttcaactttttcatcatatcaaaactttcctacatacataggctgtgtttaattcacacaaaaattggaagtttggttgaaattggaacgatgtgacgaaaaagttggaatttatgtgtgaaggagagttttgatgtgatggaaaagttggaagtttgaagaattattttggactaaacacggtcataaacttccaacttttccatcacatcgttccaatttcaactaaacttttaattttgacgtgaactaaacac

SEQ ID NO: 55747 - DNA, 9719 bp, Oryza sativa
gtgtggcatgttgttgttgatgttatagtttagtgtttggtttggatatattagagggctgggaggagcaggaagctcagcgatggcgtcggatgagccgtcgaggagaaactgcgagagcgcggcgcagtcgaggttgttgaggagatcggtgagggagcatgacttgctcatgctcatcgccgtcatgggctggaaatctgactgttggttgttcatgtcaggtggagcaggaggttgttgagaggaagagttgttgtcatggatgtcttcaagctgttcatcgacggttgatccctcgggttcttggtcgtgttggtcagaggaattgaagtcgttgctcttcttgtggattctgcacagcacccagtcgtccagctgatgaacaatatcacaaatgcagtaaacaataattagaagtgtgcaaacttgctttatttatttttaaaataaagaataaaacacaagctcaatcaacatcaacaaatttgactttgtagagtgagttaactaagagcaacatgcacgtttgcttccttcaatatgccaattcaaacaacgacgtagctttcaaagaagacgtacgacgaagagaaaaacaaattaataatgaactaaaattaagtaattaaatgaatctcaccctcatggtcatggatgatgctctacgctgctttgtggtggtggtgttgttagctgatgtgcctgtgaggcgatactcgtgcatgatccagtcggtcttgacgcccttggggggcttgcccttgtagaagactagggccttcttgacgccgatgttgtcgctcgtcggagttgacaagatggacttgtcggtgccggtggccttccagtaccccgagccggcggcgcggttggggcgtgcgccgttggggtacttgcggtccctcgggctgaagaagtaccattcgttctcgccgaacagcgccttacctgcaacattccatatccattttcaaagcccaaaattaaatttggtcagtttgaaggcattaatttgatcgagtttaattgatacatggatagtttatatatgtatggtgattagttagttagttaccaggaaggtcccatgggttgcacttgtagatgttgacctcggcgatgattggcacggggcacttgatggaggcggcctggttcatgaggtagtgaacgatgagctcctcgtcggtggggtggaagcggaagcctggtggaagggcaggcatggcgccgccgctgctcggcatgctcagctccttcaatcggctcgcctagctagattttttttctttttttaaaaaaaaacaaacaaacagaataacagatggtgtttggtcagcgtgagctgaaggaagaagatgacgacctggctagcttagattacgtaggaggaaaactggcactagtgaaggaaggaagctaataagctaaggaagaggaaggattgaaatttttgagatggagggggtagggctctcttttatagacgccatgggcttggctcatcttcttgctgttcgggagaaagagaggtgggtgcatggatggattactacaaagcaattgattaatgagagctaattaactaggggcacaatagacaattaactagttattagtaggtggcgtggatgtgagtaccaaagactggaccacatttgacacttaaccatgcatgtcagattaaataacttgaaatttcagcgtccaagcgatttagtcgtaagttcagtttgacatagggttgtactacttgctacctcctttgatcgttgcattttttgtcaccggattactatttatttgcaaagtttcactatttatcttttttcaaaaaagaatgacattgttcttagtactctctatggcttcatatgttattgaagttagtagcaaataattcaaaaagtcaaatctaactcttgtaaaattaatcagtggcaaatgaaggtaatacaatgaaagagccatacaaatatatatttcaatcgtcttctatcttcattccaaaataaatttattttataatatgaatatagatacattcaaaataaatttattataaggcgaagataagataccatgagaagagaatatcgtcaaaccattaaccatggcatgatatactaaaacaaatattactccgcgtacgtagtagtaccacccaaggacaattggtaatgcaagaagctaatgacctgtccttggcgcatgcatatatacacagtaattataattgtacgtacgtggctccacgtcagctagctaccagtgggcaggggggaccacaacgtacgtgtggtgtggataaactcatgcatatggaagcaaaacaaatggatcgatcggctttaatttgttcttcacatactgtactaaagacgatgacgacacatgcatccagtagtacatggatttatgttgagccgtccaggtgtcaactacgcattgccgccaatgatatgtgcaccgatatgatggttccgtcttggcagcttgtgcgcgtggcacgctttcgactctttcttcttttgttaggccgaccggtgggccccacctacctcgtggaaaccacctgcatcgtcactccatgggctctaccctcgcttacactagacgacaatttggttgacgattaattaaagggttaattggatccatactactttaattttgcccattcattagatctatgctattatcatcatgtttgatattatcatatagactaaaatatctctagacgtgagatccacatgttagtcatatcttctttctccatcctcccattttttctcttatctgccggacgacacaacgcctctatctgcatctcgtcctcctctcgatctccccacgccccgtccgctagagaccaaggcctcgccctctctctccatctcatgtcctcctcctcccgatctcatcgtgctccgctcacttgctagagaccaaggcctcggcctcggcctcaaccttcaggacctcggatctagaggatgaaaggcggaagcatgctggccgtcgaagctctggtgccccttgcaacaagcatcaggatgacgacgttgatcagggagccgcgagcaaggagaagggcggagctctggtgcctcttcagacgagtagcaggatggccggctagggagcgatgagcaaggagaagtgcaccggggaggggggatagtagtggtggtggattgtcatggccaaagctcctccatgcggtttgcggcacctggcgcaccaaagaatttactatttgccatcttttcaaaatgtacatgcccaactctcccaaatgttcacttgatttgccatccggtcccatatgtcagcctccttccacgtttggacaaatgagatgtgggatcaggtgatgaaggaggctgacatgtgagaccgggtagaaaatgtgaatgaaaattatggagagtggcatttgggcttgtgcattttgggaggatggcaaatagtaaattctccccctgacgcgccgatgccaagcaacaggacggcggtgttgcccagggagcacacacgcctaatccgagtgctaggagcacgaatatttccatgcgacacatcatcttggcctaaaaggaacatcgtcttggcgacaagtgtgatgacggcttccgtaacgaatgttaccgccggctgcatccatgccggcatgctcgtgtcctctactcactgttgcgctctcttgccggttgaggaatggggatgagacagtgtggtagagaagatgagagaaatcatggagtgacatggttcaaattttataaatttccagtgacacttaaccaatatctcgaattgtaatagcacttttttgaattagcaaaattgtaatggcatggatcaaattaaccattaattaaagcgcatgcatgtatcatatcatgatgtgtagtactccatccggcccaaaataacttaatctaggatagaatgtgatatatcctggaataacaaatttggacaagtgttatcgagattcgttatcctaaaatatgtcgtattttatccaagattgagttattttttttagatgtagggtgtactctcttcataaggtaccctgcactaaagccaaaacaaacagatgaagcacgccttgactttggtgtgttcagttcacgttaaaattggaagtttggttgaaattggaacgatgtgacggaaaacttgaaagtttgtatgtgtagaaaagttttgatgtaatggaaaagttgaaagtttaaagaaaaattttggagctaaactcggcctaagacgacgacgaatgctccaaattgacaagatcatgatcgatcgaccgatatggatgatcctgctgtgcacatgcatgcagcaaattaatgcggcatgtgccatggatatatagagtatagaccagccgcctgaaaaatgcacgtgagtaacgttgataaagtatctcccacgcggccggagctaactagctagatgaggtacacgtacgcgcgatggacaacttcaataccaatactggtactttgcaattttttatatatatgaaaataaatttatttttcattcatctaatacatactccctccttcccagtatagtggacgtttttaactttgtactttcaacgtttgactattcgttttatttgaaaaattagtgcaaatataaaaaagataagtcatatgtaaagtacttttgataataaagcaattgacaaacaaaataaataataattccaaaattttttgaataagacgaatgatcaaaaattataaaaaaaactcaaaaagacaagtaatatgggacggaggtagtaccaatatatttttgaaaaaactcaagtttaaaacatatcgatcaattaggaggagacagaaagtacagcgtgtggctgctcaaatggaccggtcataaatctaaatctaacagctagaaaggagtcaaagaattcggcccacgtgtgagtgtgtgcattgctggctgacggcccaagtgacgaaatgtgtgaaagggacgtagtcctacatacgtacgtcgtagtaccaaattaattaataacgcatctaataattttaccgagtgaatactactcctacgtaccagtataattcttccttatttcatattcaccactgatggctatgttctaccagtacaattgacattctaccactggtggctgccgatatatataaaaacaggctagcgagttgggatgaaaaaggttcgaaaatttttctactctagatgttcacatttgtacttagtattgaggtggttagttaaatgaacgttttttttttcagtcaggtgttttagatcatttttcttttgcctaatcgctattttttgttttggtactacttatagttaccaattaaataattgttgattattgtagttctatcggagagtgaagtatacaattatttgtattattaccaattgatgacaatcgatgaaaaggttctatatgcagattggaatatttggaagcatcgaaatggttatattaatttttgataatgttgcaccctcagttttctcttgaatgacattctttaagaatgacttatcccatcttgtttttttgtttaagtttagattaaatatcagcgtctatctcctggataagtcagttgtagtaccttttattttaacctcctttttataatatatttactatgggggcttcctcatagtgctttcataaaaaaaagatgatagatttattatttttaaaaacaataagctacatctctttgttgatttgagaaggccagttagaattgtttttatattccgataaacattgttaccgtattcgctccgatctatattcactctattttagtattcaataatattcgattccgtttttataaccgtggttttcaattctgagaagaaatggaaacgaaaatggtagagctagttttctagctgttttcattcctaccagtgattatatatatataatcttaattaatttacttacaaaataattactagtcgcaggcacatctggggacgtatgacgtgcaagggctctaggcgtcaaagggctggtacctttcttccttgcccgtgcggatggaacggattatctactaccggagtacttgactaaaacaaacatcagatccatatagctttatagttggccttattacacgtcacgatcttgacacccagttcaacaatcctctactcatttctaccaagaaattctagcttgtgataagtacctataccaatccagtttgcatgcgtccatattagactctcctgtcaaaagatgttcgttcatatagatcgatagctatgtcaactgtgtattatatactagtatatcattagcaaaagtcgtacacaaagcaagtaaagtcatactgtagggcttttttgtcaggcgctatacaaattaattgaaattaatgttgaagggtcttaaaatgcaactgtactgcattcagatatgcacgcatatccgttcatgcaaatatatctatgttgacgtcttaaaatcgcacgtataataagttatttatgatatccatccatgtacggcccgccgtgacgccgccgccgcacgccgcagcaacgcacgccgccgcccgcgcaaccggctgtctccaaacaaatttagggttagtgtcttagggaattggggatttttggaggaggggatttttgtttggaaatgggctcagttgcggcccaagtggaatgcgggccgagtggaaagggggaggggagtggaaaatttaggcccaatacaacagaaatggtaaaacaaggcccaaataagtagcttctttatctttttgcatacatatatgaactatagagtatatatacctattttttgtccaaaaatctttggtatacatctgaatacccttgaattatagctgggcctgcccctgcacgtacctattaatcatgtgactcatttttgcacaaaattactacgattcaaaagtactacatgggtgcaaagcggtcggtttaacaagaaacctctttctcgttaaaaaagaaaaacctctttctcaacctactagaccaacttaaatttctaggcctactaagcctacttagattcattgtgctatcaacttattgggccattcttttcaggatacctatttagttattgggccttaacgttgagccaatatctgctgtaatcgaccctgctcatgctgttatgcagataaattaattagctgcttaattaatcacttacatccgaggccatgtagtagaaactggtcgcaacgtagagctcgtcctgcccagcgccaccgccgccgttccacactccgttgaagctgcagttgttggtttcgcagggcgcgtccaggttgagtgccttcaccacctcatctctgcacttgtggtagtctgctccttgtggcgcgccgttgcatcatactgctccccgttataaatgtacttacctttaatattccaaggattggcacaattaaaccacttgattaattataattagaaatgtagtaaacaatggattaattacatactccctctatttattataagtcactttgatttttttagtcaaattttttaaaagttcgaccaaatttatatacaaatacaataatatttatagcaccaaatcaattttattaaatctaaaattgaatatattttgatagtttacttattttatgttaaaaatattattatatttttttataaatttagtaaaaactaaagaaatttgacttagaaaaaaataaaacgacttataatataaaagagatgtatttcgtaaaacggaggtattatatatgatgcatcttgaagaaaaaagatgtgtaaacaaatctcaaggaacaagctagtaccgcaaaatccgcgcagcatgcagttgctaaatgtcccattcttcctttttaggatctccacgcgagaagcccgagcaccatagtgcaggtaactgcagattgatgattattgatcttagctagtaactacagtgataaaaagtatgcataattccttcccatagcttcagttatatattcactagagaactgttcaacaacgtagcagactgaggattgatcttagttaactgaacgttacactcttgaaaaccttattattcagctgctggtagtagagattgagatgtaaaatgagatcgatctgataaaaaaaataaaaacgaattaagttactgacctgtgcacataaacattgtaatctcttcctttaagatactcctttataatgtaaggatcctgcccatcgggcatttctggagcattagcagctgtgcctgatgagatggcataggccatttgcacggatccgcctccgagatcaatcacacccacagttttggagtagtcacctcctaatctatccaacaaatagttaagtgcaacccacatgtaagatcattcttgagatccactaagaacattaatccagtttggattgtattggaacttggtcttggtgtggacaacatctctaacctgtattatgaatcaaattgctgctagtgatatgaaggtgtttaatttgtatggtacgattattctgaaagtatacttaccgcttcaagaatctagtttgtcttgtcatctccaataagtctgagtccagcagttgcctacatgttcgattggcaagttaaaaggtttttttgtgagtaatatttgtttcaatttttctattttaatttgttcaaggaggaaacatatttttacaacgttacggtaggaaaatggtttcaactcgagtgatactccctccgttcgctcttacaaggcatattctaactctacaaatgactttaagactaaatttgaccattaatttctgataatatatattcatgataagcatgaaactaatattatagtagtatatgaaaagctctttgaaatccagatctagtcttataaaactgaacggtggaagtattctaacttatgggtaaaggatataagcaggttcataatcctaataaatcaaatctgctcacgagcgacatcatcggatttcatgtaatccgtaaaaaaactgatagaaaccaatgaaatctggataaattttatcaacaaaataaaattcactttaaactttttaaaaaattgatcgaaaaatcaagtggtttgtgtttacgacctggtcaaaaagttcggatttcgcgagatctaaatcagatttaattgaaattgggaaccctggatacaagagactacttcgtcacatggtccaatatttttttcttgtctgtattgatgttgttctcaagtagttgcaccaatctcaaaaccaggggccaacttaaatatttgattaaagtcataaacgtctactatatctatcgttttagaaaagcaaattagatgaaaagcaaattaaattttgttaagtacggtaccccaagttcaaggggagttttgttcataagccagatagggatagcgtggttggccttgtcaagcagaggcattatggattttgctgcctcttgcggccgcccagcgtacgagctcagcccaggatccacctgcaaccaacacaaaaattatgtttatatatctttattagtagtagtagtaattaagtagtaggaggataataattatctttagcagttaataagtactctcaccaattgataatacttgttattttgaacaaacatgatgtcaaactttaaa

SEQ ID NO: 55748 - DNA, 7923 bp, Oryza sativa
ggaggtgcctaaaaggtttgcaacttcatcctccagcctccaaggatcaatttcaagggtatctacgaactataccagctggacaccctcgacgtctctattatgagttgctggattttgtaagtatcgttcagttagatttcttattacgtttcctttaattaattaggtccttgtatataagtagactatatataatatatactcccttttattgttgtagaatggagattcaaagggcccgacggcagggggttttcgatactggattcatcgaccctcggaaagtaaacgtcgcaatgctcgaccagtatccgcaagccacagaggacaatctcgtccatctcctgaaggcgcagcattacaagacgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacctggagacctgcaccgtcaacgtatatgactcaatggataaaaaagagtctacgtttgacaaggttttcgaacttatagacaggtactgtcataagttcctatgttaattaagaatcttgttatagttaattgctactacgaatcatagctttaaactccatgtagggcttggtatcggttccgtcatttggtccgcagcaaatggagaaaaagacttaggcggaagttcaattttcttgtgagtacacatgctctacatttatatttctccgattcaaatacatacaagtgtatattaattagatctctcgtcgtttgtcatttatttatagtgcgcaaagcaaaagcagggaactaacttgtgcggctactacgtgtgcgagtattgccactgccttgcagaccaaatcatcaccacaagagagctcaatgtacgtacaaataaattcaaaatttcattacgtatcgatttgttgtttaattactaattaatttcatatattcatatagtttattcgcatgagggataacctgatcacacacaaggaatttatcgcggcggttcaagaacaactcatgggattcatcaacgaacaaatccttgatcccaagggtgaattctactacgacggaaatacaattcataggtccttagcttctaagatatcaactactactacgtcgaaatcgtagctagctaggacatataaaggattgtaattaatacatgtctatgtttctatatgcatgtgtacacatttctataatgtaaatatatattttggtcatatatatatatacatatgcatttgcataacatatatatgtataaatacatatatattatgcatgtacatatgtattgaaacatatataaatataatatatatatatatatatatatatatatatatatatatatatatatatatatatatatagtaaatttgtttggtgctccatggtgcccgggcaccattgttgaaattgagtacatacccaattcaaatgagtatgaaactttttcaattcaaatgagtatatatatatatatatatatatatatatatcgtcatataaatacttctttttgacgaaaaaagataaagccagtctacgaaaaatacatggattggttgggccaaaattttcaaaagccataaaagatatacaatgaaagagagaaaagtgagtttgtgtatcttgtggatcatagttaaccttgaaaactctatggagcaatcaaataacatattggtaaagaatcattcgaagaacttacgaagcactctacaatatgcatcgacacaccgtgcagtatagctaaatccaatgtataaattgaactctaagaagctagcattcatagagaattatctgtaaggagtttatacaaactatgatgatgttctctaaatccactgagatgagaaaccgaatgtatggacatgaatgaatttgtgtcaagaaaaagagaagtccactatgctcaccagattcatcaatgcatacacaatcataattaggaaactatgtacaaacataccttatttccttttgctagctctaaatcctcaaatttatagcagcataaactgatctgtaaacccgtgcaccctagaaacttgataaattctcagtcaagcacctgtagcaagcctcatttgccctgataaccactcaatttatattagcccactgctcactgaagcactgaatgtacgtacattgtttcatctttctaccagaaattagtgccgatcaaaataattagttactctctccgtttctaaatatttgacaccgttaactttttagcacatgtttgaccgttcgtcttattgaaaaacttttgtgaaatatgtaaaactatatgtatacatataagtatatttaacaatgaatcaaatgataggaaaagaattaataattacttaaattttttgaataagacgaacggtcaaacatatttaaaaaagtcaacggcatcaaatatttagaaacagagggagtatattgttaacgaccaaatttcataaattctatcattattggcatcggagatgaagatcagatcgaagtggaatccaagatgaagatcgttgcggaaacagagtaagaatcggctgcagtccaaatcggctaaggtcaggtcgacagagttcgagtcggacggggctagccgatacagccgattagccgatatagccgattccgataatatgactcggtgtacgtcatcgggttcaagttgatgtgtttcaagataattgccacgcatggatagagtcctgggaaggcaattgtatctattaattagggtattctatgtaatttctttagagatatgtttgggcaaaagtctgccgtaaagacttatggtatcttagagtttgttagagataatagtcgtgtctattatggacgtatcttgtaattctcgggtataaatagacccgagccctatgtaaaaaagaacaacacatccaatacaatctcggcgcatcgccaccctttatgctttacttttatttcgacgagttcgtgctctcgggttgagctgcatcggtttctgtcggtgacatgggatcaggagtatcatgactagaggtttgaggcagacacaatcgcccacgtcgcgcctgcttccggcggaagtggaggtaggtatgggccgtcctatcagaaggtcattcggacggcaaccatacaagtctccatctgtttatgaaaaggtggggtaagtccccacaaaaaaagagagaaatggtgcatgtggtatccccttaagatataaaaggaggaccttgcccactgagaggggggactagacttttccagattagaaacccagaacaagggagaggctggctgatactttgtagctccttcatacacagatctcccaaaacataggagtagggtattacgcttctcagtggcccgaacctgtatacatcgcctgtgtcttgtgtgtttcctgtctcgcgagccttccacatacagagagcttagaatctctccctgagtccccggccgaaccggcaaaggggggcctgcgcggtctcccggtgtggagccccacgcttcgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacagggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacatcacccgcccgtcgcccatgacccggagtctccagcccaacgttagctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacgtagggcgcctcctcgtccggagtgtcacctcaccacggacgcggggatcagccctccgtgcccccggttggtggtgtcggtagtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgctaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctagtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggaccgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcttggggccaccattgccaccgtcgatgggggagcgtgtgctcacgtttctcgccggagcttcaaggccatgaagcgagagcttctagccgcgacccctactcatgaggcgacgtgtcgggcgcggtggtcggaggttgccctcaccttcgaccagaccgaccacccaccgtgcgttgcccggggagggcagattggatggtggtttctcccaccgtttgcaacgtaaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgcctggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgtaaggccggtccggcagaaagtgcggcggcaggccccggaacgtcaagccttcatccgcgaggaggtggcgcgacttctggaagccggattcatccgtgaggtcatccatccggagtggctggcgaacccggtggttgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccactccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagtaggcgttactcttatttaagcttctcaaacgctccggaccgtttacctggacggaggaagccgaaaatgccctcacccagttgaaggcatatctaagctctcccccagttctggtcgccccggagctagacgagcccttgttactctacttagcggcgaccccgcaagtagttagtgtggcattggttgtggagcgcgatgagaacaattctcatttcacgcttctccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccaggaaagagtagggagaagaggcccccgagccgaacggaggcctaaagcccctgacgatcggagttggccctttgcccgcttttctgatgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaat

SEQ ID NO: 55749 - DNA, 6250 bp, Oryza sativa
aatacgagggactccttgccggactaagagtggcagctggactggggatccgctgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcagctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcgattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcaaggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaaacacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtcgggcccgatcactctgcgtcgacgacctcgtcctacgccgcgtccaaacgcgttctggattgagcaagctttcaccaatgtgggagggtccgtatcgagtggtcggcgtcccccagccgggctccatacggctggccacgggcgacggcactgagctgcctaacccgtggaacatcgaacaccttcgtcgcttctacccctgaggggggggggggtcgggtgtcaggtttcgggctcgggccaacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccggggggggggggggggaatcggcaaaaacccacaatcgggtcacccataaccctcggtcaccacgttcccggcctggccagtctcgacatgtggatctccccaggcactagcccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccgacggacgagtccagcgcgccctgcagatcggcgatggtgcgttcggcagctgcgaggcgggcggctaagtcgctttcgcccgtggccgtcccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgcttcccggatggtgacggcggcctcgcggtccgccagatccctctccacgacgctggcgcgctcttccagcgccatggcgcgagcctcaagggcctcttcgcgccgctgggacgccgcttcggtctccgccgcccgctgttctcgggcagcggtagcgtcaagcaccccctgggcggcgtcgagcttcttccctagctccgcctcccagctcccgtattgaaggcggagggtgttctgcgcctcgttcatcacggtggtggcaatgagggcagccccccgttcctcctccacttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagtcgccttggagaggatgccacgcggctcgggccgccgatggaagtgccggactcggggatgtcccccggacccggttggtcctgagcgtcgcccgagggagtgtgcccaagcgacgcgcccgcagcctcgtcgccagctgccccagaagttgtcgcctgagcgtcgcccgagggagtgggcccaagcgacgcgcccgcggcctcgtcgcgagctgcctcggaagtcgccatcgcctcgtcctggcgaaatccgacttcctcccgagcggcttccccggcctggcgggcccgggcggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttgggatggcgggagggacgcgacgggatctcgctgaaacaaaagaaaaaaccagaagacgaacaagatgggtgagtgaaaactcgcgttgagaaaatgaatacagccacgatgggtgagagacaaacctgcgagggggtcggttaaacgaccactttggaggggaaatgaggtttccccgagatggttctgtctccccaatcttacggggccgcttcttcttgcgctccccctcgggctgcgatgttggcgcggccccctccgggcgcctgttactggcacgcgccgccccgccccctcggggacgagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcgaacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcaccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagatggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcagcgaaggcaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtcccccc

SEQ ID NO: 55750 - DNA, 1017 bp, Oryza sativa
cacctaaccacatttattgcggtttggctgagcatgtcacgccgcatgtaacgcagtgcagtgcactcgtttatccggtctgtgaccagtcacagaccggtcagatcgcgggttaggtggcgacaggcgatctgacacacgcctcgccccttcccgtcaggacgagggcttctaggcgctcgtccccagctggagctagcgtgttacctcccagagatggcacgttagtcctggtcagatatatgccaggcttcatcctaaccattacaggcaagatattgtatgaagaagggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaaggtggggtaagtccccacaaaaaaagagagaaatggtgcatgtggtatccccttaagatataaaaggaggaccttgcccactgagaggggggactggacttttctagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcagtttcgatcttcaacaagaggtaaaacttgtcatgacgacttatgttctcaagattagtgcttccatctttatgacactctaatcttgtctatataattcgtcgagttatcatatatttcacataatctttgataatatcttcatctaacctataatcggctaa

SEQ ID NO: 55751 - DNA, 2735 bp, Oryza sativa
accatgtatatccagtagatgccggatacaggaataagtgaattccataataagattattgtaatgcaaaaatgttagaaaagtgatacaccaatgtctaaatgagcaggtaggtcagtggtttcaaatatttcagaagaaaagaattagcaggatttagatggcatgaactaaaaccactaacatcctgactttctagtacacaactactgtgctacccatcattagttcattgctgatgatttggcattcagaaggagcacccatcaatgatcaccgaataataagaactcctgtgccacccaacaatctaattgaactcactaaccaccagatatgatcattttgtgatcatatgaatttcatgtcagtaaggatccttttgcgtgttcccccaaaacaatgtcagcaaggattaagcactacaaaattgcaaaataaactaaattggacagaatggttaactggagcatgaacagaataaaagctaaagctaagttgcacattagtaactaccactgtgtggagatctgaaaattagtgatcagaatttttttttatttttcttttctcagaattgaccaaattgagcagctaaaagaagcaaaaggactaggtaattgcacctaagtaagatcaagtgatacttcagctctataaattccccctcaatactaacgtcccgaagcctgaattgggcgccaagcagaggcagtgagaaggcacagatccttccatccgagcttcagagcgccattctcctcaataagcgtgtatccatcggaagggaacatcccaagcagcagtgcagcctgagcagcagcgcttccagcaagcgacgacacacggaagcccgactgcgcaagcttttcgcgccagctcccaaacttaacatcgccggtgcgtgctggaccgcccacggctagcacattgcggatctcccgcgacaagagttgttgctccacgacatgccgattcgggctatcctcgctgtaactcgcatcaagcgagtcgaacagtgccgaatagtagtggatggcctccacaaaacgtgccaggaaggagcctgagtggctcagatcctgctccaccattgttacaacctttggcgccaacctgatttgtgtggtccacagagtcaagatcagtacacaaattaattatgattctgttcacaaaatgactcaactagcaacatttagaactataaatgataacaataagttctcaaggacacctaaattggttgccttgccttcatggtttttgcaagtacagtgggacatatctattgcagtccactactatgtgatctctagtatgaactgtgtatagattgcagccatttcaatttaataatcaacattggtggcacttagaactagaaagctgagaccttttggcatgaaaagttggtcatgatgataagaacttttagctcgttcatagtgatccacaaaccaaatggaggagaaatctttcccacttctcggatcaccaaagaccatggagaagcttgataccacagaaccactagaaagttgcaacctttctaagcctaaaaagttggccataatgacatacttttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaagacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagggctccaaaacgcaaatctttttttactcctccttaatcatcctatggtgatctagggctagtactactaaccactgatatgatgatgcatagatagagtatactactaggtcacaatgtcaatgagaagtatagggtgtaaagtagccatgattccggggggtcccgagttgacaagggaagagagaagaaaagtgtagtacctctggatgagccagagcgtgttggagtcggagccggtgacatcgtagagggagtggcgcagccagtggacggcgacggcctcgcggcgcgtgacgcccagcttctccgggtccagattcccggccttgtcagccaccgggcagaactcgaacggcaatcccagcgtgtccgcgaagtccgacagcctcttccccgtcgcctccagcgcctccatggacgcccccagcccggtcagcctcaccctcggcggcccccccggccgcgaccccaggatgtggaacagccccggccattggagcccctgcatgatgtccaggtcgatgatgtgcaccctctcctccctctcgaacgcctcctggatcgcctggttcgccgtgaagtgcgagaacttcacgaacgggctgatcccgttgaacacctggaacgccgccgccacgcgcccgtggacccgcgcgcccgccggggacgggctcgggagcggcgcgtacagccccaggcacgagctcac

SEQ ID NO: 55752 - DNA, 1267 bp, Oryza sativa
gcggcggcgaggtggtgttgttcttggtggtctaggtagaggaggagatggtggtcggaggggagaggaggcagcaaggaggtgatggcatgagaggaggaggagggagaataagaggagtgggtggcggaggaggaagaggaggggaagaggaggagggaggaggagcccatctacaaacgccaaggggaagaggccgtgggcatggcgagcggacgggcgtgcgcgggaggcctaacgcttgtgttgggtggaatttttatggaatttggcgcggcgcaagcgaggcgatggcgcgaagggggagtaaagaggaagaggccgagaggaggagaccaagaaggagaggttagcaggagcatatcacgagcattgagggggtaatttatgggggaagagaggcaacgcaacggcaagctgtctactggactggactgctaccagcgtgtcatttgcccttgggctccgtgtatcctttctttttcgttttctttttcacctttcccatggtagattactcgtaccgatgtttgtccctgttgtaatgttcacacttagcatgtaataatgcctttgtcaatatcatgtgtactgtctacaagtttcacactacagttaaaaactgaaaactttgtaaagcagacctccaaaaatcaagagtaaatttcacaaaactacagatactttgatcaaactatcacaaaactacagatttaagaatgtatttcacaaaactacagatttagagttaaatttatcatggaactacagatttaaggtattatatcacaaaactattgatttaacaactattttattacaaaactacacatttaaaaactattttatcacaaaactacaaattttataactttaaataaataatagtgctatgatctaaactctagaatatgtagttctttgataacttaatcactaaatctgtagttttatgatatggtgcattaaatctgtagttccgtgaaaagtttaacgctaaatctgtagttttgtgatacacattcttaaatatgtagttttgtgataatttgacacaagtatctgtagttttgtgaaatttactcaaaaatcaattgtggatcataagtaggatggagtataagggacctctcaattaagcgcccctttgaatcgtaggaatggaaaaatggagtgtcggtgacatgggaccggaagtatcatgacttagagacttgaggcagacacgatcacccacgtggcctaaccccctcaggggggggggggt

SEQ ID NO: 55753 - DNA, 10160 bp, Oryza sativa
  unsure (1)..(10160): unsure at all n locations
taaaactgaaccccgatagtgcgtgttcggtgtacctgcgggcaagcttctcgggtttttggtctctgctcgaggcatcgaggccaaccccgagaagatacgagctatagagcggatgcgccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagttctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggaggagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccatctactttgttagtgaggccctccgggacgctgagacccgataccttcaggcccagaagatgctttacgctatcctgataacttcgaggaagttgcgccattatttccaggcgcatcaggtcacggtggttacgtcttatcccctcggccaaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgcccccgaggccagctcgagcccatcgcagctgtctcacaccgccctctgggtgatgtagttcgacggcacctataggaaccggccccacctgtcaccaggccttagaagtggcgtcacacccgaccgcttccctcgaggagggcgatcgccctggcataacgccgggggctactgtcggtgacatgggaccaggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatctggtctgtgaccagtcacagaccaatcagattgcgggttaggtggcgacgggcggtctgacgcacgcctcgccccatcccgtcaggatgagagcctccaaacactcgtccctagccggagccggcgtgttagctcctgggggtggcacgttggacccggtcagatatatgccaggcttcatcctaaccattacaagcaagacattgtatgaagaggggcgaacatgcagattgataaactgacgcgtggtggacaagaatgaccgatttgtgaccggtctgacactggtcatgtcgtcagcagacaaccatgttcccacgtcgcgcctgcttccggcggaagtggaggtaggtatgggccgtcccatcagaaggtcattcggacggcaaccatgcaagtctccgtctatttatgaaaagataggataagtccccacaaaaaaagagagagatggtgcatgtggtatccccttgaggtataaaaggaggaccttgtccacttagaaaggggattttggggatcgagaacgatcagagagggagagagtaagagctctctggttctccagctctttggtagcttcttcatacatagatccaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctccccgtgaggagccccacgctccgtcatctggcgcgccaggtagggggttctgcgtgttggaggaatagaaaaaacataggattctgataagaatgtagttgtaaaacagaggattggaaaatacaggaaaaataaaggaatgactgtttgattggaccacaggaaaaatgcagaaatcggatgagagagatagattcaaaggaatttttccaagaggttggacctcttgctaactttcctccaaaatctctataggattagccattccataggaattttaaaggatagtataggattcaatcctttgtttcaaaagctttcataggaattttttccataggattgaaatccttcaaattccctacacttttcctacgaatcaaagggggcctaaaggatttacataggaatttcatatgatttaaattctagaaaattttcctattttgccatttgatctaaggaactgaagctttccaaatcatatggaatgactcgttatatgtcgatttcaaaggaaacttagcgagatctcaaacctcttggaaaatttcctttgactatatctctcttatccgattcatgtgtttttttcatgcggtccaattaaacgattatttctgtgttttgcgtctttctgttttacactcgcatttctgtcagaattatatgtttttcatattactctgttttttaaccctacgattcaaagggccctaaacatttcacatttttctcctcaaacatttgggggactgctaggaacgtagaattaaaatatcatgacaccttaaatccaaaataaatagaaatatatagaaaactgtggaatagtttggatgaagcacatgaaaacacacgtgatttaaaagagagaggtaggttccgacaaaaacaaacatacgatccatatgaacttcaaaggaatccagagacccaatcattcgttccaaagagccttataagaatttttctaatgagatttagggttagtttggtttgtaacctaaatagaccttaccaaattttgtcaatgccaaattttggcaagttttggcatgactaattttggtaaggtaaagttgtgtttggattgaagccaaaatagtctaagttcactattgaaatggcctatttttcttaggcatgccaaaatttggcttcaaaccaaatagacactaaacactattgaaattaccaaatattggtaagtctaatttaggcctgaaaccaaaccggcccttatatcctttgaaatttcactatttttcatgtgttcaaatggagctatgatagaaaaagaaaagaaatggattgattctggtgaaattttagtaaactcctcggtccaaaggagtattaaacaatgtccaaagtcgtagtttgtcatgcgatgcattggaattaagtgaggattggttctttcacatttccaattctcaccagagtcttgaggcaaaaatttcaaatactaaaatacggaaaatgaagaagaatattactgctgaaaagtgtgtgggcattattgtgacgctacatcgatctatcgtgtagaaactagtagaaaggtagcgactcctttggttacgcctgcggcctgcctgttgaccgactagcttgcagagaacaaagtttgggtacgcacgcatgcatatttgttacacgccgcgacatttcttcttcttggcccgataaaaagggtctttgaaacgttcttgtcaacgagtcttttgatcgatccatccatggatcattcgatatgtacgttgttggggtcggcaggcccgaaagatggccatctccatcagaccaggttagataattcatctttttcactaaaaccaagagaaaaggctatctagctcatgttcatgtagtagagctactaccttggtactcccactgtccaaccgatacaaacatttctggcatataaaatttatccaaattctgttatgatatcttacatttacttttttttatcggtagcacgatctttgtgggtccaaaaaaaactttcaaggataccaaagtagtttcaccttgaacttaatctctgctacaagctcaaagaaataattatatttttgtgaacaaagagagtaatcaaatcaaatcattttaaaacattatttttttaaaaaatatgacagtcgaattaacaagtggtaaaaaaaccaaatcgaactaccttgtggatgaaggaccgaactaaccgcacacaagaacaaaaatgaaggaggtgcggagaatgccaacaaagcgagatggggacagtgcctacgaatggaggccattgcaaatgtcacttgcggaggatgcgatggacgatgccagggtagagaccggcatagctggtgatgcaggttgctatggacgaaacccatgacgaaggatgacacggagggagctagccgtgaaaggatggggaataagacatgctatgaaggtgttgatgaaaaacacgagacctgggagatctgcttaactccaatgcaggtccaaaactcgccttcgggtatgcaagcgtgccagttgatttgatcctgcaatcaacaagaacaaagacaaagaaaccgcggttaaactcataaacgatagccgatcggctaagtgccgatgacatatcatttatttttgagccgatgtcatatatgcatcgatcggcaatcgttaagaaataactaaatctactcgatcggctgtagatattaacgatatataatccttatgtcgatatatacttaaatcaagtgattgggatagatcggtcgccatgccgagacagtataaatcacttagatcgaaatatatactaacaatgagactatatatgttcatagcatagccgatcagatagatctagcatgtatcggctaatactccgataccactctatattaagatatcaaagcaaataggatataccaaacaaagagcctaatatacttaaatgcggcaagatcttaacataaagggcagatttaatatgtcaataaagcatataggataaaagcagttaaaccaggtaagatcggctaaaaccccgatactaccctaatcggcaaccaagaagcaggctagagattgagattctaatcacgactcataagatcaaacaactgatgcagctataagtatgaaaagaaagacaatatctagacaatcaaaccattggaagtttcatagagtggtaggtaccttaggtaatctaagtcaacatcgatatctaacctaatcggttgtcctctacagacagatgttagccgattgtaggttaaatagcgatattgccagagattatgtaagatatatgataactcgacgaattacataaacaagattagagtatcataaagatggaagcactaatcccgagaacgcaagccgccataacaagttttacctcttgttgaagatcgaaaccgatgcagctcaaactgaaagcaagaacccgtcgaaataaaacgaaagcaaaaagggtggcgatgtgtcgagattgtattgaacgtgtgttaatttgattacatagggctcggggtctatttatacccgagaattacacaacatgtccataacggacacgactcttatctctaacaaactctaagataccataagtctttgcggtagacttttgtccaaacatatctctaaggaaattacataaaatatcctaattaatagatacaattgccttctcaggactctatccatgcacagcaatcatcttcaagcatatcaactcaacccgatgacgtacaccaagtcgtattgtcagaatcggctatatcgtctaacccagtctgactcggacttagccgatcccgatcatagccgatttggactccagccgattcccactctgttttcgggacgatctccatctcgaattctactttgattctatccctatctccgatacttagattaccaaatttggttgttaacagagggtcataggggccagagaggggagcaagactaaagacgtagtggcagaagatgaattcgatggattgccgaggccggtaggtgcggggtacctatgccacgccttgtgagtgttgaagggttgtgatgctagcgttggatctcttagggatttagggttatactttcatgggccttagttgatggtaagggtgaaaacggtcatggaattttccaatcgaccgagctttgttttcgtataaggggtaccatttccgaacgtaccctttttagctatttataatttttgttttttctaatttttttatatcatattaatatcgacactgaatagtttaaatgataaatatggtcaattactggccgattgagcatcatttccgtacggacttggttcggcatcagcttggttcggtacggactttggttaatttgtgctcacccttaatcgaatgtgactttccttctttgtcggcatttcaacagctggcccgagatgtacacacgcgacttcccatcacggcacgtacctcaagggttaggtttctctccactacttccattagcattacaccgtcttaaaaattagtatttcaggcttgattaattaaaaaaccgtctttgagctgaccatttcaaaaacatactccttccgtccaaaaaaaatatctggagagaagcctcccccgattcgtgttactagattatgtctcatcccaattctaggttggtttttttttctattaaaacatatatatggaataaaggcatattattttgttcttttgaaaatatttatgagatgaaaatagtagtataagaaaacacccttcatcgaccactcaggcttgacaatactggtagttccaccaggttatccccgaaaggatagaaaaaccacctcatgtttaatgcctagaatatgttcatttcaataccattgttcattgttcatttgacgcaggatatgagagattttgaggctacgtaatctggtacgcataacaagagaagggaagggtcaagggggggatatggggaaagatggcagtaggtagagagggtgctttgtgcattggaccccggaaggcaggcaggctttctggcactgtcttcttcactcgtcgatccactccacgcgaggatcgatcgtcgatgtatgtatgcatcgatcctgttttcggggtggaaagtgtctctccttttgttggtccctccctgtccaattctttcgtcacttgctcttgttccttctcattttgcagcctcatctcatcacctgctgcttgcctcgtgccgtctcgatcttcttcacgtccatccaacgcagctcactccaattatactctcttaccaatgtagttggagtactacacatgtgttcaagctggcttcaggtaaacccccaaccataaacaccatgcatatatgcatgcagagttgcagacatgcatcagttgctcttcctcttgctaagttgctatctccattgattaggagtttagaggagtagtcagctgagctcccgtgtcgatcgatgacaacggtaggatcgatacgcagttgcccttttactgcacttgctatagctgctgcacaataacattggcagtgtgcatcgagccaatattggctgcactgggtagctagctgcacgctgcttcttcctgcgctcttctgtatatatgagacaaacaagcggcggtgctgcctgtaactgactcaggtcacgcgctaatcctgcggctgccaatcctgctcaattcctttgtaatcttgtccataatactactctgtatgtctgtatcgctcacccccaccgatcgatcacctggccgaggctgcaatgaatatcttcacgattcgcataccaggagtccaggactggctctgctcatcagtcatcaactacaaatgcaccaagtacacatactgatactgtgtgttcattcattgagcaatactgctcgtgattgtacagtctgcatcacctacaaatgccatcactggcacagcaagcaccagtaaatatggtgcttgctctctgcttctgttcaggcttttaaaatactggtatggtactccagccttttatttaagaaggttgcaggcttaacagtgtactacagtatagcgagcccctttaattggctagacaagctagtaataaggtatgatcaattcgcatcagtagccattgcctgtatcaagattagcaacaatgcacacactgatcattgacgcatgcaatgcattgtaccttcattcaattgcaattgcctgagatgatgtaggatgattaggacatgttcctgctgcctactgtttagtggagtaattagtactacaacagtgtactaattaaagtagcagcagtatgtatattcaggggatcattgcaagtagtaggtcaaccatgacactgatcagtcgtagcagtaaccatcactccacagattggaaagtctagtgatcagcttttaactaattcctagccatctcgagaacaaaacagacgaaatcatggaaatattcgaaatattatactgtaaagtggtgggtcgatcaacacaggcactagattaacatcatatttacgttacgtgcaaccgttttctatgaccactacttacgcctagcaaactagccatcacagacataaattgcttaactgcatctataaattaagatcacataattaagttttggcaaatggcaaaagtgtatctctgacatcaatttacagtgtaatattctctacgtattaggctatcttttctttggataaacattgaacttggttgtattaactggaacacaaacactggaagggtccgaagaaatattaggctcttttaggcttcaatctgttcaagacattacttaattgcctagcttttttttagaacagttaattgcttagctaggtcactgctttttttttttttttgaaaaccgctaggtcactgctatgatggcgtccccaatttacagccgtgagggttagtacccttttttgtgtatataaaagaaaaaaaaagaggaagtagtcagtagccttttaggtgagacttgactcgatctagaaagcttcggatatactagagtatactcctttactatagtaacaaaaatcctttttgtattattttttttacttgtcactaacaagtagtaacataggagtatgcatcaagataatctttaatatttaccatagctaattttatttatagaattttttacgttggaaggggtgcgagtatttctttttcacgtcagtcgttaggcggagagtgaggaagaagatggaacatgtgcatggggctagcgacagaatcagtttaaggtgagaggttttttcatactaggaggggatctagagtgggagagggcgcgcttatgacttaatgtgagagtaggagtagcacgtagggtgttgtttagtgctaccgtgaattactatagctgagtcgtactaacttttttggttattttttaacgtagtagtacgatctaaaaccagcgtgaacattttgcacatagtgaaattaagacatatcttcgtcacataaataaaattgatcgagaagctagctttggcttatttcattatattattgatagagaagtaaacacgccaccaacctaacaacgggtaaacaccagcagaaaaggtatagcaatcaaatacannnnnnnnnnnnnnnnnnnnnnnnnnnnnnnnnnnnnnnnnnn

SEQ ID NO: 55754 - DNA, 1957 bp, Oryza sativa
ttcataatatcaaaacaaaaatatttatgataacagaaatttgaaagagaaaactaagaggaaagaagagaacatggagagaaaagagaggagattggaaggatagggagaggatcaggatgatcaagagaaaaagacactgatatggggagttgcacctgcggctccgagtggaggcacgcaggatgggctgataggatggtgtgggccagttgggatgggctgggaggaggagtggttgagataggaggagagtgtataatagctattctatacttacatagaattgtgtatagacgatgtacaacaaactgaaaaactaacacgaatgacgtatcaaaatttcagcggaaacatcttcaattcttataatatagtagagatatactgatataaaatgtaacagttttatccacaaattgtacataattctcttttaaccattagatattttcatccaatggcttatgtggcgagttaaatctgtccctacaattagcaatctcctgctctgcaacacgtaaccaccgattaaaaacaaaaatagcgatcgttaccaacctcccacgctgcgccccccctccccgaaatagcgcttctcctctccctgacttctcctagcaaccatcgctccgccgaatgcaattcgttgccaccaccatgcgccctagcccgccggcgccatcatcggcagtacagtgcctatgcgacgccatctgatccatctcaggccacccgaccgggatgccgcctcttgcagtcttgctccagctgcatgttggcctactaaaactgggcttggattcctgcttcgctgccacatcctcgttaaagtcaccaaccatgaactccaccaggtgaccatattatcccctctactctatcttctgttaagcaactcgacgggatgtcagtagtgaaattattgatggtcgttgtacattttgtcacctctgcatctatctatgttgtaccttttggcttgacgggatgtcagtagtgaaattattgatggtccttgtacattttgtcatctctgcatctatctatgttgtaccttttgtcatctctgcatctgcatgaatcaccccaaactctgaatctatctatgttccctaatttattgatggtccttgtacattttatcaactctaaatctatctcgttcccggctccccttatccttcctgtgctcattcctcattttcatcgatgaggacctcagagtttggggtggcaatgatcacaggaagaacaagtaggagatggatagattagggactaattactcaatgacctggattagcacagtcaaaactaaagtgtactatgcatcaaattggaggcgataaaaagcatattgacacaaagaaatgtatacagtttctgcatagacaatttaacgtaatgttaagcacagcagtgctgatgaacactgaatgactggatgttgtttatggttatttggttttacatttctattgcattatcagtacatttaaatttactaactgtggaattagactgcttcagtcataaatcaccatacaacactgctcggcaaatgtcaggcagtatttcatctaaaaaaaatcataaatcaccatattacgatttcgattgttcactcttactggtgaggatgcaattaacaattgctagatgcaatttaatttcatgattatgtagtctgtctacgtacctccagccataaaattttttgcactcatttttatagcttgctctttgaaggtgtcatacatattgctagtgtatgatataacagggccattaataatacagttaggtggtttcacatatgagcatgtttcacatatgagcatgctgaaaagagggtgcactgcattcagagatatgaccatgttgggtagttcatcattctctgattcattgaactgattggtctgaaaaattaggtcttgttagcttatgggag

SEQ ID NO: 55755 - DNA, 18050 bp, Oryza sativa
tgcacccccatttgaaagagttaatatcatgtcatttataaccatagcaaattttctaagcatggctaagcaatagctatagtagtagctcgaatatacccatattggtgcttggataggaccacaacccatcctaggtccatcaacaatagggtgatcaataatcaaggtggataatgcaacaattaggagttgttctaccaaagtcccacatttttgcaaacaccgcatgcaattttaaacataataaagcatttgcgaaaatatatgattcaacatgatcgaaggaggaattgatctaatagtacttgcttgctcaagagttactcgaatatttcttgatcctgcacactcccatcaacggcaacaatcgatctgtcctctatttaaatttaaacctatattcaaatgaaaatccaataaaactccaagataaaatatcatgcacggtgcatgaacatgttcagtgtatagatgatggtttaatataaatttaggagaaagattcgcctaaatccgatgttgaatgtgcaagttatcacgtttctaagatattaaaatacggtacgtactattcgaatttaaattagtgaatttttttacaacagtgattctaagtttgagtgtgcagtattaaaaagagagttggaaactaacaaaatctggttcacctcaatcggagctaaaatgaattttctatgattttccaaattttcagcattttatagtgcataaataattaacagaaaatcttttctcagatttaataatttgtttataaaagaaactaaagggcactgcttgaagtacgttttcctatagggaagagaagacgcatttctgttctgtatatctctactctacttttatttaaaaaattcgtagtggtgatggtgaagcacatattttcccgacatgcgatccaacataatgtacatcgacacgcttcagagcggcacactactcctccgcatccctctgcaccacccacgcgcgattcctacggattgctcgcaatccgcaatcagcgggaaaaaaaaacacgctagcgccgccccacatcgccgcgccgctcccccttcgccacggctcatcctcctcgtcgcgagtcccctcggcctccgcaatacgccgcggcaccacacctccctcccgtcccgcacctcctcctagatcgccgccaccgataccgcgtcctccaccgtcgctgaatcccctttgccgcgcgcccatcattggatcgagcgttgtcgtcatatccacctccaccgttgtggagtcccccgccccacatccccgtccccggcgtttctccaccccgcatcacctgccgtcgacgctcatcgctaatctgctcctctccgccaccgccagcgcccgcatccacgcctgcccagatcacgctgccgacgccactccccgatctcaactgaccaatgtcgtgcccttacccccagcgccacatcccaccctctcctccccttttggccttcgaggcttcgcttcggtcccacaccgacacgaggtaccgcggctgcagcgccactgctgttttctcagctatgatttgggatcctgtgtgcaaggagtggctgattactccatcctcaatttgttgatttagactttggaggcttggtctgctttgctttgttatttaatttgctgttccttatttttttaaatagatccattcctgttcagaggaggcatacggggcagaatattgttcattcatagagaggcataatgcacagttaatttcaatcactttccattttcactgtaagttctaagttgttccagaaaggccatgatgatattactattagaatgttagattaaaaatgcatgcccagtagatgtttttattaaatgcctctgaaacaatctggatgtgatttcagcatacgtttgtgcaaacagaccctttaatttgattgtctaacagtatcaaatgatgatttttcaagaaaatccactgaggaattttcataatttatttgcaatccacagatgaaattgtactcttcaatctttataacaactaactataatcttttgcccaggggtatttcaatccttacactaatctatttactgtcaattagagaatgtaccaaaagaatttttgtttttgttatcaaatgttgcacatttgatgataatctatatttcttaatactgtctgcaccttttgtttgcaagctccaaattctataaaaaaaaaaccttgactgcaagcttgtttacaattgtttggccagcacagtaggagcagggtctgatcgggtgctccctgtgcataactgctattggttcactgctgttccaaagtgagcaatagtaatttggaatgaaaatataccaatataagaggtttccagcctcgatattcagatgttcataatatatctgaccaaagtagagacaagtttcaggttcatatatctgatcaaagtagtgcccttgccaaattcagttccagagcaacatgcaactcccactaggtgacccaaaaatttcattgtggttccactacaaccaagttaaacacgtcaaagtgaatttcttcttcatgttcggacagaagtgcatagctagatcaagataagctagagagcaacccaatagttagatgacttgaacatagccttataaatagcatgcaagcctataggtatatataatttgattggttttcctgaaaatactaaccaaaatactttttttttgtttttatcaatttggttaattattttacatgataatatttccacgttcggtcatcaacttatggttgttgcacccctgacagaatggctgggcagacaccggtggctcttgggtgaaatgagagcaagtcaaccgatcattttcatgaagagatgaattagacggaacaacagagcctcatgggtatgcaacaaataactagttttttttcctaaacaatacatgatttttcattatgacttaaaacctactctagatgggtcaacaatgggattgcatatttctttacttggtctcagaatgaactgaaatgtttctcttttttcatttaactatattagaaagcacatattgtttgacaatggtattagttgcatattgtattttcaaaatttgaagaactaaagaggttgacatactaaaatgctttgcatgaacattactatgacttttacaccttaagctcaaagttgtcttatttgtccagggactcaaacttttgagatatgtatattggcatgaagagaaaaggatacaaatatatgaagcctctgacttgttgggttgttgtatgtgttagttcctggcaatgcagagctagcactgtaaggaaatgactgtgttgaggcaagtgtcaagcactaacttcttccacaacaaccctgtcttccatggtaaccattccgttactccctccttcccaaattgatcatcacactatgaaattcaagatttctcaaattgatcatcatataaccgcatggacacggatttcatcagaataccattaatacaacatggaagaatgtgtgcatgctaaggtgtaattggcatggtgttaatcgatgcatgtattgtgggagaatgtgtgcatggtatcttgattgatgtgatttaaattatcattggtcttggtgcataaacatatatgatgatcaatttgggaaggagggagtatttcttttgctatgtaatgagaaccattgtgtagaattttgtaaacaactttaaccattgcttctctgcatgcaaatgcagatccattcctttccaaaaggattagttaccatttcttttaatttttacacatatgattagcaattgtctataagcattaggaatgagaatcagatgaaactatagacaaactttccaaagtagtatcaatatgtggccaataatgtgctgttccattcattaattttgttatatgtggtactagcatgtgaatactataaagatgtgaaaattataaatatgtgacgtaattattattagttctatattaagattttttgttacagccgatttacactcaatgattatttaacatcatttcacacggttgtattcattttaaaactgtggggtccatctctcagtgaggggcactcctctaaactttcagccaagcactaaagttttcataaattacatataagtcctaggcctaactgtcagtgtctggcgctttgcagaaagaaccccttttaccctaataacaggactaggtccttcttcttcaacctacaggcagctcgataggcagagaggcacaacggctcgggaatggctcgccggcgatgagcggtggaggggatggctcggcctaaggccggggaaggctggagtcggcgagcgccatggccggtggtgccagcggttctagatgacgggcgggcggtgtgccacggtctatggagattcgattaagggataggggatggcctaaggaaggactactaggagacttaccctgtgcagtgctcggttagagttgaggcggtctgaggcggcgtgacgacgagctcccatggcggcagaggtcggtgacggtggtgacatgacggcgctctagagagggggccctataattagttgatgaaatgggttgaagggtctcctagggtcattctggcgcaaggagatggaagggaaatcaccgtggtggagatttgattggcgtgggttggggggcggtgctctgttcggcgcagaccgtggtggtggtgcggccgttcccggctacccagaggggtttgagcttcggctatgcatggtggagaacgagtgtggtgtggggagttagctggcgcgcttgctcaatttataggcgagggaggagccagaggcggatgcggaggctgttgtgacgcgttcggcgccatccatcctaaaataacaaaccaaactctctcaaacaggatccacctcgtgagttcttaaatgcatgagttcttacaaataaataaatataataaaacctcacccctgcggccctacccggctaccctgcgagtgcgagtgcaaggcgagtccgagacggagtccgtctccagcttggtgctggagtcctattcggaattgtaactcgtgtactgttgtacccgttgcaacgcacgggtattttttctagtaaccttaaatattcctgcatgtgttgtagccgccaccgtctgctagcttctggactgtcccatccgccatgttcaccgcgaagaccgccattggcctccccaacggtgtacaccaccgtaccgctcttctcaccgaaccaccggagctcgatcggggtcgtcctcgccggcctgaggtctggtactcggacgtacacagtgcacgtacgtcgtgtctgtactctccatgcatcagtgtcgtctaattgtgtcttcaacgagcagaatacaagctgggacactcggcgagaagtccccacgttgatgtagcgcaactccgtcctgtccgccaacacccccaagtatgcggagaaccggccagtatcccccataccaatgttcaaaatagccggctatagccaccgctatagcgggctatagcgtttgggcagggttggagctaggatagttagccttttgcgctaaacgattttttccgctcatagcggcaattaaccggctaaatccgctaaactgcagatcatttagcgccactcactttgtagtttagctcctgggccaaaatcagagcaggccttgggccttcgccagtggcccaaaggggaggtagaagatcaagccagcaatctgtgttgtctagactgtaatgaaggcatgaaagaacacttaatttgtttcagtccgtgattttttcttgattccatgttcatatgcataattgttgactgatttctgtctggcaattacaaaaccgctaaatagggttagctgggctatagcccgctatagcctttcttagcctccctagatactagccgctaaaagccttagccggctattttgaacattgccccatacgtgtaaggcaccgaacacacgtccatggctgagtccgatagcgcgcgccgacgaacgcctcccagtggaagggccagtaggccacgccgccgccaaggcatggcctagccgggcgcagtatggtttccttcgttccgggccccagctactgtcgtcagacgagtagcaccgcatagccgtgaagccggggcggttgtagatgatgagcaggcggaagaaggagcgcgatggcggcgtgtcgaggtcgtcaccggtgagtattgcgcacacgcgtagtactgtagtagcctggacagtcgccgccggtcatggggttggagacgacgagcgtgaggccgttgctggcgcgggcgcgcgtcgcgccggagctccaatgacgcggccgttgcggccttgcgggacgccactggctgggcgtagtcgagcagcaaggcctcgccgtccgggagctagaacgggcctaggaaccgcgaggcggatgccgccggaaagaagcgcggctgccgcgagctcgaagccgcgagccacttccgcccccacgcgcagcggccgacgtcgttctcctggtggaagcagccaagggcgaggcttgggaggaaccgagtggggaaccgagctggccgcggcagtgcgcgggagattgtagcggcgtacgtgcgtggccacgaacctgccccagctagcggggacacgtcgacgcgaagcgcgcgacgtcggtggcgtcggagaacacgcggtctggcagagtggtcagaagcgcgccgtcgtttcggcctctctggtggcaacgccggcgcgacagccacccgccggtgtacggcgtggcgtcgcgacgtgcgcgggctcgtcgcagcggcggcatgactagctagagcctggagggtttccccaattgtagttgtgcctgctaaaaggatgcgcttcgatcgttaatggatgacgtacgtgcatgttagggtatatatataggccggcatgtcgagtccgaaattgtgacaatttgtgagtgtgtatccataccagcacaacacgtcgactatcacgggtcacggcaccgaatgagcccgacgcagcgaatccggtcttcagctgcgacgctgcggaggattcttttctcttttcattattatcggtcgacgatctcagccgttggatgttgatcaaacgacttccacatcgtcttcttcctctcgcctcttttttctctctctctattttcgttctcctgctagggcaagctcccccatctctcgcctgacaagtggcaactcctgtcctcgattggcaggacatcgctcaatccatgcaccagcaccaccacaccggctatcttacacagcaccgcgccgagcggcgtccccatcaccgtcttatgcccacacctcctccccatcggccgatgtcaactctcctttaagcccatcggatcaaatcctcgccggcagcacccttcccctaaccccaacaatcaaaaacttagtgtcagcaacccggcctgcttaggaagcgcgtgttgtttgttccatattgtatttgcactcgtattcaaatccagtcgcacagaggcgcgtcaagcgtgcgcacgcgcgataggagggaaagcaactaaggaagcggagtccttggcagtcgcatcgtgcagatgatgctgctacggacgaaaatcaaagggtgacggaagtaaaaatactaatcttttaattcttactatcaaaatgcccgtgcttcgcacggtgtattaaaactaaaaatatttgttcttaaccgaagttattttcgcactgcttctgtacttttgctcgctagaaaaagtatcaaatgatagagagaaatatagtagctcataataaattattattctgaagaaagggagataaaaaaagacaaagccggtttgatttccacctttacacgacgcgagtcaacatggactctgaagatataggtagatctatggggtggctcagtagcacgatcgactagcaaatcagcaagcacccttagaccaattgacggccgaacgatgaccgtagcatggtaggtagcagccgcgtctggctgcaacggacgaagactttggtgaatgaggcttgaagtttgatgttataagaactcgaccgggatcataaccatatcagtgtgtactacggccacgagccacacatacggagctgatcagcacaacaataattaatttacggtgctcggacatgaccacaaagctggagatgaggtgtgtgcaatgccgtgatgatgcgtttggagaggtgactccaagatggtggtcggcgtggtgtgtgtgcgcgctgagagtgtaaggagatcattgagttgatcaacgaaatgggaacatggttgtgtgaggcatgtgccgtggctgaattaaagtggtgcacaatattactgccagaagccgatgcccatgggtatgacgcgccaacctaacaagtgctctggttcctacaacaagacgttgatcatgggcaatatatattgataaaatagcatgccacgagttgctacttgatctaatctcctatacaagttttagttaatttgatttgtacggtcgatttagttaatttggatgtagaaggattcaatttggactttggtggaggggaggggctgctgatgggctttggcctagagcttggacgtgagacatattataaacttttgtagagattgattgatctactgggcttggccaaatgaaggaagagggaggctatgtggactttggaaattatttttcgagctgagcggtagaatggtgggtcccacggagatggggttagagcagtgggtcccctggtaggtcccagtcccaccgtttttctctctttccttttcctcttcttatcttctctctcacactttcccttccttctctcgcttttttcttctctctcggctgcttgcaggcaggagagcgccggcagcgatccaaatggcgtaggcaggagggcgccggagggcagggcaccggggtgcgccagggtagagggagggagctccggcacggttggggatgcgacgagagcggctgtgctcggcgggcgcggcaacgataggaccgcggtggctttgggccggcggcgcagcttggttcggcttcggcgatggcgtggtgcgagctcgacgcacgcgtggcgtccaggagccagaaggaggatgggggcggcgtcgggcggctcggcggcgctcgggaaggaagggcgtgacgttggcgggcagatagaagacctccttccccacgccacttcttcgatctagaagtggttagcatcgatctgcaactggtgggcttggtgggcttgcttgctgcacatgattcgtggatgcaccgctattccaattttatttgtgcgattgaattccaattgggattttttcgggggttgattgaattccgattgggatgggatttgggggtgttgtgacggacaaattttattgggtggattggagttcctcatggatccctatgctgattttattagggtggattagaatttgattcctggtttctcccatgaatccgtctactgattttgtttgggtgaattagagtccgattcttcgaaatttctgaatcggacaccggcattgcaggcgcggtgatgaacgacgcggtgatgaatgacggacgaagaagtgacggacgaaaaatcacgtgggtgaaaaagatgtgacgaaaaatcacgcgggtgaaaagatgcgacgaccggaaaaatatattactagcaaaaagtgtccgtgggttgcaacggaaagtgtacagactagaaaattaagaaaaatttaagaaaaatttacattatgtaattaattaaaatacaaatttgctaaaatatttggtatttttaagtaggtaagtgtataattaaatcaatttacaagtaaagccagtgtgagaaataaaatgacattgttaaatttaattttactaaattctccacgattagttacgctctttgaaattttattggaattatcaaagcttaattgctaatgtttaataatacaaacatcatttaacaattatttaattggaaaaagaattaaaatccttcattctaggtttgggccgaatatagaaaagtttatattttctcccttttgtctattcaatgtgcctggcctgtttcctttctccgttgaagtccattttgtgtcctccattcggtggcccaatatgccggcggcatgacgcgggagcagctggagccgtccgatcgaatggacggtctagattaatcctaacctaaataaatacacctaaaccctaaccctaaccctaggattcattctccccctctcccccgcccccaatctcctcgagcggaggcggcggcggcgcccaccaccctccttcccccgagcgactgcggcgacacggagcaacgaccggcgagcggcgcccccctccccctcccccgagcggcgataggcggctatataccaaagccgcaactctagagttcatccgtaagcgcacagatataccattgtagcatttcacccgagagtattccaaggatatcgtatttattttatcccgtgggaagatcatgtagagagaacttgactaataatttatatattacttgtgataatcacattctaagcaggggttaagataatccaagggtagaatgacacacaagcatcaactactcattatcataatatattatctaagctaagtggatggaaaagagaaatataatctattcctatacttctaatatacatagtatacatacattctagttaaccgatatactagctaagaccctctatccgatgccctcctggtacttcgggaagtcacccctgactgccgagttccttacgacagcccgtcatgaccatacaaacgggactaaatacgaagaaataccctccccagggaattaacttaggattatataccggcacggaggaatacccgtactgagctgtcaccatcagcggcccacctctcatccgcaatatataaccccaaataataatatcccgtaagctagacaccacgtctaaactaccagatactactctaatatcatcgtcatgacatagagtaattgcatatgcaaacattatacccgcaccaatgcatctcccagataagctagctgtatattcagtataacaagaacataatgtaaagtaggtacttatatacttggaaagtatttcaataccataaatgtatttagaagagtattctaataaaagtacaaagcttacaaaagagaagagaaaagctactagagccatacccgaactattccgaaggctgtaggatcgaatcacaagaactaagccaaccagatgggggttgaatggttggtatacccaaaaaccgaaaacttttagcggaaataaaagttaccctcgaaatcgatggatcgcggtctgaccgaagtagttgcgccggtctgaccgcctgatgaacgtcagtctgaccgatgtagatcgatcggtcgaaccgccgagaaatcctgccgccgattcctgtcgccgccggtctgaccgccgtgtgcccgccagtcggaccaccgagatgcctccggtctgaccgccggtgcgccgccggttagaccgccgaaacccggtgaaacacaaatcgaagaactcttaaagtggatgacgactttattgattctctctgtgtttacaaagtgcaccaacaacactccttacaaaaatttcgactaaactcgaaaccctaactcaaaacttaactatattgctctcaaaagcgatgccgggaatcctcacgctccctctctatttatacgtgaggtaggtagcctaaagccacgaaccaaactcatactaggagtcctaaacaccttaggaaaccctctagtacaagaaagaaactttacataaccaaacgtaccaaatttggactccttccaaattcgactccgcatcccacacgcacacaataactctatcgtatgccatatggaaactccatcaaccacgtgcatcaactctagcctaagtatcccgcatgatctctgaccaccacggacgtcgtcttatccccaagccgactcccggtccatcaccgcaaatactctcccgagacatcgagtcacctacacatggaacaaacaaagaaaccatattccaagaccaagctatctccaacttgactcattagcagcaaacaatagtattacatacgtatagtatccatctagaagtcataatcatggaataaactcggatatccaaataaacaacacgaaaccgaaaccgacacagtgtcggccggtcagaccgtgggctgaccggtccgaccgctcgatcaccgccggtctgaccggctaccagagcccggtctgaccggtccgcacaaaatgataaaatcctgcagattcatctatgaaatccaatcatctccaaaaccacttgactcattagcagcaaacaatagtattacatacgtatagtatccatctagaagtcataatcatggaataaactcggatatccaaataaacaacacgaaaccgaaaccgacacagtgtcggccggtcagaccgtgggctgaccggtccgaccgctcgatcaccgccggtctgaccggctaccagagcccggtctgaccggtccgcacaaaatgataaaatcctgcagattcatctatgaaatccaatcatctccaaaaccacttcgtgaataaattccaaatatcaaaaccaataatctccaatgcccaattgttcatcatagaataataatcaaaaacacctttgattttacaaaggcttccggactcctgattcctactctattcctattccaccagctagatactagtaaactgaacttgagagaaatgagagagatattgcttgaggtgtgtgagtgaagtgagaaggcgaagtctttttataggcaggtatgacggttgtaaccgctgcaaaatgtctgaagtgccccgcaaccgtcatcaagagaagatctggagcgtcactgccaaccccacatccaaggccagcccaacctagcccaaaatcggcaggtggcctcctccgttgcttcacttcgtagacttgtgaattttggcccaattcatcgtgtcaattctgagttctttgcccattcatgcataagtttaattctcgacaccgtccgattgatttatcgtctatgttgatgtcgattctcctccactttagtgtcattctctgcaaaaggttggtatacataatactagtgtaatattattattctaacatatttatgcattgcaagtatcactagttctcctctattttggtaatattgacggtcaaaactgattgataacaaccatcagcaacatatttcaccaatactagtggatacgattagtaataatccctaccactaagttggataccatattttattccattatatgcaagcattgacggtcagatatcatgatttaagaaccgtcaacacccgcgtcaaacacttggcgagcgtgcagacggactttgtcttcatcgagaagaagacgcattacatttgggccctcctataagactcacaacttacatgtcatcccttttaacataaagactccacctagtagagagttatactcttttttattagcattagtgtaatttcttgccttgccctatccctctcgcccaggcgcccaccctttgacctcctataagactcacatcttatatgtcatcccttttaacagaaagaccccaaatttcatgccttgccctatccctcccgcccaggcgcccacccctctctttctattgctctcgtgttgctctttgtcctctccaatcatggatgatctcaaccattactagactatttcttagcagaggattttgccatgccttgcataccgcaagctttttttaggtttgtgtatattgctgcccaaaccacgccgttgcccatcaccctgacacaaatacggttttggtcgaaggattgatcaaactatcctctattttttcctctctatgcgccatcttttggattaacattgctccatgcgctatctttattggatttatattttatttatttatttatttttgcttgttcacatctagtcatgatggagagttttcccgcccttacgcaccaacgggatgagtatgactgtaaccacgttcagagtaccaaaaatgatgcaagatgttccggagggatatgccgaatagatcattgtccgtgtttgagccttatttgatggacttagatggttcttgtgtgcgatttattgattgaactctgagtcctcatttttagatggacttagacgattttttttgttatgattcttgtgtggaatttcctcatacgaggaaaacttgtgtcgttgcagcactgggttttgtatagtgcgttaccaagatttactgtctcacatggttttatttgtatttggtttggatcagtggcaggtttggattagtggcatagggaggggagaagggagaggcctggtctcccataacaaaataaaattgtaattatcaaatatatctacttaatcatcacatgattaaattagcagtaagtgttttaatcccctatagtgacagaaaatccaacacccctctagtgacaggaaatccttctaatattggaagataattggctgtgttttaatccctctagtgatatagtgtatatggatgagcatggaacactggaataatcacgttttatggtcgaatcatgagtttgattactaatgcgataactgcgttaatatacctacttcctcgcaaagtttggatcaaagtgcctaattccctacttaatttcttccatgatttggttgatgtctgctgaattccgttgtgtgacatgagagcgtgactaaattatgtttgctgtttttttaggtatcggcagtacaacacggtcgaaggtggcaattgtcaacgtaaattttaatcaacttttgtgtggagtttttcgagccagcactccttgaaatatatgtcccaccacccagttgaataggaaattaacttttagagataactaattttaaactatataatataacataatatatacttatacatagtgaaagtcataaatcagttgaacaatatttatagcgcactatgatcatcagatttacaacaaatgttacttaccaattatatatatattagttaagagcattctagatgatatttaagaaaaaatatctctcaaattctaaaatctaattaatcaacttggaagcatacagtgtaattaatatgtcacggtaattactactaactcctgtaaaaattacaaataatataatacaaagcatgggcacacaaaccaactggcagtgtttattggctaaagctatcagtatcatcatcaataataaagaaaaatgagataacaaggagatggaagagtggaagaataccatgagaaaatttcatttttatcctacattgtgctaaggaacaaattcgcgttaaaaaatatgaaaatttaataatattagtaaatcattgatgagtatattatacaatgtctttctgaaatatatgacatccagccagggagtgtgagcttgtcatgtgagttgggcacctctttttgctgggagcctctctttattgcgattcaaagtgcttaggttgaggtagttctctatctactgcccctgtaacatactatatttttcagggtaatttttttacgaaaatctttaaagtcgttgttctttgttctttcgaattgaagcctcccaatccttacattccttttgtttccttttaattttccaactccctcgtaacttcgtttagttttccctccaaaccaaatccaagatatcacaaaaaaaaattcccaaaaccatccgaagagctcgtgtttatttttaagttctcgtgtttatttttaagttagcccgaagtcatcatgcaaatattctaagatccccaatcccaaagattcctattcggaaatattttacaagaattcgattaaaaaatctcttcaaaaatttaaatagatcactatgattctcctcaggccgaattctttgcaatctagcccatattcccaatttactttccattgctcctctgtattgggctgttctaacccatctcccgcacaaccacccagctagcagcccattgccgttgctggccgagcctccaactgacacgctgctcgtttcgctcgctccagccaccgctcgcgttacgcgcgtttcgcctcgcacctccctgcgccttgcttgcgcccgctgcccgcatgcgcttggcccgcgctagccgcgtgccgcctcgcacctgcctgctctgctccgcgtgccgccacgcgcacgacacacgcgcttgaagtcgctcgaaggaactcgatcagatggtgccgacgttgtcgcacaaatcttaaaaccgagcaagcaccactgctaccgtcaatctcccgctgcccaactatttaagcaggcaaggtagctgtgctcatccttttcccaaatcactttctgtcttcaatttcttcaagccacgctgccgtggtcatccgccgatccgccgccgcaggccaccgatcgtcgtctgctcgcaccaccagcctctttgttgcttcctgcttctgcaaaattgaccatgcatccatccaattataggccatgtgaattaaatcagtgggatcatttggaagttttttctcaaagcaagctttatttctacatttccatttagaccatatcacaacagcaatcccaaccacaatgagattttttatgaatttgtcagcattcttaatctaggaaccaaacagttcatgcctgttcaaaacaggtttcaaatttagagcacaagaaataatcttccaaatcaatctagccgtgggacaagcaaagaaaaagtgttgaattgtttcttccttatcacaaaactgacatttattatcacctttcctccagcccctcttgaaaagattgtcattttgtcaagattttattattggtaaagagccaaagaaacactttgattttcaaaggtacttttgaacttccagatttttttatgagggtaattcacttgcttaattttaagtgcattacagaaagatttcacagtgaatttcccatctttggacaaggtccatcagagtttgtctctacaattttctttcaaattcaactcttcccagttgtgtataatttttctccaatatctcagtttggctccatacagatcccttctgaattttatagaaccaataccttttttgttcaagtcagcaatggtgatcttttttttttttgtcaaggctatgttatgaatctcagggaattgcaaggccaaaggtctaccacctatccagctatcttcccaaaaaaaaaagaagaatattttctctatttcccacttttttattcacagactgaagaaaacatctttcacctctataatccattgccaaaaatgtgaattaccaggtttgagtttcagaccagatagtggtttgtttttgtaatatttctcaataatgatctcttgccaccaaccctcttcattctctaatttccagatccactttcccagcaaagctttgttcattgcttacaaatcaatcaccccaagacctccttagtctctgggtgaacaaactaggggccaattaactagatggtactttctaataccttgatcttcttgccatagaaatctttttctgaagtaatccattctatctttcaccccttttggcagttcataaaaagagagcatgtacataggaacactacttaaacttgaattaagcagcaccagccttcctccaatagattgcagcttacctggccagcaacccaatttatgctccattttgttctcagccaccttccagtccttgtttagtattcttttttggtcaatgggaatatccaaatatttcagaggtaaatcaaccacattgcaggtgaaaatattgctatatacatgttgtttttccttagcttcccaaagcaaaaaaaaaaaaaaacctcacttt

SEQ ID NO: 55756 - DNA, 4213 bp, Oryza sativa
gtcaaatcgcgtaaaaattatatataaggaagagaattggcctacggtaagatgagaaaagccgagagcggacagcggtgggtttagcacaattctatgtgcgcatgcccttggtaagttggtatgtcgtaattggaatttgacaacggacaattcatggaatacctgttgacatcacaatttttgtcactgggaattaatactctggttggttagattattttagttagtagcgtgatcccacgaaagtgaatatatctttactttctaactagcatggtggcccgcgcagattgcgcggctagtatcattatattttctctcatataatagcatatatgatttttattatattattcaaatatattaaaatgacaacataattttaaattttgcaataactttacaaaactactaatgtgtaatattcatattgtattttatatacgtgttagttattaattatttttaatatcaaattttagttatttgtaaattatatatattcctatatggactctagactcgtctttcaatatttcttttttttaatttcgaattttctgtaaattgtatttctatatagactctatactcttcttccaacattatttatttttatttctgaatttttattatttctaattgtatttctacgtggactctaaactcatatttcaatattctttaatttttaatttcgaatttcagttacttctaaattgcattcttatattgactttaaattcttcttcccatgtttttcttaatttcgaattttagttatttataaatatattgtatttttatacgggctctaaactctacttttaatttcattatattttttcaaattttagttagttttaaattcctatatggactctatactctacttctaataatcctttttttaattctgaatttcagttatttcctaattgtatttctatatggactccatactctacttctaatattccttgtttttaattccgaatttcagttatttcctaactgtatttctatatggaccctatcctctacttctaatattccttatttttaattccgaatttcagctatttcctaattgtatttctatatagactctagtctcctcttctaatattccttattttttaattccgaatttcagttatttctaaattgtatttctatatggactctgtcttttctttttctccgattaatgtgagaatttctaggccatgagagcgaacgtgaatgctcctttttctactaattttatttctatatggactctatactctacttctaataatccttatttttaattccaaatttaagctatttcctaattgtatttctatatggactctatactctacttctaatattccttatttttaattccgaatttcagctatttcctaattgtatttctatatggactctatcctctacttataatattccttatttttaattccgaatttcagctatttcctaattgtatttctatatggactctagtctcctcatctaatattccttattttttaattccgaatttcagttatttgtaaattgtatttctatatggactctagtctcctcttctaatattcctttttttttaattccgaatttcagctatttctaaattgtatttctatatggactctgtctttttttttctccgattaatgtgagaatttctaggccatgagagcgaacgtgagggctcctttttctattcctttaataatataatagatagatttacttttgagttaattggatccatatgccattgcaactctaccaactctaatttacttttgagttaattggatccatatgccattgctgccaaagtgccactccctcgcccaggctaccgccgccgtgtgagggtaggggcaaaatcgtactctcaccagtgtttctctctctccaaattaacaagaaataataaaataaggccctgagtgtccaggagctaattacacgacttttgtgatgcccgacggcaaattctcgtttttgtggtgtccacgagctaattacacgttttttcaatgtcctgtagcaaattttgccattaaacaaatatcactactattcgtaatattggttcaatgtcattagtattttgtaaaatttaaacaatgcgactgtatacatctcggatgcggatagactagatattttcatgccttacagcctcatcttctggccttatggttataagtcaaaatttgaattttcaatcttaaatttcgagttgattttgaggtattttttcgttgtagtttattttccagtcttttcgtttcttttcgattgctaagaacacgtatataaaagtttaatttacaaattattttctttttgcaaatatgtcgtttcgcttattccgccaataagcgaaaggatggagtctttattgtcgtacaaaccaaaatgcacacaacccacctcctcgtgttctacgtgcatgcttttcaaaatgctagacggtacgttttttgcagaaagtttttatatgaaagttgcttaaaaaaatcataataaccttgcacgctaatggacctctatgttttccgtgaatgggaaatgagttcccagcacacagaaacaaacacagccttagaagttaacaagtgggacccgtatgttacacttatattcttcctcgactcttcttgctcggtgattctagccgtggtagggcagcagtggtggagcggtcggcaatggggctcgccgacgacgatgcccccgtggctggcttcctgacagcgtggtggcgaaatcgagggggggccaggcgagtgtaggatcacacaagaccaaacaaacctaacaaacctaccagaggagggtgaatggtagggaaaaccgaaaacccaaaaatctttttcggaattaaagattaccctcaaaacgaattagacgtcgaagccctatcaccgctggtcgaaccgccctcctaccgccggtcaaaccaccgaagcctcgccggtcagaccgcccgtagacctgcggtcagaccgccgctatcccaccggtcagaccgcacgcacacctgcggttagaccgtcgggacccataaacaccggtagatgacaaactcgaagatgtagattgaaactttttgacattattgcatcaactagtgtttacaaagtgcaccaacaacactcctcaccaaaatctcgaactaaactcgaaaccctaactttctctcaactctagtatctctaaaatcgataccgggaggcctcatcttccctctctatttatacatgaggtaggctgtgcatagcccacgaatctaacacaacttagaactcctaacccacataggaaaccctctcttgcaagtatccaacttatctctttccttatcttaatcaatcttcctgaattcggactcccttccaaatttgactcctcttaccatatgtacacaatccctcttgtataccatatgaatttcttcatcaccatatgcattgtcctctagcctttaatatccctcatgatctcttgatctctggacatcaacttgtcccaagttgactccaatctatcaccggcaacactctcccgaggcctcaagcaacacctgcacatgcaacaaccaagaaaccatattccgagcccaagttcgtcccaacttgactcacattagtataacaatagtatccatacgcatagaaaccatctagaagccaaatccccgaaggaaacatccaaatccaacaagacaacccgaaaccgacatcgaacatgatcctgccggttagaccgtcgagccggctggtctgaccgccgcaacatctgtggtctgactggcggcacgcgaccagtcagaccgctagggtcaaccgaaactgcacacttcacaaaatcaaccgtcttataaaatctccaaaataacattagcaaaccaccaatattttcatcacaaaatctaaatcaactccttgattttacagcgagttcagggcgccgaggaacaacagaagcagcggtgcactcctgctcgaactttgagcagcatgcagtagcagcaacaacagcaacagcctagggtcgctccttgtctcgtcgttgcacctagaagtggcacgcggtcaaggagtacctacatgccatgaggtagaaaaatggcatgtcattgtaagactttataggattttcaatgaatgtcataaca

SEQ ID NO: 55757 - DNA, 13329 bp, Oryza sativa
caagagttggcgacacaaaacacacccttagcaatgaggcttttccagattgccgacatatgtgtccatgttgagaaagctattcgacacaatgatggtaagataaaagcaggggaggacaatgcgccgagcacaaaaatagaagcaagctactcaatgaagctgaagcagctagcccatgaataataataggaagcgcatgatagatagagtggtattgcagtggatacaaaactacctcaacctaggcacttcgaatctcaataaagataggctcccagcaaaaagatgtgcccaactcacatgacaagctcacactctctgctggaagtcatatctttcacaaagacattgtataatatacacatcaatgatttacaaatattattaaattttcatatttttcaacgtggatttgttctttagcacaatgtagggtaaaactgcaattttctcatggtattcttccactcttccatctccttgttatctcattcttctttattattgatgatgatactgatagctttagccactaaaaactcccggttggtttgtgtgcccatggtttgtattatattatttgtaatttttacatgagttagtagtaattatgtatgcttccaagttgattaattagtttttagaatttgagagatattttttcctaaatataatctagaatgttcttaactaataacatatataggtgagtaacatttgttgtaaatctaatgatcatagtgcgctataaatattgttcaactgagttgtgtctttcactatgtataagtatatcatatgttatattatatagcgtaaaattagtgatcatggtgtaacatatatactacctccgttttaggttataagactttctagcattacccacattcatatagatgttaatgaatctaggcacacatatatgtctagattcattaacatatatatgaatgtggacaatgctagaaagtcttataatatgaaacggagaaagtatttatttattggaatagatgtcaatgcatttttctctaactttggttaaagttaatttcctgctaaactgggcggtttggttaaagttaatttcctgctaaactgggtagtgggacatatgtctcaagcagtgatgcacgaaaaattcctcatataggcagctcaattgattaaaatttatgttgacaagttctgcaccaattgccagctttggtcgcattgtaccaccgctacctaaacaaacaactaatagaatttagtgatgcttttacgtcatacagcggaattcagcggacatccaaatcatagaagaaatcaagaagtatgacattagtaataatactttgatccaaactttacagtagcgaagctagaatatcaatttgaaaggggtaacttactgagtaataataatacttataagttttaactagttagtttaacattttataatagtttttttctcgtctctgccgatagactcttttcttcttcctcgcctctccttcttcctcccgtccaccccgatcgtctttcttaatttcttcacctcctcttcaacaaaaatggatctttctcccttcatagaacagattttgcatgaggatttcgtgtcatgagaggttttgttcccgctactcagccatggtttgtttgtcctgttgtccggaacacgccgccatccttcaccctggcaccaatgctgttacagtggaggtagttgcgttgcggcaagaatctttctttcaatcatctacatgtcctgtctcatgcatctgaactaactccacatgtttccttctttttgacatattttcattgttaatggttttcctgtactgagccatcgagatgccaaaaataagaggatgggttgtaattggacaagattcaaagggtcaagcacgaagcaaacacctagataatgctaggaagagataggctgaggaaaacactttcgggtctgagggagaaatgccgctgcgattaccaatagcgtcaagatacaacttttgtagcccgaaatccaaggtgggaataaattgtttgtttctgttgtttctaactgttttgtgagttcgatgattgatcattttctgttattgccttttcttgcgggcatttcctttgctctgaaattggattcgttgaatcgagttcaatttcttctgcaaagagtcctgatttcattttgtgagttcgatgattgattattttatgttattgccttttcttgcaggcatttcttttgcttggaaattggaatcgttgaatcgagttcaatttgttgtagaaagagtcctgatttcattctgtgagtttcgataattgattattttctgttcttaccttttcttgtggacatttctttggcttggaaattggaatcgttgaatcgagttcaattcgtgctacaaaagagtccagatttaattttgtgagttcttgatttctctcccatataggttgcggaggtacaacggggccggagctggcagacagtgcaaaaactcgtaaactcgagttataatcaagaacatttaaaagaccggttctgtttgacatgcaagctcagcttcagctcacagaagtgtttggaccataggcttcatcatccagttaaagagcgagataaccttgtggtgttggagattgtgatggaagatggatggagtgtcaatgtcttatctctggggaacaactcccaataggttcttgtgatagcatagatgtaaatttttaagaccagtttcagttcactggtaacttttctatgcaatgcagaaacaaaaaaaaaaaaaaaactagttctggattgatttgctcaatttcaccgcgcgtcaagcttgtggacggccagtggcggaggacccggtatggcgaggtctggcgctcgccataccttaggctgcctgcgagtaccccctgctccggccttcagctccagggtcaagccgggcagcggccatgcgcggcgtccagccgacgtgtgacgcgatggcgtcggcgtggtgttgacgaaaaacacgaggcctgggagatctgcttaactccagtgcaggtccaaagctcgccttcgggtgtgttagcgtgccagttgatttgatcctgtaatcaacaagaaatagagacaaagaaaccacggttaaacctataaatgatagccggtcggctaagtgccgatgacatatcatttatctttgagccgatgtcatatgtaaatcgatcggcggttgtaaataggtaataaagaactaaatctacccgatcggttgtagatattaacaatatgtagttcttatatcggtatatacttaaatcaagtgattgggatagatcggtcgccatgccgaaacagtataaatcacttagatcgaaatatatattaataaaaggactatatatgttcatggcatagccgatcagattgatctagcatgtatcggctaatactccgatacaactctatgtttagatgttaaaacaagcagaatatgctaaacagaagcttagtatacttagatgcaataatatcttgacataaagggtggatttaacatgtcaatgaagcatatagagcaaatatagttaaatcagataaggtaggctgaaactccgatactaccctaattggcaaccagaaggcatgctagagattgatatgctaagcacgacttaatagatcaaactcaactgatgcagcattaagtatgaaaagaagaacaacatctaaacaatcaagccgctggaaatttcatagagtggtagatatcttatataatttaaatcaacgttgaaatctaacctaatcgactgccctttaccgatagatgttagccgattgtaggttagataacgatattgccagaaattatgtaagatatatgataactcgacgaattacataagcaagattagaatatcataaagatggaagcactaatcccgagaacgcaagccgtcataacaagttttatcttttgttgaagatcgaaaccgatgcagctcaacccgaaagcaagaactcgtcgaaataaaactaaagcaaaagggtggtgatgcgccgaaattgtagtgaacatgtgtgttaattgattacacggggttcggggtctatttatacccgaaaattacaaactatgtccatatcggacacgactcttatctctaacatactctaagataccataagtctttgcggcagacttttgcccaaacatatctctatggaaattacataaaatatccaaattaatagatacaattgccttctcaggactctatccatgtgcggcaatcatcttgaagtacctcaattcaacccgatgtcatacaccaagtcgtattgtcggaattggctgtatcggcttacctagtccgactcagacccagccgatcctattcgtagccgatctggactccagccgattcttgctctgttctcgaatcgatctccgccttcgactccacttcgatctaatcttcttttccgatgccgatattaccaaatttggttgttaacacgtgggcaatgcatctaggctaggcggcgagcatctgcaggctgcaggccggcatggcggtgctcgtctgctcctagtgtcgcggtgccacctggcatgcacggctgcgccaggggtgaacctagcatgggacatgggggtacatctgtacccccaaaatttttgactaataatctttgaattaataggtatattacctatatatatcattagttgggtcaaaacagctattctttagcctaaaatcacaatacaactcatagaaaacggctctggcagaacaacacaagctcctcgatctcgtctcatgaccctgaatctctggtttgtctatggggcttacaaccagaataccgagcatattgcatgccttcctatggtttgggacaaccaaccaatggcagccgtgtgcaggcgctgctcgtggtcacggagagaagccgagaacaagcagctgatcgacaagccactgcactggagaagcaacctcatggctcaatgggttgaatgtgttcgtatcatatatatttttaggctcctaactcatctttctgtagttaatgtttgattcaattgatggttgcttttaggaaatttgattaatgtgcatatctgaatttatatggtagagcagtcaaaaagttaaatggtagtgcaaaaatctctatggagtgtttgggatgaaaacatactatctcttctccaagatttaatttttctttagctattttgcaatgtttctatttttatttgttctagcaagaaaaactttctcattacttttcctactattaagctttagtttctttatggaacaacgatttgataactctgtacaccatcttcaaaatcctgtgtccgccactgggctgcacgcagcaacccagctctaagccgagcagggcagctacaccaacaagtcagcaagggcaaggcagcaaagcaactggcccgattcagcacaaatggatagaaaggggaaaggaaaggctttggcatcttaaaaagataacatttgttgagtatttgacaaatgacaagtgaaaacattgcaatttgcaaaagttaatgcacaatttgtcattgattcacatgtgtgtaattttgtttgtagatttgaagagctatttcaccaggtagtctagtagttgtcgagcagtatgcttttactgttttacgtttcattcaacttgtttttaaagtcgcataagtggtgatgccaatttaaagtcacatattaccacttattataaaggtctttttggccctcttgatgagtctgaccttcagtttgatgagaattatgttactgacattcctcaagtttcacaattggagaatgaagccttaactaaggattttactgaaaatgaggttaaggatgctattttccaaatggaacacaacaaagctccgggtccagatggatttcctgctgagttttaccaagttttctggaatgtcattaaattcgacctcttagaactgtttaaggactttcattctgggagttttcccttatattcgctgaactttggtactatcattcttttgcctaagtgtgttaaggctatgaagattcaacagtatagacctatatgcttacttaatgttagctttaagatttttaccaaaattgctacaaatagaacaatggatatcgctcaaaaggtaattagtcctactcaaacagcgttcattcctgggagaaatattatggaaggggtgcttattttacatgagactttacatgaattacatcgcaaagataaaagcggtgtaatttttaagattgattttgagaaagcttatgacaaagttaaatggccttttgtacaacaaaaaactttgagaatgaaaggcttttctcctagatggtgtgagtggatagcatcttttattcaaggcgatgatgttggtataaaggttaacgatcaaattggtaattgttttcaaacttacaaaggttttaggcaaggggatcctttatctcctattctttttaatatagtagctgacatgcttactctattgatcaagatggctaaagaggtgggactattgaatgggattattccccatcttgttgacgatggtttgtctatcttgcaatacgcatatgatactatcatctttttggagcatgacttgcaacaggcaaagaatctgaaattgatttaatctgtctttgaaaagttacctagcctaaaaataaattttcacaagagtgaattattttgttttggtcaggcaaaggaatgttatgagcaatattctggtatctttggttgtaagttaggtgcctttccttttaaatatcttggaattccgatgcactttaggaagcttactagtaaagattggaaacttattgaagagagaattgagaaaaagcttagtagttggaaaggcaagcatttatctgttggtggtagattggtgttgattaattctgttcttttaagtttagccatatttatgatatctttttttaggtgccgaaaggggttcttcgtaaaattgattattacagatcgcggttcttttgacaaggggatgatcataagaaaaattacaggctcactaggtgggatgttgtttgtcaacccaaggaccggggggtcttgggattcataatctggagatacaaaataaatgttttttaagtaaatgattgtttaagttaattaatgaggaaggggtttggcatgacttattgaagaggaaatatctttataataagtctataacccaagttgataggaaacaaggggattcctattttttgcctggtcttatgaatgtcaaaagtactttcttaaatatgggctcttggattgttaataatggggaacaaattagattttgggaagataaatggctaggcaacttggctttcaaggataaatatccgtcgttatacactattgtccgaaggaaaacatactctattgccactgttatgggatctgttccgcttaatgtttcttttaggagagctttagtttatcagaatcttgtttgttggcatgagttgtgtgcctctatagtacatatccagttgaataattcgtctgatagtttcatatggaattcccatcagaatggcttgttcttggtgaggtctatatacctagctttaattaataatggctatatcgagagaaataagtgtatttggaagcttaagttgccacttaagattaaaattttcatgtggtacttgcttaaaggggttgtgttaactaaggataatttggcaaggcgtaactggaatggcagcttgaggtattctttttgtttgaagaatgagtctattcaacatctctatgtgaattgtcattttgcgaagttcatatggatagcagttcagttctcttttggtttttaatcttccagttagcatatctcatatttttaagaaataagttcatctgaggtcccttaacttgtcaacgaatccgattttcgtccctaattcagaaaaccagacacaacgggtccctcaactatcaaaaccggtgcagattagatccctcggcgtttttgagagtggttttggctgacgtggctcctacgtggctaatttgactcggtcttcatctgatgtggattgacgtggcgcttacgtggcaattcgatcccgaaaaataataaaacccgtgggacccacatgtcaatctcacacataaataataaaaatgggggacccacgtgggccccacatgtcagtagaactcacccttcctgttcttcctcctccctcccagggcgctacaagataattgagctattgccaccaaattattacaacaaaaaataattcgtagcaatatattatagtattgcaatgataatttttctgtggcaaataattattttttattgcaacgatctacaatcgttgttttatttagtacttttgttgcaatagaaaatgagatattgccacgaaaaatcgtactgttgcaaaaaaacatgttctatcgccacaatttttatttttgtggcaatttatatagtacacagtacttttcactattttttgttgccatgatcaacaaaattgttgcaataaaaaaattgccatctcataatttaactttattttttcatatggacacggattgagacaaattttatatggaaattatagctctcgacgagatctacaattttataggtgataactttttcatttgaaatcttttagatatcaaatctatgattcaaatctcagttagctaggctcaaatagaactatatgcattttcgaacagaattgatgtgtagttgagttggtaaaggagagcacacctgaaggacaggtcttgggttcgaatcctagccaagacacaaaatcaaaaaaaaagagtagataaatagataggatgatagactaatatttgaacttttaacttggtacgtaaaactaatgctacatatggagtggtggcaataatttttattacaacgatgtgaagtgttgcaatatgactttttgccacatccattccgtggcaacatctaaatttattaccacaaaataaaaatcgttgcaataacctattaccacgctgtttattactacggctagcaacgattttacaattgtggcaacatgtatctatttccacaattttagtattgatgccacgatttttttcgtggcaacaaatgatttatctagtcgcgatgtgctccagtaggacatggcggcgcgagcacatggtgcaagaggagcggaggaagacgtcgggagccgcgaagacggtgatcgaccctggccacgccgcgagcaacgttgagttggcgaggagcggcgccgcggaggccatctcgttgtaccacagcgaggagagcaccctcgccagctgctccagttgctgctcgtcgcccaagcccgcgaccccggcgtggactggaggcggagggctcgctacgtggcagtatctcgggagcggaagtgtcgtcgtggactcgtggtcgtggccgtggccgcagcaggttcgtcgagaacaaaaatgcctggatctctatcaactggttcactcagctcattcactgtactttttattaagcattcgactgtctccagagcttcagactcaatacagcaagaagagaaggctctaagtctgtctttcccacaacaccctcctcggccaaaatagcctttacacgatataagttgagaaacacagtcctgcacttcatccactgacatagcaccaccaaggatgaccttgatgagcactggatttacttcaaatttgtattctgattccagaccagcaatcaggtttgtcagagctgcctcaatgtgttggtcagttaaatcgtacattcgtatcccaagagaaggcatttccatggccccagccatgattcctccatgtctctgttcaaaaggaacataacataccagaaccaaaaagttattaaaaatatgatcgatttcaacaacagaaaattcaaacatttttttaaggaatgcatcaagcgttgtggaatcaattttcagtttttgccataacatgagaaatcttacttcagcatcttatcaaggtggttgttgagcttgctgaggcgtcgatcagcgtcggggttgcctcctccgccgccgctccgacagcggcgatggcggcctccccggacggagcctcggcagcggcgggcgcggcagcggccgcgaaggggtcgagcatgtgcagcgaccgcggccgccgcagccagagccacttcccgccgccgattcctcttctgcccacaaccgccggagccgtgcctccgccgctgcgcgccgctcccttctctcccgccggccgccggccgccggccgccgctgcctctccgtcgcctggagagagcagaggagagagacgaagagaggagagatggggagggaggaggaagaagaggaggggtgagcatgatatgtggggcccacgtaggccccaccatttttattaatttgtgtgtgaaactgacatgtgggtcctaccggttttattatttttcctgatcgaattgccacgtaagcgccacgtcaatgccacgtcagatgaagaccgagtcaaattagccacgtaggcgccacgtcagccaaaaccactctcaaaactgccaagggatctaatctgcaccagttttaatagttgagggacccgttgtgtctagttttccgattgagggacgaaagtcggattccttaacaagttaagggacctcggatgaacttacctctatttttaatgggtggcttttgggaattgataagaaaaagagtaaactgatacttgttggagcttctgccatttgttgggcaatatggctaagtaggaacgatatggtttttgaaaaatcaccatcattttcctatatgcaggttattttcagggcaacatattgactccggtttcgggcacaactacaaaagtgtgatgaagatgaagagtttctgaaagttgcacgtcgaaagttagagactacggttatgcaactttttatcaattatggttggagatttacaaatagacttcaataattgtgatctccttacgttaggctggattctttgttattctctagatttacactctgtttttgattgctactatgtaataattggttgtagctcttttgagtaaaggccatctaaaaaattcaacttgtttttttttaagttaatccatgttaaaggtagtcttttaatccatctttactctttcttttgcatattctatatatatttatcatatctatcgattatatatgtattgctaaaagtctgaaacattattctttcaagtatttttcagtgcctacccttttatttatgcatttatgtagatgaattgtggtttagtggttgtttccaggttgaatttaccgttttgacaacttgacataatcacataacgtagacttgctgaaattcttgtgtgtcctctcggtctcaagacctagtccatatgccacaccacttttttttccgtcctcctgcagggcgctaaccacccacgacggacacggatgcaggcacatcgattgccaggaggaggtgacagtttacgcccattcgattttgctatatatttgtcgacaaattttccctcaaaaatttgacagatgtaattacagtacaatcgtagtgtaattacactgtaacttgcatgtaattacactgtaactatagtgtaacttatatataactttcaaaaatctctccgtaacatgttatttcggtaaaatggaggtcgtgggaacaaattctttcatatatgtgtgtgctatgatttgttttcttcctcaccaaaacaaatcttgtaataaatctaataattcaaaattatgtgaaacttatatataagttacaatgtagttacatgcaagttacagtgtaattatatataagttacagcgtaattacattatgattgtacaataattacatctatcaaatttttagggaaaaatttatcgacaaatgtataggcagtccaacggccattatattggtgcagcatctcctgaagaaggaatattgccgcaccggtggtggcaggtgattgaatcgatcttctcatcttccctgcactgcagcagacggtcttcctcgacgacgcccatggagtctaggtgagtacttgcgctcagacatcctcgtccccttccctcactttctacgattctactcggccatcaccggcagcaagccgggaagaagtcgctcgcggtcgcaccgcgccatggaagtcaagcagagtcagagaggatgacaggtgggctcgtgccctttacttccactggcacgtgggtcccacctgtatcctataatatcagcccttcttcttccttggccagtagcctctgaccgcgccgccgccactccactccactcctctccaccgatgggtttcagccaccgccacatgcaggcagctgcggcctcccctcctccgatcccttccagttccagcacaccacccgcccctccctctccttctacaccccgcgctgcctcctccgccacaggccaccagcctaacccccgccgacggccaccgcctctaccctcttcatctcatccagcgtctccttgctcctagccgaagacgccgagcaccagcaccccaagccctagatccgccgccacctgcgggatgtgtttgtgcggtggcactatctttgcatttccttcccatggaggctttgtgcgttgtacttttgggggcttcaatttggtgggggttcagggggaatttaactatttgccatttttacgtttaccaattatccaaatacccttctttcttaggtttgtccttaatttttttttgcccctataatgtggtggcatcttaactatttgccactgtggcatgccaacatggcaacacagtgtaaaaatcgatgtgggacccacttgttagccgcacagctatcctctttccccctctctcgctctccgacatacccatcggcttccgtcgctactcctctctttcccagcggcggcggtggcgatgcgccggctcgcggctgcggaggaggagggggagccgagcgctgctcctctctttcccagaggcgaaccatgtcggcagcggcgacggcgtgccggctcgcggcggcggaggagggggagccgagcgccaccgtagtcgaggatgtacgcactagactggacgtgcgaggtcatgctcacgttgtttgcaccgacggtggtcgccgtcctcgccgagcgcctgtctctctcaccatggagccatggaaggaggagggggagccgagtgccgtt

SEQ ID NO: 55758 - DNA, 8749 bp, Oryza sativa
ggcgtccctccctcctcggccatccactgacaacgcggacggctccgcggatcttggcgaatcctgcggttgcagctgagcgcggtgaagagaggtcggactctcggcggcgctcggctccccctcctcctccgcaactgcaagccggtgcaccgccgtcgccgagaggagcaacgctggcagccgacgggtaggccggagagcgagaggaaggggatagctgtgcggctcacaagtgtgtcccacgtcgatttttacactgtgttgccatgttggcatgccacatgggcaaaagtggcaaatagttaagatgccaccaccttaaaagggcaaaaaaaattaaggacaaacctaataagggcatttggataattggcaaacctaaagtggcaaatagttaaatttctcgtttcagagagattcatttccttatcatctgaaacaaattgtgaacttttctttgcaggcaacaaaaggatctagagaataagaaacagtaacctctgaggtatgcatcttcagatgggaaacatctatgttttcttctgataggtgtcataatttagagatactactatgtctgattttatccaagagcattgcttcagaagttgtttaattatattttacagtgttgctgtgctcttcttatttcctagtcctctgcatgacacttgttttagaactctgatccaacagaactatgtgtgtgctgttttatgctatgctctttgttttttccctggggaaaactacggactttgcttgatatatatgttgcattgttctcctgttaaatttgacaatgccatgttatcactgaatcctaatttcacacactactataacattttttttttgcttgccaatattcttgctctaatgatattttgattaatgttctccttgcataaatcatggcttttcatctcaacatatttagatgcaaatggtaacttaatctgagggatgcttcatcttctagcatatattcactttgttagcattttacttttgttacaaactgaggaactgagaggtcttattatagaggattccgacttcctatgttgcttgacaatgatgccaaagcacaataagctgatctctttcacagctatgtgcagccattggccttgatttcaaagttgaaggaggagaagagttctgccattcaacagaacatgaagcttcaagaagaactggttagcttgattatgcaaacatttaatgacccattatattttttaactttggcagtaagaactagattaacttaccccccccccccccaaaaaaaaaaaaactagttaggtttgagtaacagctttgtcgctaaatttgcatctccaataaataatcaccacatgatttactcattccctgttcttttactgtggccagcagtgaccagtccaccggaaaaaaacactaatacaatttttagctttgagttagatagatagaataagcagtttacatgcgctttatttatttttttttaacttttttgtcaagtttatttgcaacccactaatttctacaagtacagatgtatttcgttatctacaaatatcatcttgtttgtctattatggctttgtgcatcaatgaaatctgaatctgaactgcaacactcacgtagtttcatttatcttctattggaattgaacaggatcttctaaggaggcaaatggggagtcagaacggtggtttctcactagtttttgtgctggttattgctattctgagaatcctgcttggttttctcattaagagatgagcgtctgtgatcatatatctttgttccacttttctgtgaaagagttgatagtcgtgggtcttgtctgttgtgttagccatttgtaccaactcatgatcgtcttatcttaggacctgattcatcttgtaatttctgactatcaaattccaatcagtggctgctgcatccagtcaataagtcgtctgtccattatcctgttcgagtataagcttttttttggtcaattgtattcatcttttgacacctgtaaatatgacacttcccctaatattgtggcttgcgatatgtatatgctggatccttgtgaatcttacggagcaggattttcgttactgttggttttcaatatatatgaacaatgttgcttcaacattatggtcccagcttttgtcatttgtatgtgtttgttcaactggttagctttataccaagagggtttctctgtataacaaacaaaacaatggctgtgtttagatctaaaatttggatccaaacttcagtcctttttcatcacatcaacctgtcatacacacataacttttcagttacatcatctctaatttcaattgaaatccaaactttacgctgaactaaacacagccaatgggttaaagcataaaatggccatgctaagctgtcaattcctcctttccaaaatacaagcatctcagctttaatggtccctctggctcgttaattgatgagacaagtatagccgagtttagttccaaaattttttcttcaaacatctaacttttttatcacatcaaaatttttctacataaataaacttttaactttttcgtcacatcgttttaattttaacatatttttaattttagtgtgaactaaacacatcctatcatcaaaacaaatcacgcgacagattcgtagcaaaatggaaaaaaagaaacaaaaaataggagccatttcgccgtctccccaatctgaaacattcaagacgcgctgccgccgtagcctccgccgccgcgaatggactggtcaggcctccccggcgacctcctccgcctcttctccggccgcctccacgacccactcgacttcctccgcttccgcgccgtctgccgcgcgtggcgcgccgccaccgccgccgcagcggcctcccctcctcccttcctcccatggctccttgcccgccccgcccccatcaaccccaccgccggccccggcccctccctctccttctactccctctcctccgccgccctccgctccgtcgccgccccctccgccacttgctccctcctcggccacacaaactcccacctcctcttctccgaccacggccccctcctcctcctcgtcaaccccctcaccggcgccgacctccccctcccgccttcccccttcgacgccttctcccccatcacccagggctactacctccccggtcccgactcgccggtggtgctctacgacaccaggaggatcttcttccaccaccccgccggcggcggcggcgggtggacgacggtgccggtggtggacctcgtcgccgagaacatgtaccacgccgggaaggtgttcgtctgcaacgaccgcggccacctcaccatcttcgacgccgccacgcttgccgtgctcggtgacgctgcgccgccgccaccaccgccggtgaccctgcacagggatgccttcaagtgctcatccttcgtcccgtccggcgatgatctcctgtgcgtgattcggtacttcaggcgcaagaacacagaacaagcaggagaattgctggaggatgccgtgcattggaggttcaccggctagagattgcgggggagaaatcgcggtgggttcagatgaggagcattggagacagaatgctgttcgttggtctctaccagggattctcgctccgcgccgcggatttcgcggggcttgaggggaattgtgtttacttcttcaagatggacagagccagcaggtctttcatctaccggttcagcatggaggatggtcaaatcgaagagttgcctggcccctcaatgcatgcttgcacttggtttgtgccaagtttgtcatagccctcattcgtggacttataaggtaatcttcagatagttttggtcaggcgttcctctttttggtttgaatacattgctccaaaataattcatgaaaatgctgctttaagacatgcaattttcttgtgatatgttaatcgaatgaaatgttggctgataatttgcaagtttgcatcataaattagaatagctagctgattagctgtgtgattggaatgtaaagtttgggtactgctaatcagactgataattgccttcattctcttcacaaatgtgtagaattgtggatacttcttggagttcgagatagtcagttattttcattacctgtgaattcttcttgatatcagtgccaaccttgcgacattgaagcaaattcatgtatgcaaatatctatgattagataaatgggcagaggaacctaacttctgacacagtgttaacttgtgttagatagttgcttattgagttattcccgctgtcattttgtgattttgaattaaaaattatgagatctctgttcacttaaacttgttaagaagtcctatactttcattcaaattttaccgatatgaccataatttccgaaataatttgaattcttgaacaaaatttggtcaaatatgaacatttctttttatcaaattcacaaaaaattccaaaagttttagttgaaatcatttcgtgttggggggttcacaatttcgaatcctgctttaatgttaaaatgaagtgatttgccatggtgaaatttggcaacatctctaaactatagtttagtttatttattgtacaatacatattgccatattccctatcagaattaatcaagagctgacactccatatttaatcattattaatcttgtggcactatctttgctgtgacactcttcttgtagcatatgtgtggtctaggacctcaaggtccaacctattgatgccaaaataaaactttccaaattttggtaagttaccaacatggtaggctattttttatgtgtttagtttagtgcccagatatacattaccaaattttggcaacatttggcctgtccagattttggtaacttactatgatgttgccaaatttcataaacattagtgcataaccaatgtctggtagcaaacctaatgcatccacatgttagattttatcaaaaagatggtatggattaaaatggcatcaatctgaatgggtcctgaatgtttttatatgctatgtcagcacagatagtgcctattcccgtccggcgatgatctcctgtgcgtgattcggtacttcaggagcaagaacagtgaacaagcaggagaattgctggaggattgctgtgcattggaggttcaccggctagagattgcgggggagaaatcgcggtgggttcagatgaggagcattagagacagaatgctgttcgttggtctctaccagggattctcgctccgcgccgcggatttcgcggggcttgaggggaattgtgtttacttcttcaagatggacagagccagcaggtctttcatctaccggttcaggatggaggatggccaaatcgaagagttgcctggcccctcgatgcatgcttgcacttggtttgtgccaagtttgtcatagccgggctatgatagccctcgttcgtatagacttataaggtaatcttcagatagtttgggtcaggcgttcctcttttcggtttgaatgcattgctccaaaataattcatgaaaatgctgctttaagacatgcaattttcttgtgatatgttaatcgaatgaaatgttggctgataatttgcaagtttgcatcataaattagaatagctagctgattagctgtgtgattagaatgtgaagtgtgggtactgctaatcagactgataatagccttcattctcttcacaaatgtgtagaattgtggatacttgataatgggcagaggaacctaacttctggcacagtgttaacttgtgttagatagttgcttattgagtttttcccgctgtcattttatgattttgaattaaaagttatgaggtctctgttcacttaaactttttaggaaaccctatactttaattcaggattcaaatatttgttttcgctatttttatcgggatcaccgatatgaccataatttccgaaataatttgaattcttgaatttgaacatttcttttcatcaaattcacaaaatccaaaagttttagttgaaatcatttcatgttgtggggggggggggtggtttcaaaatttcgaatcctgctttaatgttaaaatgaagtgatttgctatggtgaaattcggcgacatctctaaactatagtttagtttatttattgtatagtacacaactacacattgccttattccctatcagaattaatcaagagctgacactccagatttaatcattattaatcttgtggcactatctttgctgtgacactcttcttgtagcatatgtgtggtctaggactcaagcctcaaggtcgaatctattgatgtcaaacaatggctgaaatttgatagcctgttcagattgatgccaaaataaacatttccaaatttggtatgttaccaacatggtaggctgttgtttatctgtttagtttagtgcccacatatacattaccaaattttggcaacatttgacctgcccagattttggtaacttactatgatgttgccaagtttcataagcattagtgcataaccaatgtttggtaacaaacctaatgcatccacatgttagattttatcaaaaagatggtatggtttaaaatggcatcaatatgaataggttctgaatgtttttatatgctatgtcagcacagatagtgcctattcctgtttgagctgaatattttatgttgaatgatggccagttatgatatactgtatatctgaaatcaagattgctgcagctactcttctacttgcttgcccaaggtccataacctatgtcctaggaacaaaattctgaagtcaaacacaagaaataagtcacaggtaggtctaaacatgctattataggcatatagagtttgtcatgttcagaaatttagcatatagagtttgtcatgctcagaaatttagcccacattttcagtctattgtgtataaacctttgtccaggaaactatgtcagggtacataaaacgacaaattaatatacagatctaaatgtaaacaaagagtaaagggggactcatgtgaaaactcctttttattagcgtgttaggctgaaatcatctcttgggcttggcgagcgtgcggaagatgaatcaaaccccacccctatacattaagaaaacaaaatgtattacctctctttcatattttaagtcgttttgatttttttctaagtcaatttttttattgatttcaccaagtttatagaaaaatataccaatattttcaacacaacacaaaaaaaatatatgttcaaccttagatgtaatgaaactaattagttctataagtgttgctatatttttctataaatttggtcaaactttcaataagtttatcttagaaagtcaaaatgacttatgatataaaacggaggaagtatctcctatttttttttaagaaaacgaactattacgtatgcaactagtgaatcaatgaaacaaaaataattaatagctaaaggtggttgagtgaaaaaaaataatatgaaatgaagggaataatcacagtcataaaatttatatacacttgaaggcagattcatggaacccactagaaaaagatctttgttagctcaaaaggcaactgaccgccatgggtctcgtttttatgacaagggagacgcaggtcgcagcttgggatcaggatcctctgcagtcactgcaccgtgcctttataattgacatgtggtcccgatgtgtcgtcaggcaggatctcaatcctgcggcttgaggccacaggtagcggttgtggtgttgccgtgctcagattggaaacgagttttttttattactccatccgtcctaaaataagtgcagctatgggtttcagtgtccaactttgattgatcgtcttatttaaaaaaaatttatgattagtatttttgttgttattagattataaaacatgaatattattttatgtttgacttatgttttttattttttaaaaaaaattaaataagatggacgaataaagttagaaacggaaactcatgattgcgcttattttggaacggagggagtaagtgattgtttcgtttcacatgtgagacacgtttttctaggcaaaatttgctctaggacactcaaaaaatgtgtaattagctgtcggacaccgtaaagacgtgaatttactctaggacactccaaaaatgtggtaatttgctgcaggacactgggcgcattaaaatataatatatgcccaactaatgagagagaaaccacgtgaaatgactattttgcccttatcttcttccttctcctagtcttcttttgttgtcggagggtgtgaggtgccagcacacgggggtctatgagccctgcctacgggagcacacagcaaggaggaggaggagaaggcgtgttgcttctcgaggagtcctcggcgtagcatccagtggcggccggctgccaccgaagccgacgtgcacgagatgcagcaggtggtatccatggatgcgctctgtgtggtgtgctacgccgacgatcgccaccatcgttacccgccaccgcaatgctcctcgccgctgtcaagcccgcactcgtcgagccgctccttctcccggagaaggttcgaattaaatttgaaaatatactgtttatttaattttttctcaataatattcgagatgcaaaactttttacacaaatataccatcggtctcgctcaaccgttgcgcgagagtgatgtgggaatgacgtcgcgagcggtatcgcgcacagaaagcgcgagaccgct

SEQ ID NO: 55759 - DNA, 24651 bp, Oryza sativa
tcggacggctcgatttgattagtcattaattacttaattaacaattaactaataataattagtgattaattatcctaattaatgattaattaataattaattaatcactaattagaatcattaatcgctaattacatcggcactggaccggtatcgctcgtgcaatgagcgagaccgcgagatgtctcttttagtccgctcggtctcgctattccaatccgcgagaccgtgcggtctcatgctttccctgcgcgataccgtccacgacgtctttcctatgtcactttcgcgcaacggttgtgcgagaccgacggtatatttctgtaaaatattttgcatcccgaatatttgtgagaaaaaatcgaatgaacagtatattttcaaatttaattcgagaaggttctccatcgtcttcgactactccgtctaaaaatttttggaggcctagtaaaactagcaaggagtaattagttaatcaacaccataatctgttaattagccaagaaatcagcagcatcatcaattctgtacttaggtgtaatttccctcactgtacgttaatctaagaaatttgcacacgtgagaggagcgacggaaaaagacaggaagaagagataagaagatgagagtaaaactgtcattttatttggtttctctctcatcaattgggtggatattatattttaatgcgcctagtgtcctgcagcaaattaccacacttttggagtgtactagagcaaattcacgtctttgcggtgtccgacaactaattacatattttttgagtgtcctgtagcaaattttgccgtttttctattaccgacggtgaaaatactattaataagataaatatttgcttgtcttttcccgcagttatgaatagtagattttgaaaatacctgaataggttctctttgctgttctttttttttaaaagaaaaaactcatacagcacgagaggcatgtgttataaaatcgattccgtcatactggtttgtaatttacaatagaaaaaaatacaatcaattctccagccaaaaataaattaaatcatgtgcacatgcgggcatggctagggtttcccaaaccgccggggccagggttaccgcgtcccagcggtaagtacggttaccgcgcggtaaccgtgaaaaatcgtataaaaccgtgcaaaatttatcaaaaattcaattttttttaaatttatttgaatttaagaaggttaccgtgatatttatattaccgtaccccgcggtaagcccggtaaccacgcggttatcggcggtaaggtaaacccgggcagggcaacttcatccttggatattccttttcaggccagccaatttgtttgtacagtgtaaagaactgtccagtttttgtgcttccacatgtaccaggctgttataatcaataactatgaaaaaaaaaagtttggacactacaaatatgaaaaaaaaaaagtttggacactacaaatatgaaaaaaaaagtttggacactacaaaatttgtccaattttcttgccttccactacatgtgtcatgctggtacaataaacaacgaaagaaagggtttggaaaaaggaagttgggaggaacatgctccagagtcccttccgtgatcctgtcccattcatttgcacataaaacgcagccctaatcatctccagtactgtacttcctttccagcaatgcctcctgcatccattctgcccatcaatgtcaccagcttgctgataaacggttcaattcggacatcctgctcaggttgatcccatccattcgaaatcttgatcacatacaaatccaatcaagaaaagcaggagtagaaatggaaagcatggagagcaagcagccacatcacatggccccttgccacaataacatcacaatcacaggtgccaatagcatcacaactcttgatgagtgatgacaaagcaccaatttgttgccacacacacatgcagcaattcaatccaccaacatggagggaaagagatcacatcaagaaaataattaaaaaaaaagaaaccatatcaaagaagaaaaagaagggaaaagaaacaagctgagaataaggacagacatgggtaagcaaggtacagcagagacacccacatcccttgggatgctaagatagaggaggcggatatcaacatcatatcatgaacagtcctaagaaattggatgaagaatcaatcatggctcgcaatttacataaatcatcacaattatcgcctcagcttaacaaggatcaccataattgtcaacagcaatagcagtaacaatagaaaggggggaaaataagaagaaattagaaagaaaagcaaacagaaagaagaggaaagatttcaaagcctcaatttctcaattgtcctaacaaaacttcttggcgctgcatctaaatcgccgaaggatcacgcgcgcatctggcgtctcctcctcctcttcctccgccgaatcacgggaggaaggaaggaaggaatctcagccccagttcagcggtgcgccgtgacgagcgtctcgatgaatcggaggccgtcgaaccgcggcgcgaacttcttcccctccacacgctgctcccccgccgccgccgccgccgcgcgttccgcgtcccttgacaacgacgaaccctgacgagccaaaaggagaaaaggggatcagaggagatcgaggaagaagagagggggagaagaagaaggggatcggggaggcaaacctggttgtggcggacgaggaaggcgtcgcacctcccgacggcggcggcggcggcctcctgctgctgcggcggctgatcggcgcagtcgcaggcgagcagctcggcccctgacgcggcggccacggcggcggcggacgcgacggcggcggcgatcccccacttcatggcaacgagacggctcctcctccttcctccggcgacgcgccgaccgaagcgcggcgtggcccaccggcgtccggtaggcgcggaagattcgggtgcgtggtgtgaacgcgaggagatgcggtaggcggtggaggaggaaatggcggagtgcgccgtcggctagtcgcgttttaattatagcggaggaggggcggatgtggcgtgttgggggaattaatcggattggagttttttccgcgtcgcgtccggtggggcccacccgctcggcgcccggagctcgtctgtgcgggtggttgagacagagagcggcgatccgcagacgagcggagcggagcggaacctcggtgaatgtgatggctgcctgccacgccacggccggtctgcatttgctgctcctccacgtactgtactgtacatttcgttgggtcaactgctcgtccactcccacctcgcgttgacgagctctgcctcgggggaaaaatctttccacctgtactgttaccctttgtactgtggctataaggttgtccatgcgaacgtttcttttaggaccggatccatctctcgtaagaggggcacgacttctctatgagacacacacctcactgtgctactcggccccttttcatcaagccacggagctaggctccatgttggacgatgtcgtggctaagtctttcatggtctctgctccgcatatgtatctttcccttctacccttggccggaggtggtgaggtagtggacgagctggaggcggtgcaacagcgacaacctagcgacaacgcagcaacccactagatccagcctcccgaccaaccgtggagagagagagagaggcggtgactggcggaggaagaagggaaccagcaaccagcactgtcagccaccccgcgctgccagccacctcgtgcaccgctcgcccctctcgttgtgaggagggagagagacagcggtgagcggctggagagagaggcaagcggtggcgaaagagatagagagataggcgacgggtgacggagaaaaagaggccgggctaaaataaaacgtaggggtaggatagtaaaatgcacatgggctccatgggctagagaacacacgttgtgggacattgtgggctagtgtgtcttcggacacttgcctcagattttttgtaggggcatttggagtgtcttctattgggagatatgtttctcatgtgtggtctcagcttgtatgacccatgtgaggccactgataggtgtggcttctattgggataccctaacagccccatcgtttgacatactggaggaaaatgcgaaacggtatatttgtaaataaaaaaataatttatgaataaaacttttatatacgtgtttttagtgatcttaaagcaaagaccgaaaataaactatgattgaaaaatcccaaaattaactttaaatttaagggtgaaaatttaaattttggctgattagtataagcaaaagcgaaaagatgatgttgcaagttttttcagactaggatataacctcggtttgtgttattatacttttcaaataaatgatgtggtttttttaaaagaaaactatataaaacttgtcttaaaatattaaataaatatatttttaaatttatattagttaaaatccaattaatcatgccttaataattttttagtttatctttcccttaatctttctcaaacaccgtcgtttgtttgcacgatacattgaaacattgaaaatttgtgggctttaaacatgtatttggtctgaggaccaagtagggtataatggaaccatcactgtttttggatcgaattagacttttttttttttgttggagagacagggatggactggagctacttcgatcagtgatttgtgaatggaaagaaactaacgtccgtgaccaacttctctgtggttttcgataaacccatacctatttctgatcaagtgatcgatcatattaggttggatccaatgatgccaaagtcgggagcggcaaatggcagaaatggatgaagtgctcgaggaagaagttgaatgtgtgcggtaaggaagagaaagcggagaccgcctccatctgcgacgcgccactgccttcactcgccgtcctacctttccgacgccactgactgccccccgcctccgctcgccgtctgcgttcgttcgtgacgcatcccagctgagatgaattgaatagaagagaaaatctaatcggctaatcaataagggtctattcggttcacaggattttaaaatcataggaatatgaaaaacgtaaaaataatttaggaatgcacgtgcaaaacaaaggattggaacacagaaatttttcctatacttagctaaacaaaaaaggatggagtggatgttgtcatttctgtggaattagtatattttggaggatttttggaggattggcatagcgtttctatggaaaatttttctttgaatcctacaaaccgaatgcatggatagtgcttattgcataggaattgagatttcctttaggaatccttcgaaacgaataaggcctaatcatctgccctgccttgcttccttggctcggtgccactttccgccggccaaccaccgtacgtgcgcccgtgccggtgccggcttgccgccgccgccgttgtcctctacatatgcacgtcgcgtggccaccccttgctgcggccttgccgtcgccactcgatcgtcggccccgatcaccgcacgtggacgctggtcaccgagaaggatcaggcatgccaaccaggccaccaggagccctaacagtaacaagtaggccgatacgcgaggcgagcagatgatacgcggaaaagctaattagcacgcacgcacgcaccgctaacgcgcattttgatgagttaagtagctagttagttagttaagaataatgacaaaattaagaggatactatttttttggagaaattttttactaacaaattgaaaactttcaagttagatttgaaaattttggacttaagatttaaactttaaagtcaaattttaaaaactttcaactcaaactttaaaaattttcaactctgtcggagatatgggcccgggggtatgcggagtaaaggagtatgcggagtaaaggagagctgcttccctttccagccacgtggctctgcgagctggtcccacctgtatacctcgtgagtcactaaggcgatggggagagcctcgggggtcgacgacatcccctcgggggtgacgtcaccccctcgggctctctcgtcgttttagcccgaggccctctctcggggggaagtgtgagaggggagtccaggctaggcggccataaatgtgcagcgccccaaccgtcccttgctgcattcaatgcggcgagggcagacgtgcggcgtgcccgaccgactcctgtcagtcggatgcgaccggtctgtgaccagtctattgccggtcatggtcgattgaacgggtggtcgtgcccccacgtcgcctctgtctccgcggagtggcggtaggtacgccccgtcacatccgggcgtcggtcgatgcagggctaccgcaagtcctcattcatttatgagggaatgacagggctgccccccgtgtcaggcgggagacggcgctgggccccactcaaggaccgaccgatgcttagcttccagcaaaaggcacgggttgaaacccggtggcagtagggagaagggccccctcccctccctccgatggaggggaagggtagaaacggcgcatgtggtatccccttaagctataaaaggaggaccttgcccaccaaaagaggggggctagagagagaggaagagaaggaggcaaggggaaccttgtaaaaaagttcattgataatcccaaacgcaggagtagggtgttacactccagagcggcctgaacctgggtaatcgacttgtgtgctttctaaccgggaatcggagggacgaacacgcgacttcggagagatgagtctctgacctcggccgaactcacgaaaggggggtcacgcgactccccgcgatcgggggtcttccctcgacaaactcgaaatttaaatttgtaacacaaattttgaaaactttcaactcggatttgaaaattttcagctcgagatttgaaaactttcgaaaccagatctgaaaactttcaacttcaaatctaaaaactttcaacccaaagatctaaaaatacatgtgctgaagattaaaaaaaataaaaaaaaacaccaaaaaagtgaaaatcacaaaagggaaaaaaaaaagaaacagaaggtaccagctagggcgcgcgagacctccgttgctgacgtgcgcgcgccagttagcaacccacatgatacggcaatatattttatgggattttttttttgccgtacctacctacatgggccttgggtcggcaattttttaggtggtccggggaccaccagaccatccatcagatccgtcggtgattacatttcctaataatacgaatctagacagataatgtcccattcatctaaaattccttatatttcgagaaggggagcgtaattaatatgtctatagcacagcagacccgcctaacctcaaagaccaagggaggatgtcggcaattggcaatttagcatgtttcatgggccacagttcagtgagacccgctagctgaacatcatcttcggagaaaaaagaagacggggaaagcgaggggaagtaacgtcgtcgtcgccgtggaatgtacgcatggctgggagcatcgcgtggggagaaagcagtccccagccgaggaaggcgcccaaccgatagtagatatgctccatatttgcatcatacgcatacttccccgttatgttaatgttagtgccgttccattcgattgatccattcacccggcgcctcacgcaagcgcttgcgtcgccacggattgtgacaaccggcctcatccaaattgccagttccatgggagttatttttatatacagtttcagttttagcttctttcgcttttgttatatattttttttcaagcttgatgagtggaccacacatgcatcatggctagataaatgaacgacctaataatcataaagaaatgaaattaaggccctatttagtttacaaacaaaatcttttcaccaaacaaaactaattacacagattatatgtaaattgcgagacgaatcttttaagcctaagcgttctatgatttgataatgtggtgctacagtaaacatttgctaatgacagattaattaggcttaataaattcgtctcgtaatttacacgcaatatgtgtaattagttttttctatgtttaatactttaaatgtgtgtctgtatatccgatgtgacacgccaaaacttttcgtctagcgaaataaacagagcctaaaagttgttgaatataaatatgtaaggatcatgcatcgatcaaccggggccgtcgctgttgttccgtcatgctgtccctccctcgtcggctttctggtttggttggacgtgcttttcggagataggggcagtgcgtgtgcgtcgagaatatacctccctccaaaatgcattcctgtacacattttttatgtgcaaaagatggagtactagattaattaaaggagaggaaaaacaagatgaggctgcatgagagatgctatatgtccattcaaaagtgcgtgttgggatgaattatccaaaatatatggtgcacctcgatcgatcgccttgcacctttgtgatgcgttgtgatggataattggatactgtgtacattgtcatcgctagcttatgtatggtcgaactgattagacatgcatatgcatccgccggttctatatccaatttaggatatccagagattagggataagattcaaccagatgttattcatgtataactagaaaaatatccggggaaaaccattaaacataaaaactgaacctaacggtttctctaaattcatggaaaaaatattagtataggcatgtatactagataaccaactaatcaatactaagttaatgtcaactttatttggtaggaaaataaattagattaagtaacatgacactattaaataatcatcactgtactgctgttaatttctaattgtcgatgaaagacttgtcgaaaacaactattacgggcgaggaaaataggtgtgctcgctttgacttgagcaaacaactattatccttttcttttcaaattcctttacagtagacaatcatataaaaattttagagaaaaatcagtaagagctggtaccttttgaaaaattttctttaaagtctatcccttttatttgattccttcattttttatgtgatatactcaaatattatttctgtaattttttatgttttctatttctctattttatagtcgtatttctgttaaaattatatgttgttcttttagtttctatggttttttcaatcctaaattcgaagaaccacccaaaaacaaactgagaggctgttttggtacagctccaactcctaaatttaactccaggagttgggtatagagtggagttgtggagctgcctaaacccagctccacaactctagttcattttgtgagagagttttaccagcttcattcccagttttgatagagctaaaactgtttagctgagctccagttctaggagggatggagctggagctgtgccaaactcgccctgaattccaaattcgtgtggagaagaaccgcggggaaagtaggcaaggcaatttgcagagttccagtggtgggaacagcgcaaacgtggacagagaaagaggcataggaatacagtggatcacggggcagagaatctgtctgcgttcacactcacttgtgaagatttggctctctttgcgtggtcggcgcgagatgccccacatccattttcaccttgggttactttatttttcacactgttaccattagtattactcgctctcttgccaaatagtactaagttgtttaattttttcttcttctgtttattccaaatactagtaaattaaagttagtgaaaataaaaataataaatgtattagaagctgataaaataagaaatagttaatttaataaagtgagcatctttttagttttataatgaacggacgggagtagtattcactttactagcaggcgaggcgaccatgtcatgtgtacttgaagcctgacatttagcggaaagtcaactttaagtaattactccgaaaaaaacaaaccctgagtttccgtatctctccgtaaaaaaaaaggcaaaaccctgggtttccgtgtccaattttgactgtccgtcttatatgaaatttttttataattcatattttcattttgttagatgataaaacatgattaatattttatgcgtgacttgtctttttatttttttttataatttttttaaataaaataaatggtcaaacgttggacacgaaaaccaggtttgtcttttttttgaccggaggtttgtcttttttttttttttttttttttttgaccggagggagtaggcagcagtacttctactaggcatcgaatactcgaaatgcgacgcgagccaaatcaatatacctgcccaagaaaaaaaacgtttgccaaaatttgcacaaaattcaaactcagattaagcaggaagaacagcacagtcaattaatgatggtagtagtaactaattcgttcatctttcacccatcctgaggctaactgaaatccattctgctcttcgcgaatgctaatctagctacctaactaagccatgaatcctgctctgccatggcggttcaacggtgagcggtgacgagggtctcgatgaagcgcagcccgtcgaaccgcggcgcgaaccggtcctccgccgcgctcctccgcccattccccctcgacgccggcgacccctgcagaagtaacaaacaaacacgcgcgagcgtgagcaatccacacccagccacaaggaacaaaggtctcgggatggagcgtgccgtgggattggagcatggggtgacgcagcgctcggtggcggcggcggtggcggcggacgcgacggcggtggccgcggccgaggcagtggcggcggcggcggcggcccacttcatctccggcagacggcgagggggggaggagagaccgccgcctcctctggagaagagcgagtgagctgagactgtgatggcggctgctgctgctgcagtgctcacacacagtcacacttgcggctatttatggcgggggaattcggcggcggaatcttgcggggcggattcgggcggattggatggcgtggcgtcacgggcggtcggtcggtggcgccggcgccggccacgtgggggcggcggtacagtcgaggcagtggactagtggtggagtgggcggctgttagcggcaaaacgaaatgtagcttgtctagcaaaacagaaaggcagcttttctggattagagcttaacattaaatagcaagttacaagaaagttaaacgtggccatagtggcctcctaattgtgcgtgccacactccttgccacttcgcgccatcccacgaactggagcacaccacgcacgacaccacggactccgcacgaacgcagcgtgcgtcaagcccactatgaacacaaacaggatgaacagatcatgtacaagactcaacgtaaaaacggagggaaactaactactctgagcagctagacttattactaacaaatcacccccttaagtctgaccgctcttgtcaagagaacagacaccgatctttaaacgaagctcctgaaacctggttctgcccagagatttggtgaatatatcaccgagctgctccgcagttcccacgaacatcatttcgatcagtttcttttctgcacactcccggatataatgatatttgacatcgatatgcttactccggtcatgatgcactggattttttatcaatgatattgtggactggttgtccaccttcagcagcggtgcggcgatctcgtcgcccagcacctccgctaacagccgcgcgagccatactccttgacatgttgcggcggctgcggcgatgtactcggcctcacaggaggacaatgccaccaccttctgcttggaggactgccaagtgataggcccgccattgacgaagaaaatctggccggacgtgctctttcgctcatctggatcgccagccagatcactgtcagagtaaccaaccaacattggcaaagcgcaccgtgcacctgggccaaatcgaattccccagcagcgagtgcctgccacatagcgcagtatgcgccgaacggctgcgagatgatcttccctgggtgactccatgaagcgactgacatacccaacagagaatgccaggtcgggtcgcgtgttgacgagatagcgcagactcccaaccaagctgcgatacaatgtagcatccacaagtggaaaatctgaaccctttctcaatttcaaacgtacctccatgggagtctgacagggattgcagtccttgagtcctgccttctcaagaatcttgccggcatatgcggcttgccccagcgtgatcccatcactgtcctgggtaacctcgatgccgaggtagtatctgagtgccccaaatcactcatcttgaagagcttcatcatctctcccttgaagctgcggatctcgtcgtcgtgatcgccggtgatgatgaggtcatcgacgtagacgcccaccgtcagtcgtcttcctcccctggtgcgtgtgtacacaccatgctcggagctgctgcggtgaaagccgagtgacagcaaggagctatcaagtttggcattccacgcgcgaggcgcctggcgcaagccgtaaagagctttgtgcaggcgatacaccttgttcttgtggttgtcgtcgacgaaacccagcggctgcgagacataaacttcctcgagcagctcgccgttgaggaatgccgacttgacgtccatgtggtggacttgccacccttggtgcgcggcgacggcgagaaggaggcgcaccgattccagccgggcgacaggtgcgaagacctcgtcgaagtccaccccctgtcattggacgtaccccttagcgacgaggcgcgccttgtagcgcacgatcgccccctgttcgtcacgtttcagcttgtagacccattttagcccaattgcacggtggccatggggtaggtcagtgagcgaccaagtgtcgttgtcgacgatcgcgttaagctcgtcttgcatggcgccacgccagtttggatccgcctcagccagtgaagcaggttcgtcggcgctcacaacatggagctcgagctattccagcacccgcggagcgtgtccaggcggtgaggcattccccagcaggttatccaccaggcggtagcgaggcacgacgtcgtcatctgcgtcggcgtccaggatggaatcctgggtaggcggcatgacaaactcaaccgcctccggcaacggaggcgacggaggtgccggcgtcgtgggggccgacggagccggcgatggtggcgagggcggagtcggcaacgaagcaggtgccgtcccgatggtggtcgtcaccacctattcgacggtgaacggctcgagctggggagcaccatcgggcgtcactggtccccagtcccaggcggcgtcttcatcaaacaccacgtccctgacacatggacgcgctcgctgactggatcatagagccggtaggccttcgagccttgcacgtagccgaggagcaccattggcgcactccggtcatcgagtttcttcagcccgggcttggtgatcttgacgtgccccctgcacccgaaagtgcgccggaaatgcatagcgggccgttggccataccatgcttcatagggcgtttggttgtccaagcttttcgtcggcgaacgattcaagagaaagaccgctgtggacatggcctctccccagaaccgcccaggaacacccttcgccttcaacatgctgcgggcagtggcgacgatggtttggtttcgatgctccactactccgttctgctgcggggagtagggcgccgtcaactgccgaccaactccgagattggcgcagtattccccaaattcgattgaggtgaattcgccgccacgatccgtgcgcagtgcacggagtttgcgcccggactccacctctgcacgggcctgaaagtgcttgatggcgttcgcggcctcatccttgctcctgatcaaggttagccacatatagcggctcatgtcatcgacaagcaacaaaaaataccaattaccagccggcgttgcaggttcgatcggcccacagagatcgccgtggacgagctccaggtgttcgtcagcgcggtacttggactacgtcgggaacgccgctcgccgctgcttcccgagcaaacagccatcgcagacttgagtgacttgttgcagcagcggcagcccacgaaccatttcctgttgcgcgagcttgcggagagcaggaaagttgaggtggccgtacctggcgtgccaccgccacgccggctcggcgctccttgccgcgaggcagaccggacggtcgatgtacagattgatggtgtagaggcagtcgtcggagcgtcggacacggacgagtaggtgccctcgaggatcccacacgcgcaggacgccgtgatgaatcagtaccttgctgccggaacgatccagctgtccaaggctgacgatgttcgccatgagccgcgggatgtagtagaccccggcgatgccgcggtgttccccgaacctgcaggagaacaggacggtgccgcggccctcgatgcgaaccaccgagccgtcgccaaacctgacagtgccggtgaccaccgtgtcgagctcggcgaaagcggagcgggacccggtcatatggttggttgcgccagtatccaggatccacattgccggatcatgttcgccaccgtcgtctagctgcgcgaagacccttgcctcgactacggcgagttcgcccatcggcgaaggcgccctcggcgcgctcggtggcgagacgacgtttgtcggtgcagcgacgcgaggacgcggcggatccagctgcaccttggctaggagcagagcaggctcttcgtcctcctcctgggctacgtaagcttgctgggccttgggcttgctgcgacagtctttggcccaatgtcccctcttgccgcaattcttgcaatttcccgggttacggcctcccgggttggctggcttgggctgggcctccttcggggctccaccgtccttcttcccacgccctcgaccccggtggtcgccgttgccgccggaggagtgagcggcgtcttgcagagaggccgccttgcggaatttcgccagccattcttcctcggtgaagaggagacggccattggcgtcgacctgactcgatgccgccgcagtcttgcgctgcttgcgttgctcgacggagcgcagacgcccagtaacctcctcgagagacacctcattgacgtcgagcaaggtctcaatcgagatggctatttgctggagatgttctgggacaacctgcaacaatttctgaacgacctcagcttcagtgatattatcacctaaggtgcgaaggttgttggcgaggccgccgatccgcatcgagaagtcgtcgacggtttcaccgtccttgaagaggatatcaccgaattctcggcgcagctgctgtgcattcacctcacgcacgcgctgcacaccgatacggcgagtcttgatcgcttcccacgcctcctgcgccgtctccttgacagcgagcgtggcgagcatctcggcgggcacggcgcgaagtatcgcggcgagcgcctgccggtcctgccgatagtcgacgagatcatcgccctccggctccaccgcgccccacagaccttgggcctgcatgttcacccacattaccagcgcccagtcttggtaatttgtgtgggtgagtgtcgggtagacgacgctgctcgtggtcgcctcgcggacgacgcgttccaccacgacttggccgcggctgccatgacggccacggcgcggagacggcgagcgccagcgacgacgcggtggtgagtgggagacgcgtggcgttggtagcgacatcaggaaccccggcgatcaccgaaggctctgataccaattgttagcggcaaaacgaaaaactgtagcttgtctggcaaaacagaaacagagcaacacagagtattttggcgctgcattaactggcagcttttctggattagagcttaaccttaaatagcaaattacaagaaagttaaacgtggccatagtggcctcctaattgtgcgtgccacactccttgccacttcgcgccatcccacgaactggagcacaccatgcacgacaccacggactccgcacgaacgcagcgtgcgtcaagcccactatgcacacaaacaggatgaacagatcatgtgcaagactcaacgtaaaaacagagggaaactaactactctgagcagctagacttattactaacagcggcagcggtgggtggcgtcgggaagccgcgggcgcgagcaccgccgtgggctggacttcacttgactttgggctctctctctctctctctctgggccctgttcacttagatggtcgtgtgggctcggactacgagggcccgtcagataaaactccctcaactgtcgtccgagtagcattcatgttctccagccataaaattagatatatcaactccttcaattattaaaatatgtgcaaacaatattcctagatggttttggaggtggtttcggctgacatggcggtcttgaccgattctttgtcctacgtggcgcttacgtggtattaaaataaaaacaaaaatcttatctttactatagagttataacctactaattctaaagctcaacatgccacctcatcatccactagcaataatacatacaaaacttatcatagtgtaacatgcaagcatgcaacatcatctataattcattgaattctacaaatcaatatccaatcatcttccttcacattatttttcacaatatttttaacatatatatatccattatttttataatacttaacaaatattcatccatataatcaaagtgcggaatattatatttcatacagagtctactaaatttatttctctattaacatagtttcacaaatcagttttatttgtttttaataactaatagaatttttatttttagctagattattacaaaatataaaagttacttagtaatttccgcagcaaagcgcagggaatcacctaagttaaaaaaaaatgtgggacccgtatgtcattcacacaaaaaagtattgtgggacccacatgtcatcctccctctcgctctcccttatctctctctcggtagctgcggcggtgatggtggggacgaggcggaggggagcgacggctgcggcggtcaggaggaggaggagaaggcagaagaggtggttttgcggggacgatgcggcggaggcggaggaggaggaggacggtgtgcttctgggaggagctcgtgcttcgaccgctcccgaccgccgctgctgccgctcccctcggcctcgtcctcacctccactgccgccactcccgaccgccgcgcaccgttgccaccggtcccctccacctcgtccccaccaccaccgctgctgctcccgagagagagagaggagagagagagagagggagggagataagggagagagagggggaggaagaagggaaggagagggaggatgacatgtgagtcccacaatactcttttttgtgaatgacatgtgtcgcacatattttttatttttgtttttattctaatgccacataagcaccacgtaggacaaatactcggtcaagactgccacgtaggcgccacgtcagctaaaaccacctccaaaaccacttagggacattgtttgcaccggttttgtggttggaggacatgaatcatactcgggcgatagttgagggagtccaagtatactttttccttagataaaatcataaaaggtggtctttaggacttggcaaactcttcttggaaaaagtagaccgaaggtccctcaacttgtcatcgagttacaaaatcgtcccccaaccgcaaaaccagatatccggcgtctcttaactaatcaaaaccaatcacaataggtcattctgtggttttgaccccggttttgtcctacgtggcggctgagtcagcgtgggacccacgtgggacccacatgtatggatgccacatcatccttctctctcccttcctcctctctctcactcttgtcacgttctctaggcaaagccggccggtggcaagggaggaggcgccggggagaggcgggagaggaggaggtggcgggcgacatggcggcggcgggtcctagatgatagtgccaactcttttatcttctttctgtctcggcaatggttgccgacagagaggggctgttgccggcctccttccccttctcttctctccctaaatgaaatcgacggctggcagaagatgaagaagatgacgccggcctcatcgccgaccttccctcctccttccttgagctcctcgccggcgcccatggccaccccgccttcctcttccttcaaggcgcagctcgcgtccgtgctcggctgagcgtcggctggctctgtgtggcggcagcaatgaaaaggtggggccggcgccggggtggtcgtggaggcggcgcccgtgcgggccggcctggccacgcgcggggggggggggcgctttttcaagccccacattagtcctacgaggtgatcaaataaaatataagaaaaaagtacgaattaccccctgaacaattacggtcgacctaattattacctccctgaacttgaaaccagacatagctcaccctaaattttcaacaccggacgaattacccccctatgcaatttagagtggttttatcctacgtggcgtacgcgtggcaatccagtcagcattttcttttttttaaaaaatgatgtgacccacataacatacctcctcttccccaattcccccctctttctctctccttgcgtcgtctggcgcgggtgcaagtcggcggtgggcgggtcacggtcgggccaatcgacacgctgaatcagggggtagcaggatcagctagagttagtcatcctgcttcttgagcttgttgacacgctgctagagctggtcaagcctgacgacgaggaaggtgacagggaagaaggatccagtagaggaccagcgcagtggcgatgaggagcgcgctgcgctgcggcttcatgatggatttctggtggcggaggtgctcggacggggtgcagtggtgctcgtcattgtaggtgggccgcacctcgtacttccagtagatgtccatcagcaggaagaggcagaagagcaccatcaacatcatcgtcttcagcgcgctccgcaccacggagatcatcccgcaccgggagcctgtccagcactggcagcgtcagaagcagcaccatgatcgcctcaagcaccacccactccaacgtcgtcgctgccgaatcgaaactctcggattcgagctcgtggaggaaaaggaggcgagggatatggggtgagcgccgcgtcatcggcatgggcgcaagtcgagcggcgcgcggccccatcccctacacctccccgcgcgccgccctccgctcctcctctctccctcccgcccccatcccctcctcctccatctccacctcctccgactccctccaccaccgcgcactcctggccacccactctgtcctggccttctccacctctgcctcggcagcggcggtggcagccgaggggcccaccgcctccgtgtcttgtgcgtcgaccgcccgctttcgcgcgctgccgtgcgccgctgtgcgcgccggcgcgaggagagagaaaaagaggggtagaggaggtattacacgtgggtctcaccattttttaaaaagaaaatattgattagatcgccacgcgtacttcacgtgggacaaaaccgctttggattagattgaggggggtaattcatccggtattgaaagtttagagtgagtgacgtctggtttttaggttcaggggtaattgggtcgactagaatagtttatggggcaattcatactttttttcaaaaaaataactttattcccaatctacattaaaacaatatactaacagataagattatatcctcgaatctgtactaacgtgacaacaaatttcctcgaaactgtgaggaatatttgatacaatataaactatcactaatacaatatgtcttatctagttgatgaaaaatgccactaaaaataataagaggatgatactaataggatgaagatggaggaaagaagacaaaaagaaataccatgacttacatatcctagcacgtttgctttatagacagagaaattactatattagcaaaatatcatagttagttgagtcatttttttactaatcacactaaagtttggttcaaaagcttaaatatgcataatatttataggcaccagatttgaattctgctaggtggagtcatgcagccacaactccaccaccacgccaccacggtcatttgagacaaaagtttaaaattatattgccattttaaaatgttaaattatatatgctattatatgagaaaaatataacgatgctagccgcacaatctgcgcgggtcctatactattttagtcggtttcctctccacatgatgaaacaagtagcgtcatctgttgactgccctgccacgggcacctcccccgcgcgcacgtcacgcttttgtgcgagtttattcaaattctgaggcttgccgatttgttcgtcaacaaaacaagcccatcaacacacaatcgttaaaatggtagcccaactacctgatagcgtcacacctgtgcctccttgtctcctaatcacatcatccttttattcagagcaagcaacatcaatggggatcaatctatatacacacaacaagcataccttgtttgtagaagatctgcaaacattacagaaattaacctactgtactaagcttgtcagcctctttacttctttagttcttccctcattctgataggctgctccaatcgatcccgcaaagccagtccgcagtgtcctcttccgactatcgtctttagccttctgtgtcttttgttcagagcattagcaatggtcagctcagatgtggtactttcttgtagaaaagaattagttactcggttgacaaaactaacataaccttgattaactgttactaactgacaaatttctccatcaggttagcatatgagggtaatggggattgttttgttcagtttttactatccacagacattccaattgaatcaccatgcatgggtgctgttaaggctatcaatggacattttgccctctatataagctgttagaatgcgcagcccgacccatcaaccgtaggccacccagatcatattgggcctgttctaccacaggcccaactagccacaactttagtggtgctgggcctacacaatccaaaaaaactagtcgatataggtgaggactgtccccaccttttaagtcatgcttcccatcatcaattaccaattacaacgtagcttcctttatggattaatacttacactgacaaaactggcattgttgatttcggttagtttaaaaggtacttagtgacatatgctgctacatgcttctactaatactttactagttcaggaatctaaagtgcctaacctagaaaactgcaagctgaaactttaatcaaaactacaagaactagtgaaatgttgaaataggtagccgacaaatctagactttaaataaaaaggaaaacaaagtattgttgctaaaaactaggtgctgttcatacgaaaaaggacaaaactaatacggctagatgagagctgtggtacagctgatcctaacttgaattaaatttaaaaatatactttttttaataatttgcatttatatacctgggtggtaaagtttagcaaacatatacctcctccacgcgctggaaatgcgggagtaagatagtaacacagggcacggcgcgggaacgcggtaccgtagcctgggagtgcaggaccggcacggtcgcgcagaccgggggtgcggaaccgagccggtcccgcgtcacggctgtgcgagttggtgttgcacgcgggaccggccaccggcccgaccggtcacacagaacgcagccccaaacggtagcaccgagccggtcccgtggggcatcgatgccacattcctagcgcgcgggatcgcactactactccgcacctccattctgcgggaccgcatcgaaagttgttttgtccaccgaaagttcttttgtcctcttgctccatttggcattctcagccagaaataaaggagagagtgattctcttctctagtcctagcatttttcaggggatgtccgccaaaagtttgttgtcgtctggttacagagcctactcgttgagtgcctataaaatgaaagttacgaaatgaaagaaacagactcaagtatagcatataattcatattcgtagagtctatcattggtgtaagcttcaataagttagtgcgctttgcgaattcacaggccctatcttgtggtatgaactgagtacgcgatgatttatggcgcatattgggggcttaccaaaagataatgctgtgaatttgcaaagcgctcaaacccactgaagtgttgtgtaaaggtaaatatctgtaagtgttcgtgaagggaaagcgggtaaatatttcgaatttatttctttagaaatgtagctgacacattagaaagtttgaacacacaacattacatattagttcgaaagagcaaaatataaaatcgttccactcattagcctcatcatcaaaatttcgtgatgtgctagtgtcctttttctttccctttcttctagcactagctggaggtctgcgtcttgacaaagataatctttcaggtgaatgtcactcgcggacagacctatgtgccaccttaacaccgctgaaatcaacatgcccgtagtcttgggtcagctgagttattggaggtggttcatcaatatgcgacggtcctatctcgtgtagtgctgttgacgacccccaccgtagctacatggttctctgtaggactgtgtgctgtcggcatatcctatcatttggtcggcagtgtacattcctacaaaacatggaatccaaagttgtagcccactaacatactggagctaaaatattttaaagtatattgtaatttgtacatgttgtttgtggttgcatgataggtgattgactgaacaaccaatctccttggcctaacatgtccaaaaagcttggtccttgtggttgtacattttcagttatggacatttggtagatcccctgcaggtgcagcgctaatttaatatcgcaatataaggatcgtcaaaaatgaaacacattatgtacgaaccagtgttgtatgtggaagctccataccactgatcgttcatacccgttggaaacatgagcatgttaacttaaggtacacctgcaaaattaagcaaatatgtttgtgactaactaaattacaaaatgatgaacattaacatgcgtgtttattgaactaccggaaaacgctacgtgccctggaaagaactgtaagcttccatcttctgtacacatcagagggaccatttggctggatcctgcgaaccacacaaaccctccctgccattcactggaggtacttacacgcagaatagaagggatcactgctatactacctgcaataatctctataggtgaacattgaatttaaaaatagcaccagttgatccatgtcggaaaaaaaaataggaccatctaatggacaacaaataattaagcttggtttttctagagcttttcaactcctgcctcacatatatgagagagcaaagaaaaaaaatgcatagggaatagaacttgcaatagaactatagaaataaaaggctttccaagcaatccattgtcccacacagcgcatggctgtagaaaggtttgcaaagttcagaaaataaatggtaaaacgaccacctaatttcagtatattctgaaaattagtccataaaaatagtgtgtattgtacttttaagtccatagattaaattagcattaggcggaacaattaattctataagttaggccacttgtacttaaaaaaactgtgcatgaaatgagctaaattttaggacgattttcataataatgcgtagagcttttggtttaatttagagaaaggttaccataagtataatgattaaaaacaattcgtgcatctaatataattcatatattttcatatacatagcttgtaacatgttgattaaagtagtgtgaatgctagactatatacagttgtactagatgagaagttaacaagtcatccatgcaaaaatattttgtgaaacagtttctacccggtaccgatgtgaacccttgatgccactgtgatcctcctgttattgttggtataggcctaaccacttgcgtgctaacaagttaacaagtagtatgctcgaaaactatttgtatcataataggctttacctgcattgtccgatcggtttatcgtagacggtgccacaggccttgccgacgtccaggacgtgtggaagctgagggtcttgccgatgtggaaggcctagaagaggtagacggttgttccggtagggggtccgcaaacctgtgtcctgtgggacggtggacttctgatgcatgcctgtactatgcccccgcataatacgtttgcatttctgtcgcattcggtctagagcagacatcatctcctcgagggacccagctatattgtcacgcagcttctcccacagtgaggttgtgtcagaatatagttcctcca

SEQ ID NO: 55760 - DNA, 1087 bp, Oryza sativa
  unsure (1)..(1087): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataagggagaaaagaaggacattctagaaagaattgatgccattgacattagagtagaaagcatgggtatgagtggttctgatagagaggagagaaaggaacttgaaaatagactcaaatttgttattagggaagagaaactgaagtggattcaaagaagtaaaggaagtattacaaggggattgtaatactatgttcttctatgctaaggcaaatgggaggaagaggaagagtcagattcatagtttgtgcatgaaggagaggtgattgaaggataagataagtttgttgcttcatattagaaatttttacaaagatctctttggacattcaaaggaaaacatgttttcaattgatatggcaaatgtatctaaggtggcaaaggaagatatgaagatgttaaccattcctatcactttagaggaactcaaaacaatgatttttgaactaaaaaagaacaaagccccaggtcccgatggaataacaggagaattttacatgcatttttgggacttggtcaaacatgacatgattgacttgataaatgattttatcaagggtttaataaatattgatagattgaactttggagtgattacattgattcccaaaacaaaagatgcctctcaaatacaaaaatttcgtcccatatgtctgctgaatgtaagctttaagataataactaaagtcctcatgaatagactcaacacaatcatggcatacattatctctaaacaacaaacaacttttctgaaaaatcgtttcatcatggaaggaatggtgatattacatgaagtattgaattcagtacatcaaaaaaatgcagagtgggatcttgtttaaagttttattcgaagaaaca

SEQ ID NO: 55761 - DNA, 863 bp, Oryza sativa
cggtggagtcgactgtggaggcgtggccaggggcggtgggtgaggagggcagcgagaaagcgaggaaaagagggattgtggagaaagcgaggaagaggcaagaagtggctccatcggtggccttatccactcgggttcgttggttgtgggaatttttggccgtttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaaggcttctggatggcttgcgggcttggacctcagcgccagccataatggcgctgaccgtgggacactcagcgccagcccacctggcgctgagggtgggacttggccgcaacccccaaggcccagaccagcaagcctgctggatggcttgcgggctgggacctcagcgccagccataatggcgctgaccgtgggacactcagcgccagtccacctggcgctgaggtgggccttggccgtttcgagccttctggatggcttgcgggctgggacctcagcgccatccataatggcgctgactgtgggaaactcagcgccggctcacctggcgctgaggttggacttggccgtttcggccgtggcccagcccaacaagccttctggatggctgggctgggacctcagcgccaggtgcactggcgctgagtttggacatgtcagc

SEQ ID NO: 55762 - DNA, 944 bp, Oryza sativa
ttgggcagatacaataatacaacacactttaatagcattacaaaggtcacacaaattggaaaataacatctagccccatgccccatctgtcagcgcatttgatgctacctgcgaatttatacatcttttcggtgttactgagcaaagtgtgatcattgaatgctgggagaaggggtggagttgtaattatcagcacctgtgtgcaaaatacaaatgttctctcctctattggaaaatttatttataggaaagcgatacaagctgagtagctgatacatttatttttatcttcactaaaaagttcatgtgtgtgatacatttatttttatcttcactaaaaagttcatgtgtgtgatacatttctttttatcttcactaaaaagttcacgtgtgtgatacatttctttttatcttcactaaaaagttcatgtgtgtgatacatttatttttatcttcactacaatgttcatgtgtgtgatacatttctttttatcttcactaaaaagttcatgtgtgtgatacatttatttttatcttcactaaaatgttcgtgtgcgcaatacatttctttttatcttcactaacaaggtcatgtgtgtttataatgcttcctatttgtttagttttgccttttgcttttttcacctttctttctagaagctaaatataatataaacaacttttcttgttttcttcaagcaggtttctttgtctgatggcattattcaggaaggtcctcagagaatttcagaggcagctatacagatctctaggtgtcgtgtagcggattttctgaatggacaaactgggtatgatttactcccagattctggcaaggtatggaaaatgagctcgtcttgtatgaattttagtgctctaatggttattcttattacattatatttacaattcaggtcattgctctagacgttaatttgcctgtg

SEQ ID NO: 55763 - DNA, 2797 bp, Oryza sativa
  unsure (1)..(2797): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaattatgatattcctttccttatgtaaaagttactaatctagtttgaacgccttctacttccacatcaattgtactcatggttggtgattattgtctgtagtggccgaggtgatatttgcaatcacatcggcagtgaaggatgtatgtgggaaaccgcctacggagaggctcttccttgacaaatacgggaggatctgcttgtgccttgatgagattgtttggaaggtacagcttggggttgatcttctagtgtgtgaagttgtttcccccattttctgtgatctactctagtacctgagagcttgatgatatatatattgcacgttgttgatgcagggtctgctggagaacacggagaaggacagagtccggaggttgatcaggctaaagccgcccgttgagccatgattttttgatcactttggaatatgtgtgtatccttctcgtcgtgtaatcatatctctcgcagtttatttgctggcagttgtttttttattccctttgggatggatgattctgtatgtgtacaatcctaatacattttgccactgatgatttgtactgttacactactctccgtgtccatggatggaaggattgcagtttggcaatatgctgcattgctgctgcgcttttggtttcggtcattgctacggtatgctctgctttaagtgaatttgaatatttgatgaagcaaaaaatgagtaatcaccatgattattacatacatcgttgaatttgatgaaatggcaaggcaacctgtgcctttgagggaaaaaaagcaatggcgaccacgtcgcctgagctccttccaaagcaagcaccacatctataataagacattaattatattatattatgaaaatataaaacttggagatgttttcattaaattttttttacgttatccgtgtttaagttgattgtacgtccccaacccctccttctcctaacccaatctaaccagcctacaccatcacgccctcctctccaatcacctctatttcatcacaattggtaaagtttttatgaatcacaaaaattgtcttcacctcatgtaacccaaaggcatttttgctagttaataagaaaaaaaagaagaaagggtcaaaagcaagcgtgaggggggtgaatctcactataaaaagaaatttccattcgtagcacaaaacttaaccaaatttaaaaacagggcaataaataaaatttcagggcgcgaagaaaataccatatatatgtatctaaaccttccatctcaaaattatttatattctttaaaatcaaaatagatactattaggtggtgtttggatgcagggacttaactttagtccctatatttagatactaatttagagtattaaatatagactacttacaaaactaattacataaaagaaagctaattcacgagataaattttttaagtctaattaatccataattagagaatgtttactgtagcatcacataggttaatcatggattaattaggctcaatagattcgtctcgcgaatcagtggatgtgttttattaatagtctacgtttaatatttataattagtgtccaaacatctgatgtgatatggacttaaaagttttagtcacatctaaacagggtcttagtaaagagaaattcctcttgtgtggtgtgtagtaaatccctccctttgtttttttgggttaattagatccatgccattaaaaatatactagttttgaaatataccactagtattcaagtatttggtaccatgccattataattttacacatatttgagacatgtcactatttaccccttagatatattttaagaaaagattggacaaaattgcccttcttcttctttcctcctcttcttctcccttctcttcctgttcgatgcagcggggagcggtggagcggcggcggcggagtgagcggcgagaggcggcagcagctgctactgcgcggcggcgcggcagtagcagcagcggcgcgcaagtgtggcggcgcggcggcggagcaagattcttgtggccgctgctgaagataggagagagaggtatggcctgttcactttgatgccaaaaaaaaccttaccaaattttggcattaccaaaatttttgccaaaattttggcaggatttcttatatagttaccaaaatttggcagcaaactaaatatagtcactttttggtaactttatcaaaatttggtaatgttaaaaataacatcaaagtgaacaggcccgtaaaagatagatgagagatagagagaggtagaagatgagggtatttttatccaatacatataaaatacgcatcttagtggcatctttaagattgtaaacaaatagtatagtagtggcatcgttacaaatacacaaatagtaatggtatatttcaaagcatatacctaattaacccttttttttagaaaattggaaccatgccattataattttgcaaaatttgagatatgccatcctgacccacatgtcatttactcatgtgggtcctacatgtcattgagatactgatggcatatgtcaaactttgcaaaattata

SEQ ID NO: 55764 - DNA, 10683 bp, Oryza sativa
  unsure (1)..(10683): unsure at all n locations
cggccggtcggtgatcgagtgcggaagtcttggtgaaggcccaccgcgtcgcgtccgtgtcctcctcgagccgcgtcgtcgtcgacctccttcaattccctcatggctcgcaacaaggtaacctcgctcgctcgttcgcacctcctcgtcctccatgatttgcactccaactccaacgccacccttcctaaaccctatctataccctcctcctccgtccccttcaaataaaataaaggttttatccccccattcctagggtttttgggacagtaataatttacttcgcattcgattgttgtgatttagtatctatttacatccatcttcacattaacctatctgcattcctctccttccgctgcaccatgcacttgttgttaggaagtatcctgattttacattttcgacttgcacaccgtgataccaaaatctaatgaaaaaaaaaataaaaaccagaaatcaaacccatgatactgatcccccccccccgtccctgtgattctgcgtgtttgacaaaaataaaaagagaagaaaaaaccaatatgcaagaccatttctggtagcactttttattgccaatcaattatattttttttaatgtaggaagcattggttttgctattggatgttggcccatccatgcatggcgttctgcaagaagttgagaatatctgctccacccttgtgcataagaaggcaagcacacactatttccattttaacttcccagatgcaaatgctactacctggccacctgcaattcatcataacttgtaaccaatcagcctcaagctaacccccctgccttttcccccctctctgcagctagtttataataggagtgatgagatcggtgttgtcctttttggaactaaaggtattgttgcaagcaaatgtttaactaaaattttgtttgcacttcaaatgttctgtgttgttttttattagcttcattgaacaagcatatatgattcacaatggaaaaggataaagacatagttatattaaacaagtatgtgattaacaacagtgaaggatcagacaagttaatgtttcttcttctcacacatctagtctagttaaacacttcttctcaagttgctatgaacgatagatctacttagacaccaacgtttgcattgttttgctgcaaatttgagaaccatgcatgaacattgtttgggtcacatatttcttgcttcaaaagttccttgggctgcttgatttatgtttatatgtgcagaaacagcaacgaactcgccaaggagcttgggggctataagcatgtggtggttgctcgtgatattaaagttgttgatgaagaaacaacaaatgctctgcaaaacctttcaaggggaacttcccctggtgactgtatccacaagtagcactgtatgctgatgtttggtttatagttattgttaactagacatccgttactagatttgccataactactactatcagcacacgacacctatttgatctttcattttatgaggcattttttttgtcttgccctgctgcctgcatttgcatgttgctagatcatatctatggtgtaggagctcaaattagtatttctcagtccattatccttaagtgtttgcattttgggggacttctttgttgtgatactgccatccatattcagcatccggctcttcatatagtagctcctgcttatggatttgtgcttgtttcatcttcttttttttccctgtctttaagtcatatagtttctttgttttacatcataatagcgttgtttgaacttgctctgtactcttctcgagtttgatcggaatcagatactggaattccttgactaaggcaagttttggatgctattgttgttggtttggatatgctgataagaaaatttggaaatatcaaaggaaaacagcgtatgtgtctagtcactgatgcacaacatccattaagagatccaccccaagggacaaaaaaggatcaggtggacactattgcagaccagatgaaaagacacgaaatcaagatggactgcattattttcagagaatctggagttcgtcacaatgctgtaatggatgaaaacgaccaattattataccacttcagagagaggtcagtaacaaaggtagttcatgttgacagcccaacgtcactcttaggtgctctcaggactagaaatgtacttccagttactgtcttcaggggagacttggaagtgagctctagctttaaaataaaggtggggtgttgttttcttaaattcatgtaatgttttttttttcagttagagaaatttatattaattctggttcagtttgcaatttggtctgacgtctttgtgaacaggtgtgggtctataagaaaacatctgaggagaaattccccactttgaagaagtattctgataaggctcctgcaagtgataaatttgcatctcatgaagtcaaagtggattatgagtacaaaagtgttctagaaccagacacagtcgttccaccagatcaaagaattaaaggatatctttatggtccacaagttgttcctatatcatccgctgaatgggaagctgtcaagttcaaacctgagaaaggtgtgaagcttctaggttttacagatagatccagcatatctcggtaacccatatccttcaaccttttatttggaataagattatgttctttggaccttgtggtcttgtattcactgatgccatttctacatttaatttcatgattatttcaagttgtttgaggtaacttgtttgaagacatagcaaaccaatccatgtgaacattcaagcatgaatagttagtttatgtactttatatcattggagattgagctgatactatgaaacaaaacattataaaataaattcttgctctagctgattacctgatccttgcaattatgcctaatataaatgtttaaagagtacatgtttcgtgttatgtggtgttgcatttgagtttaagctgtaggttatcatttatcatgttataaaaccccttgggatgaatatgttgcaagctggaattggtgaatggtttatgcatgaaaacaatacatgaatgcagtgctctgattcgatcaatcaatcataaatccttgcacgtaaagtttatgtttttatgtatagattacagaactcagatctgtactgggtcaaacttctgtttatccctaaggactgccagggggttcagcttatacaaaagctaatataaaatttcttttctgaaagtatctcatttccaaaatttgtaaagataaattgctgtaaacatgtttataagtttaatattaaatgtctttactatattgcagttttaagaccagatgttagtaacggtgacacagtccaccttttttactttaacaggcactattttatgaaagatgtgttctcctttgttccggaaccaggaaacacaaaagcagttgctgccgtttctgccttagctagagcaatgagtgaaatgaacaaggttgcaattttacgatgcgtgtggaggcaaggtcaagggaatgttgctttgggtgtattgacaccaaacatatcatcagcaaaaaatgttgtatgtactttatttactcacaccttatacctgtaggattcgtctgatgattgcatatgttcaagcaattctttttttttccttttccctgcagctggattccttttacttcaatatacttccatttgctgaggacatcagagagtttcagtttcggtccttcagcagcctgccatcatcatctcagcctaccaaggaacagcaggaagctgcagataacctggtaaagatgttagatcttgcaccacctggaagggaagagatccttaagcctgatttcactccgaatcccatgttggaggtgctattcttccttcagaatattgctatttatcaaaaccaatttagatattctgatatttttttctcatattatataccttaagctatttttcctcttcttttcactttttcattggagtatgctctgcaaaggttcttgtatgtatttgttttgcttctaagtttactaataggttctagatcacttgacatttttcttttaatgctccttttgtgcatattctttattctgttgactaaggttcacttgccacttccccctttagagattctacaggtaccttgatctcaagtcaaagcagccggatgcaaatgtcccacccctcgacaaatgtctaaagaagataactgaacctgatcctgatgtcattgattatcaagcaccgctaataaaaaaattaggcaatgtatttgagctgaaggagaaccccaaggttagaaatattgctaacgtatttgtgttattgacttgatactgtaattttggggaaccataaatctgtttggactgatcacagaaaaagaaagcacggacacaggacagattgacttatactggcgcagacgatcaggctaaattattagaagaaccttctgcagagaaggttggggtttcggaagctttatatcctccaaaaaagaaggctggggagattggcgatcataatcctgttcaagattttgaagccatgctgacacagagatctagctcaacgtgggttcagacggcaattgaagagatgcagaagtacataaccgctttaatacaggattcctgtgatcgggataatcaccaaaaggcactggagtgccttgttgctttacggaaggcctgcattattgaacaggtaatctctcctatggttattttcatttgattgcatggtagttagatgtaatccatgccccttattttgctgcgagacctcatgtatagtttaaacatgcttgctcagttgtaacttaggtgttgttttccattataggaaccaaacgaatacaatggattcgtaacaaagctctgtcagaaatttaggccggctggtgataaaatttttttgcagcttctttcgtccaagaaagcttcgcttataagcaaagaagaagcacctgataggtaagggaacctccatatgtgctgtagaaaattctatgtgcattgttttctctcagtttttgccatttaattaccctattctatatgcatgtagcgatgtgacggaagagatggcgagaaacttctgtctgaaacccgagccgtcctctcagtagccgagactgcaggcatggatgtggatggctttgagttctgaaggcctggaagctaggtaaaagaggaactggaagacatcgaacggccctagtactaatttctaacgtacgcctggttaaaatgttatgtagctcggtttttggaaagctctgtgtcatgtgagtgatgagcaacacgagctactattgttttcgaatggatatgtatgttgggatggaaaaatcccagatgaaatgtaaaagacttgcagtttgagatgtcccaagctccaagacttcaattcctcacctccagaagctctgaacttaaaattcagcgtttctgcggccgatatcagcattctttgcgtgacatagggaacacactctggcgatcagcctcagggtcagggaaagaacacttactcattcccagcctttattcaaaatctgtgaaacaaacaaaacacgcacaaatccctgcagagactcactagattcaacaagagattcatcggcattcatagcctgtaaactacaatttgtattttgtagtagtacaacaaactgagctttggcaacagctaattaggcgtccttctctgccacaagcttgtcgataagcacagcagcatcctccactgtctgaatcacttgcgcactcgattcgtccacggtaatctgaaatgcctcctcaaggcccatcacaatttcaacctaaaaccaatcaaaacacacataaagagtaatcagaggcatcatggctgcaggcagcaaatactaaattcctgagattttcataagaaagaaaaaggcgccacattcctgggataaaagagaataataagctagatcctgggaaaagagagcacaaagctagatatggaattgattcttcattccactatgaacggagaataaattcatttatacaatgactaaatataaaaaggtgtacaattgccgcatctgcgaaaaatgtattgttgagagcaacaacaacatgccaggagagatgttgactagaataatttttaatactaatctgagccgtgacaaatatcagagatcactgtggactttcaacaagaaagtatgaggttgccaagaaaagggctagttgagaggagtcttacagtcccctttaaaaaaaatcaataaagtagtccaggtgatttagatagtgttgaattattacattagtccagaagattaccgtgtcaagtgaatcagcaccaaggtccacgaattttgtttctccagaaacggcagtgccttcatctactgctaactgattcttaactatttcgcaaaccttatcaatagtgtcttgtttggcctgttcaataatgtaaaataaatcatcaagcagagtctttgaaaatatcctgcataaattttcatgaacatattgtaataatataaactgctacccacagcaattacagcatgggaccaaaattaggctcaataaagtggaaatactgcatgctttaagtaaatatgaacaggactaagcaatcaaggtagcagggtaacacactgaaaatctgcaagcagccaagcagtttggaaaattcatcaggagtaaccgattctatagccatcgtgagtgggcagttctcttgcaagctaggataatttcactgtcgaatgcatctttctagttcttaaaactgattgtgaattttttttcaaaaccattcctcctgccataaattgtttgctatgctgtcactgtaaatctttaaccggtaacatagttctttttctaaaaaaaaaaactcatacaacataaaacattggcatcatagtcagtaatgtaccagggcagcagtgtaggaaaactaatgaggaacactatattaccatcaccaataattttctttatccccttgcaccaagtaaaaggaatgtaagatgcagtaggtgatggcatgatacatcaaaacatagtgaaagttcttggcattgtatggtgtgtgtgagaatttcttatggtggtttcggcaaactactttgttggtgaacgtataagagaagaagaaagattgcagtgaagcaataatttcattggttgactgaactaacatgtatattaacatctggagtggaaatcaaaactacatttagcatcagaaagtaattgcagttcagttgattatccacatggcagaaatgtgcattccaactctgttggaggcatcacgcacttgcattgagcttagaagttaggcatgactgtacagtagagtgcaaattccaatggtggaggtagcaaagacatgacagtgatattacatacataccgaacaagacaaggcctgnaagcgacttgnngaccggcgcaaccgaatggacgggaagctgctgtttgcctggagaaagaagctgaggttggattgagcattgagcacatcacctgtatgtgtatgtaaggaatatgaacacaattaaaaggggggcaagcttgcttgaaaaaagaaaaaaaaaggaagagcggcacaaattgaagaagtagctagccaagaaatgaagctggggggtgacctagtatacctgaacccgagacgcaggggagagaggcgatgtggcggcggtgatgggagcagccatcgttggcgcgcgggaggacgatgacagggggcgggcggcggagagtgcgaagaagatggacaagaggagaggagatggaagaatcttattgctaagctttttgcctcgtttgtatcgacggccgtgcaacttaggatgcgcatcaccatttccggcctattttttttgtcctattccgacattatcatgggagatcccacaaaaatgggatgcaaacgaggaacactctctcttgtgatcaccatcaccactactcacccatcttcatttccaccatcagattgtgttactcacctttttttttccttctatattgtccgtgacgatcaaaaaaacaaaaattactcaaaaatagaatacatactaattacctaattattaatccatatactaattaatatgatctaattttattagaattggataatctaccggagtcctgttatccagaagattataatgtttgaaggcatatattccttccattcaatatttctttttccccaataacatcaaagatacacaatgacatagctcctttgaaatttggagacccgtgtgaaatcatagccgagccgtaaacttaaatgataaaataataataatttacattagtccatggttattttatagctccttcctagtattggattacaccttttattttctctatggttttaccttttcacaaccagagtgacatttttctgatccaatttttagaaaacaaatggcttgaaagttgaatattatatacatgatgaaaataataaaattggaatttaggaaatgaaattacattataagaacaaagttcacgtttacctgatgagatgatggccgatagaatgagactatataagaacttaatcatgcaggtggtgagagcctatggctatagtagtgcaacctcaccttcatacgaccggtggcaggcgcgaggctgcaaggtgtgaaccaacattgcagagcatttcggtcgagacaatggtgagctagtagtccagtcaaacgtcaagattcgagaaaagaaagcaaaacgatgttgggcgaatactccatgactctcacgcctacttgcgccatgggccgagcagcctagaagcgcttgatcgacctaactacttgggtcttgggcctcccgtgcacgatggtgtttggggaccctagatattgggattgtgaacagccgctcagctcgattccctgggacggtcctgcacgtacacagttatgagtatgtcctattaatacatgtttaaatattttgactccattagctaaagtttactcttttatcaattctattagttttagttaaaattaggaaatggtactttacttgtgataataagcgacaacccattattaaacaaagtgagaaaaatgtttgttatatctctagagcctagactatgttggaggcaattttttatagagtggtgtattttgtaatgatggctaactaataattggaagtctatggtttttaattttagtttcctttttttaaaaaaataaattgattagttctctgtaggcatgaaaaacaaccaaactaaaattgaaaactctacttgtttaactatggtccttgaaaggtattgaatgaacagtgttccttaccttaaggtatatatgggtgtatataggagtatcttacaatagacatattgcactttacgtcgacacaaactaactccaattctcaagtaaaaaaaactcatttaccaatgacataggatagtttaaaagttatcaatccttccacaagaatatcttaacatggttgaccggcttccatactacttagtgagtagtaaactcaacatatttgttcccatcatcctaacttttagcggtaccaggtaaataagcacaaaataaagaaaaatgatcatgtcatcaatttctctaagacattttcctatacctctaatacatgctctagtactgttataattgatatgttgtttggctacgtcttcttaatatacggtgtcatttgtattcttctgcacgtttttgttgtcctattagtcccttcccgcctatatattatttatctttgagtagaagaacatgctctactatgcatttaataggtgctattttcgccaagtataattaaatacgttctagttttgtattaaatagtatgtcagacgattttgccgctcttgcatgcacgctacgtatctactatagtcttatcatcagtgtataagtgacccattttactgctgttgcatgcacaacttatataacaaacaactaattggatttatttatagtgtatataaaactaaaaatatctgtatgaaagttttgattggaaaaaaaaacaatactaatacgaatggatggagaatacaagtggtggtattggaggtggcaggcagcagagcacacaggatgggggtgttgcgggcgcagaagatccgtagatagataggcctcccctcattttcaaccctcggaagggaagcctcctttgtttttttttttcccttcttgttcatttctctcttgctccggctcgcctcgcatcgcctcttcctcctcttccctcatcgcgttcgcgtttccatccccatctccatctcctcctcctcgccgcattcgcatctccctcctctcgccgccgccgccaccgccaccgccgccgctcccttcctgccattaccgcccgtgcccctcacccccctttgcccctcgatctctcccccctagggtagggtaggggcttgcctccgattccgtacggacacaccctacctagggtagggtaggggtaggggtagggttgatagagagaggttccgggatgacggccggcgagggctgcgcggcccgacgcgggtgatccgctctcacgcggggagcccctctcgcgcgcgcttgcttcacgtgggggatcccgtcgcggctatccctcc

SEQ ID NO: 55765 - DNA, 775 bp, Oryza sativa
tggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaatacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatactttactgacgcgt

SEQ ID NO: 55766 - DNA, 2248 bp, Oryza sativa
cattctttgacagtattaagttattgacctagaagcttatttcacatgaattataaagacgactggttcattaatggaatgtgggagtctatgcatttgaacaatgtacctgcttgtaatcccgattctgctgtatcacttagtaaccatgcatctcatggaactttgtttgggtgaccacaagaagttcagccaagatagtgatcatgttgaactgtttttcccttaattggaagtgttcagttagtagaacctccaaaaatttgaaatcgtatcttttggaaggtggactctagaaaatagaaataaatatgctagtagtagcgactgcatcatgatactttatttttatgctgtttgaattgtttctgcttccaggtaaaggattattaatcctgaccatgtgatttgttacttgaaacaatttgtgagcatattccaacagagtagcatttaatatcttgtttatattgcagctggaaactcatggctccaatctgacagaagagcagcttgaaacacatactatatctgcgtggaaggaggccaagcgtcaaacttatgccagaaacgagggttcttggagggcaaatcaccatttagttcatgtgagttgtccactgtgtttgtgaaccaattgcaaatctgtatgcactcaccacaaattgagactgctgccatcaacttctatctatatttactggccaaattacactccagtgaattttagaattcatgtattgcattctaaggataatattttaccctttgatttatttgcatttgacaaattgttgtcaacaattgttgtgtgagtaccacataacagtttttggcacaccatgacacacatttttgtcataacattttttggcacactatgacacattttactttttgtgttacaactaagttatctactggatgctgaaatatattttgcttaattagctttaattgccatgctcaagtgagttacttagtgaactgcaatttgtttggtgtgaaatttcatcgaaccccttgcatcaactgttccttttcatttccatcctagtattttataacatgcttagttttataatgatcatgtgtctcatgcacttatgctggagtgaatctattgtttaggccaccccttatgaatccctgagggaaattgctatgaagatactgcaaaacggtgtttctaccgttccaattatgttttcctcatcaccagatggctcagtatccacgcaattcggttggcattgcctgtggactgtgccccttatactggacattttgaaatgtaagtgtttctatgtatttgcatgaaaagtgtgctatacacaaacatattacatgatagcttaacaacatttcattttcaggtatttgtagatattttaaaaattctcaaggtaatttacctattttgagccaacctgtatgcacaattcctctgggtacctgggttccaaaaattggtgatcctaatggccgtccattggctatgttgcggcctaacacatctcttagcgctgccctgaatttgctggttcaaggtatgttatctgtctgttttaccataaccaatgcctgggaaagtacttgcatttctgtttcttggtgcaattactgaagtttaatactaattccactgagatctcttacagctttcgattatttacgctatcttgttgccaaattaatgtcttattacaattactctgtactctaattgtttcattcagctggtgtgagctcaataccaattgtggatgacaatgactcactgcttgacacatattccagaaggtgcccatttgatactcaccattctttgtgtagtcatatactattctttggtccatgtattcattgtgttttttccattatgtagtgacatcacagctcttgcaaaagacaaggtgtacacacacattcgcctagatgagatgaccattcatcaggtatgctagtaaatatttaatgcgtcttgatttagtttgtgtctggaattttagctgggatacagttgtacaataatttttgcagagtttcttttggtcttgaagactggttaacttagaaaataataactttactgatttatgtatatgatagggaaatctgtatcgatacctgcatcacacatatatactatgaggacatgcctttgtggttctggcatttattagccctgtgtctttttgcacgcagagcatggagcatgcacacacatctaaaacaaaggctgtag

SEQ ID NO: 55767 - DNA, 6722 bp, Oryza sativa
gagcgattagctaatcctgggttttatctgtgcctagatatgcttcctgaaagcaacttttcgggttcaacttactaatattttttttttgcattttatattgttggtaggggtgcgccgtgttttcattgtggaagctggtagcaaacgtgtggagggcataatatcactgagtgatattttcaagttcttgctgagctaagtgaaaatgcccgagccatctgtgttttgttctcacaactgccggagttaacaatagcagaaaaaaattgtgaatctccaacatcgatctctctggcttttggatcagacaggtgtcttttcccgataatggccaaccagagtctgtaaagtcttttttttttcccttgccccttcgttaccaaaatgtctggtgatttttatttattggattgttttgctgcttgctcggtttctgagccccccaaggagttagtagctctgttgaaagggtgggatgggcgcttagagacatattttagcatgaatcatcatcacagggaagtaagaattgaaggaaagaggggatgctctgaagcaagaaggatgaattcaatgtgttgtttttgctcaacaaccgtttttttggcgggcagtgttgcaaccatgaaaggagaaattacagtcggctccttgcttgttagacaaaaaaaaaaaagaaaaaaaagaagagaaaaactattggatatctgatgatgtagtgactgagaagcaggagtggagttgtgtaaaacctgtaccacctgatttttatgtctaaaccgcagcttactcattttccttgtctatgattcttgcttgcttgtgtagtgaatagtagtttttcttgtctggtatctctctctggtagcggcgccgacgtgcggaggctgtttgtacaagttgagccgcatgcaatgcatgttgaggagcaactggaaatcgatttggaacttcattgatgcgtgcaggtgaaggtgaaggtgaaggtgcaggtgcagcgtgcggtgcgtccttggtccctgtcgagtaacggcgacgggcttggcgtcgagcggaaagatctagagagggtgggttacgtcgacagacactggataagatcaatccacatcgccacattactccgcccttttagacgcttgtctgctgctgctcatcagtagttcatcagtagtagtggtaggggagataattcgtcgttcgttttgtgcatccatccagaattcgttccagatccagccagccagccatctcaagcttctctcttctcttgttattaagagcaagcaaacagtagtctagcgaagcgagactgcgagagcagagcattgttcttcttctctagctattagtggtggggaataatggctcccgccaccaccgcagcaatggccctcgcgccgcctccttcccatcaccatcaccatcaccatgtcaagcagctgcagctccctccgtctgtctccgtctccgtgcccctccgctccggtttccttggccgcgcactgcctgctgctgcccacccacagccgctgctcgccgccgagagccgccgcagcagcgccgtgtccgtgcggatgtcgtgggacgggcccctctcctcggtccgcctcattatgcagggccgcaacgtcaaggttctcctctcctactgctaccactagtttgcttccctggaatttccttcgtttcatattataaggttttctagcattactcatattcacatatatatatatatgataatattctagattcattatcatatatatgattataggtaatgctagaaaatcttataacctgaaacagagggagtatatataattcggtaatggaactagagtatttgttttattaattggacctttatgaaatactagtagaattcaacgaaactacattcttctttattggttatattagtagtaatttgcttcactagaattctattttatactagagagattaaaaattattacaaaactaactgtatacccgttgcaacggaatagtaatatggacctattacttattactacctccatattttaatgtatgacgccgttcactttttgtccaacgtttgaccattcgtcttattaaaaaaaattatgtatctattatttattttattatgacttgattcgtcatcaaatattttttaagcatgacataaacattttcatatttgcaaaaaaaaaaaacgaatggtcaaatgttagtcgaaaagtcaatggtgtcatacattaaaatacggagggattatatgggatagctacagtagcagagtcatgataaagtagtaatgtgttgggaggagcggtagagcgttgtgtggaaaaataaagatgggaatggaatggaatgaaaagcgtacgtgcgtggcgtggcggtgcagctgaatgagaaggtgaaggagcacatcgaggagaaggcggggagagcagtggcgaagcacagccagcttgtgaaggaggtggacgtgcgcctctccgcccgcggtggcgagctcagccgaggtcccaagatttgcaggtgcgagatcactctcttcaccaagcgccacggcgtcatccgcgccgaggaggacgccgagtccacctacgccagcatcgacctcgcctcctccatcatcaagaggaagctcaggaagatcaaggagaaggagaccgacgtccgccacctcaaggggaccaagccccccgtctccgactggccgccatcattgctcgacaacaacgacgacgacgcccaggcccagctcaaggatctggaggaggccgtcggcgccgaggacgaggacacggtgctcaccaaggtctgcagtctgatgcatgatcaatgcatataaatcaaatcattcatgaaccaaattaatgcaactgtgaatgcaggtggtgcgcaccaaggtgttcgagatgccgccgctgtcggtggaggaggcgatggagcagctagtgaatgtggaccacaacttctacgccttcagagacgagaagaccggggagatgaacgtcctgtacaagaggaaggaaggaggcttcggtctcatcgtccccaagggagacggtcatctccacaaggagaccatccccaactctgaccaccaccacccctcccttgctgcctagcctctacacctcctgcatcaccatcctcatttgctaattatttctatgcttgcccaagagtctctaaatattactagtattaattaatccaagtgatgagagaggtctttgattttgtctccgtgtacatcgatcgatcgactcttgactactctgtttaaccaactgttttcgatatatttatattattaatgatttttccaaggtttttactctgctttatttctggaagctgcatgtatagcttgtgcttttgctgtattattgcaaattttaaaaaatatatcctacatcttagccactcgatcgagaaacaactgaggaagtccatttgtacctgtttttgaagataggagaaacgttatattcagtttttactgttgacagagttgattcgatccaaatcgaagaggtgaggaatgtacaatagacttattcatgggtgtgtaagttaataaataggaataagttcaccagaggtcccttaacttaaccgcgagatttttcgaggtcccttaaccacaaaaccagaaatgtgtacctctaaactcactgaaaccgttcaaaggaggtcccatagcagtatttttgcccggttttggtgacgtggcattctagtcagcaaaagaaattaaaaaaattacatgggacccacatgtcatcagctgcacatttttttcttctctcttcttctttctctctcctctcttcaccggcagcgggcggcgatgggtgagcacgggatgcgggcggcatgcggagagccagcggagtgggtggcgaagctggatccgcatgtgctgctggcgccgccgccgcggcagatgaaacaactaaccgaccatcgctgcttccaggggcggagctagtatatattagggggggtgcccaggaacccggttaagaaaattttttagctataccttatctatttttaccatgtatgcacccccctcaatgtaaacttaggcacccgcataagcttaaactcgatctaaagtagagtaaattaagcaagtggcaccaccctccatttcgctctagctctgcccctggctgctccgcctgtctgctacgcccgtcgaccgctcgccgccgcgctcgcccgcccccacccccgccgatgggagcgaggcggccggccgcgccgacgtgagaggggcagaggcgacggtggcggcgctgacgggttccttcccctgtcgctggtcgctgaccggtcgggggacgacattgacgccgtgttcaaccccgaatggcgccgtacgattctactgcttgctatatagctcaacgattataaagcttgaaggatgaattgaagcttcgcttttcttgagctatatggtgtttctttgggttttcttctttgtaggtaggtgaccaggcgctgtacaatgggttcggggccgccggaatgcatggcgctgccgtcatgcagccgccgacgttcgggcaggtacgcggccaagaaccagtactcccgtgggttcaacttcttccccaattcattctgcttctttaccagcgttggaaacaactgcctgcctgccgcctccgcggcgctcgtccgccgtcgccgcgctcgcctacccccgccgctcatgcctgcttcgcttgccaccgctgcgctagcccgccgtcgccccgcccgtctcggcccgtcgaagaagagagaagagaagaaaataaaggagaaaagagaagaaaggggaagaaaaaagagatgtggggccacatcattttctctcactgacatgtgggcccccacatatttattttattatttttactgactagaatgccatgtcattaaaaccagccatctatactgccttagaacccaaattagatggttttgtatagtttaggagtgaagatttctggttttgtggttaagagaccttaaaaaatctcgctgttaagttgagagatctccggtgaacttatttctaataaatatagccattagtgggccgcctatacgaggcttattttaggctataaacgggccgtcattatgatcaacacggtccatcgccacgcatgctaagcaggctgattatgtgtcttctatacgttatgttactgcacgctcactttaaactgtcaatcatccatcattatagttaggcttatctcatattctcatgcaaaacaagaatgttcaacatcacccactgacaatgtactcacaaaacacacgtacacgcgcacgcccacacacaccaacacacgcaacgcacgcacgcacacacgcccccccaccacacaacacacacgcacgcacgcacataaaaacacacacacagacaattgcatgtttcaaacattacaatcaatccgcaaacgtttagctattattttctacaatgaaagcagcatttaattatcatgaaagcaatagtcaattcataaacactttattccagcactggtagggtgtataaaaatgggacaatagctaaaggtaaacaatgcactattattcgtgcaatgcatctactccctcagttaaaaaatgagaagctttatccttcaataccctttacctaccatcactcttactacttttattaatgattaagggcattttagtcattctcactctccactatttccaccttgggatgctaggaatggtttttttggacggacggaatataaggttggaacagtgagatgtgatatagtaaaatgttggactacgcacgtgcctgggatgcgcacaaacgcattgagaccagcccacgtgcacccgactcgacccatgctctttctcttccgtttctaatcacaatcatcgaccgatctccatccgagtccacgcaggcatttagggtcgaatacaagaaccaaatctattagaggagggtgaatggtaaaaacattaaaaaaataaatccttttatggaattaaaagaacctcaaacctaataaagttgtgtccggtcagaccgcgttgtagctgtcggtcagaccgctcttggttaacaaatctgccgacatgctcgctgtcgctagtgtgatcgcccatttatcgtcggttagaccgctcgcatgatgccggtatgaccgttgggaccaaaaaataactttattgcatcaaaatgtgtttataaagtgcatccaaaacacttagctctcaactcacgaactagaattgaagcctcaaagcaaaccctgactttcctttccaaaaagtcaagatacttaagccacatcccctcttctatttataccaaaacatagttgtattttgccacaaatcgaactataattaggaatcctaatgacaaagcaaacccttcaaatcaaggaaacaacatccctatacaactccaaactcagatctcctcaaacttggaccacaatccaaatttgactcatctttccatacgcacgcaatctcccttatatgccatacgaaaatctttatcctcacgtgcattgttctctagccttagtatcccacaaaatctcgttaaccgtctagacctcaacttctcccaagctagttcagatccatcactagcgatactatctgaggccttaagcaatatatgcacatgaacaacaagagac

SEQ ID NO: 55768 - DNA, 729 bp, Oryza sativa
aggcctgaaccagatggaatggacagaggattggaaggagagcatgagcagcaacagcagcagcagcagcgccacaacccacggcgacccgctccctgcagcctcggcctgatcagcatatgcatggtggtggtgtacttggcggcgcagcgtccagtagcggcgtcgatgctggaggacgagaaagaggaggaagatggtgacggcggcgagcggggcggcgaagacgcggaggccgatctccgcacggcgctcgatggccttgtagtcgacgtaggaggagacggagaggaagaagatgacgatggcgaagaagacgagcaggcgcaccggcgggagcgacgcggaggacagcaaccgcgccgtccacgaccgccgcctgtgctgcatccacgacgacatggtcgatcgatatatatatatatatatatatatatatatatatatatatagcctagctattgtttattcattagctagcaggcagcagagatcgatcgatcgagatcaacaattcatggacaagaagctcttggagctagctactgctacaactggtgggggatggatatgcggtggagggagggagagactagctagctaattaagttaagagcttgatgccggccagctgccgatggatcgatcgagatgctgatgagaatgaagaaattaatgggcggggcgggggcggtcgaatcgaatcgaatatatgcttgctagctagct

SEQ ID NO: 55769 - DNA, 13291 bp, Oryza sativa
  unsure (1)..(13291): unsure at all n locations
atctatcccaacgaccagatttgccccctcccccccaacattgggcataccccgccttacctaactggtcgatcgatcactggtgttatttttttaataatagaaatggttattagtggcgctgtttccttacatgcatctcctctctcgtctctgatagtttactccactagataggctgccgccacacttgcctactaaccattgtatcttcctttcctcccacggaccctacacatgtggtcgaccctgcccaatttccttctctctcctcgtagctccggtactccgtccatcacatacaagtacattgtagcctatccatctccgccacccacacctacagttggccaaaaggcccgtagtccgacggtccggcccacaacacggagttttggtccggtccaggcacgacacgactcgactgttgtcgggcctgtgctagcctgactcaaccgttgggtgttggctgggcctcttccttggcacgacgtgccagcccgacacggccaacactcccgcatgccatagcccgtcgatggctggcccaaagagatgagggaggcaaaatagacttattttagccatataagacacaatccaaagatatgagggagacaaaatagacttatttcaaggatgagcacagtaagctagtcatgccttcgggccggcacggcacgtcctgagtcttattgggccgtgcctaggccataggtacagcccgtgggtggacaaggcacgacacggcgtatcagtcgggccgtgcttcggtcgtgtcagaccgaaccatgtctggtgatctatttgactatagttagctctaattaagcctcaaagtctcgaactttctttcttcacagaatcacaatgctcccctctctaacccgctatctaggtagaatcctaatatgtccaaatcggaatcgggcggtcgtcgaacgaacgcataggggccggcttggcgcattagcccatctttctcatgaaattgaccacagaggcaacacgtaggccagcgcacgtacacaagttccaaattatgtccctgccaccacttaatacgcagtggattattatatactccctccgtttcaaaatattttttttgttttctgtactttatcctttttttttacagtttttgtctcctctattcaatgaaattgacggcctcattgattcgttcaaaaaaaatgtttgacaccgttgactttttagtacatgtttgatcgtttatcttatttaaaaaaaattgtgaaatatgtaaaactatatgtgtacatgaaagtatatttaacaatgaatcaaatgatatgaaacgaataaataattacttaaattttttgaataaaatgaatggtcatacacgtactaaaaagtcaacggtgtcaaacattttaaaacggagggaatagtatgtaattgtaaatacagatggaagggtgggtgtgcatacatggcaagtagctagggaggcttgcacatggtgggcaagagatcgaaaagaaacactgacaattcataaggcccctagctagctatcaatgtgaagtactcactccatccgaaaaatacgaatctagaactgaatgttatgcatcttaataccatataaatctggatatattatatccggatttgtgtcacacatcagtactagattgattttttataagacgaagagagcagtagtatacgtttagctagtagcctctctagctcagcatacgtacatcgatccatccatccattatgtgctagctccaaacataagatcgcccatggtattaattaatatgttggttgctagtattagctaactcttgtccgatatattgtttctcgactcttgttgcggggacaataattagcaggcaaattataaaagcagggggaagatccaagctaggcggccagtccgtccggtatggaacatgacatgacatatggtactaagcatggatatatatgattgcttgctagttgcattcgctagctatatacacaggcctggatccatccatcgatcatatgtatgtatgcctgccaaacatgcacctacctgcagatcttctacccttccttgtcttatttgttgtcgtttttgtcagagatatatcgatcaatactactgctaattaatagtagtattaccttagctagtcgatcgatcgttctagctcccgcagaagagttaatttgtttgtcaacaaatcagggctatagatgatgggtattcagagttccaaagtagctttcttagatataacaatatcaattgatatgttgttagtacaatatagtaccatttttatggattacttttactacgatttgtatgcatgtacgataaaattatattgaaatcactatagaaaatgatttttcacgacgtcacccaattattctcggtggcggctatttgttcaaaccgccagcaaaaaatgtaactgggggtggggggcttcgaatcgcaagcgaaaactgatcttcgctggcggttgaggccgacggggctcggcagcggcggcggtgatggtggaggggacttcaaggacgacgacggcaacctcgagtgcgacgacgccggcggcggttctctgtatttgtgatgtttgtaatatttgtgatgcactctatttggattgatgcttgatgttcaaatttttgttaatttggtgatatttgtgatgcttgaatgcttgtgtgaatgggaatttttggctgtaaattgtcgatgtaaatttatgtggatttgtggatggagcgctgatggaggtggacggagcagtgttttcttttcatattttttcttttcaaatttcctcttcgctggcggctagggtagctgcatggttttgattttcgttggcggtcgttttaacacagccgctggcggtcgcggtcggtgtaagacaaccgccagcaaaaatagatctttgctggcggctgacttaagacgaccaccagcgaagattctgatcttcactggcctttgctttgtggcggctccaaattccgccagcgaaaatctaaaatggccgtcacgaaaaatggttttcgtagtagtgagttttgtaattcattataatcagcatcaaactataaatctttaaaataaaaattagtaggatgttatttctttacataaatttcactttggaccaccttttattactgatgtttgattcatttggatcacctttcaaccaatgtttttattttatattagatgattttacctttatggcactttggactatcctcaactcttatattccatctatatctaatntatcatatgtcaaatataccgtctacatatagctgagggagtttattgatgagagtgaaccagcgtacttgagtatatattcatgcatgcaactgcagcttattgttataataattaatcngtgagaggagagagagagagagaganccaacgnaagtaaggttgtaaaaggtgtactagtacacangatttggggttgttctgcatanacgattatgtcgtactatcgctaaacgcagtaaagctgatcgatcttacatgtcagcaacttgactacacccggtccctgctgcctaactaactaattataatttactagttcgtactcttgtacttgcaactaattacttactcctaattgctactgctctcgatctagggttacaagccaattagatcttaaactaactagcactaatttttcatccatactacacatatatataccaatataaaaaaatataatatcataactttattaaattctaatacaatcatttttctctttatctattatcaatgcactactaacataatttgataaaaataattacttaaaataaatttattttgaaataaacgtgaggggtcaagaaataagaacccatctcctatacacgaaaaatggagcggttcattaacacatgattaattaagtattagctaattttttttaaaaaatagatcaatatgaatttttttgacaacttttcgtaaaaaacgtatcatttagcagtttgaaaagcgtgcacacagaaaacaaaaggagagtgttgggaacttgctcttgcaaacacaccactctgggaccgagggagtaagttcttggagattcgtcgaattaaatgacaagacagactggttggctgttggtcctctaattgtgcgcattgatctaatgtgtgcagtacttaatccacaaatgattgcatcagtacttccgagctggtttccttaattccaaaaccaaaagggaatcccaagcacaacttgctactttacatacatatgcttgctcaagaacatatttaaataattaagggcaaaagagaaaaaagacaaattgatcagctagctagagactagccagacaccaaattaaagatggctagaccgtgaactcagcgtcgtgaacctccggatgactcaacaaattcataccacctcaaattagagccgttggtgctgagccattatagcttagcgctaaggcccatggcgttgagtccacggcctatttttggtttaatttttttataggaactagtttcaaaataagtttttaaaaaggaccaatttattaaaaggacggctagttttgtggctaaatactttagtattgtggttctttatcaaaaagtcagtctattattttaatatttcctcttcacatggagagataaaactttgcaaaagacgattttacccttggttcatctagtatggtcaaatccaaacaaattttagttggttctaaatatttgcaaaatttaaaagctatctcaaattacggaaatcaaaactattctacaaaaaatgtcaaaactcaaaaataatatttcaaatttcttttttagaaaaattgaatgaatttgatttcagtaattctaggcaacttttgagttttgcaaaatatatttaaattataccaaaactgtgtttaaatttgaattaagctaggttagccgagagtaaaatcgtcttttttgtaaagttttatctctccatttgggggaatatattaaaataacggataaagtgtcttttggcaaagaaccataaatagatagatcgattggtagtaatacacacacacacaaaagaaattttgcatagcttatgctaactttcttctcaaattaaacttaatttgcaggttcctatatatagcaagctagtattctggttggatgcattgtacttattttgcaaagattaagggattgaattgagcatctatgtagcaggtggatcgcgctcctctgacgtaaagtcggagggacgtgggtcactgacgtgtgggcccaaccttttgggtcccacatgtcagtgacaaagtccctctgacttacgtcagaggagactcatccgtagcaggtgtacatacatatatacaggctgctactagtagtattacttttttttaatatatgacattattaatatttttattaacgtttgatcattcgtttattcaaaaaatttatgtaaatatataaaaaaatttaagtcatgcttaaagaatatttgtcattaattaagtcaaaataaaataaatgataattacataaatattttgtgtaatatgaatggttaaacgtatctcaaaaaatcaagaaaagattagcatatattgatctcttaattccaagcttccctctcacagttgtctgatcggatccaatccggaaaaccgtatgatcgattttggattcccttgttgccactctaccctagctactgtactttgctagctgtatagtacatattccaagcccttaaacatgcatgcacggttgatatatactttatgttaatccttctatgcaaaatgatcgacgacgaaaatactgtccaactgctaagtaaacacaatcactagctccatcttagaatatagcaatttagaatggaatgagacctattttagaacagaatctagacatgaggcatatatccagatttatttttctagaataaaatctattgtagattgctacattctaagatagaggtagtagcttacaactaaaaagcaaaatccaaaaggatttttgtaatgactggaatattacatctacatgaatgcttgtgtcatgacagcaaatgcttttgagcaaactagccaaattgctaggcggcaccaagacaagaacattactgtacagattaaggaacagcggaaaataagaaccctcaccacgacccaatattatctctccgtgtgaagtcttttattttttaaacatcttaagggctccttaatttggaacgcaggatctgaaaaaatgcataaaacatgcatgaaaaacacaatattatagaatgtcatgtatgggtaaatccaacatatgaaatcaaaacatagaaacttggatggttaataggaatataattacatgaatttaatggaattaagagagagaagatacattgaacttctaaaaggaaaaatcaagagaagaaattttaaaaataccgttgataaatgttctatttcaacgtttaccattgacggtagctacataagtaatagctaactcggcggagacacaatccctatcatgacattactattttttacagatcaaattaccatttgtgaccgttcaatttagactactaagcgtattattaccacgtattatgatcacagagataaattaaatactactacatagaagtttagaacaaacggtctaaataatactccctccgtttcacaatgtaagtcattctagtatttttcacatcatattgatgttaatgaatctagacatatatatatctctctagattcattaatatcagtatgaatatgagaaatgctagaatgacttacatctgaaacgagggagtatagtggaagaaagatttttagaaaacatatttagacatgcataaaacatgcaattaatttaatttaatacttcagttaattatgtctagcctaatatgtttgcaaattatgtctgaaccaaatgatctttctaccggccgccagcagagattgatcacaatcaagtgattctatatattatatatagctatgggtacgtcgtctgcgggtgcgtgtgtgatgtataaattgcatgtatatgggatgtctagtcgacacgtatgcaatctaagtacctgacctgtttatttcgtcgttacatgatactctagctaactagctagcaccatatatattaattacccctgtgtccttttaaatcaaaagatttatgcaaaacttcataagactttaaatcttaatggttttttttctatttggccctttgtgtatataaaggatacgactatatagaagcttttcaaatcttatgaaatttctatgtaatggtttattacatataaatttttgaggaaacttagcatgagcttcaatattttagacaattttctttgagcctatctctcttacccgattgctgtgtttttcccgcagtctaattcaaacggtcgatattaatttatgtgttttgtaatgctttgttttacacttgtatttatgttagaattatgtatttttttatattcttgtaattcaaagagccataagtgattttgtttatgtaactgggacggaggtagtacgtacatgtttgttgttagtttcacagttctgttcaagtgttcatcgatctatatatatctacagaggatggctagttatagccgcaatatgcaagcacgatcgatcgatcgacttgttgaacgcactgtgcgtactgttatgcatccatgcatgtggtagctgctgttgccgaaacaaacaaaaaattgcctgattaattaagaaattaataaccctcgcagctatgccaggagccaagtaatctgatcgattagctagtcgcagctttttgctagctgctatacctacctagctggctagcttaatttaggtttaacgtggaacatgcctatgattgtgcaaattccaacaaattgatttggattttgccaaatatccttctatttgagagatgattaatagatatgcggatcatatagtgtaattaaatatcatatatatctcacaaaaatacattttaatgccagaacaaaatactcataattaattagctatatatacgtgcgactgtgtacaaactttttaattgtacatacatttatacgctcgatcgatcgcagttgatccatgcatacagtagctgcgaccattcgctaatatgcaagtacatcgtgctaattaatccgacaagagatgtcatcgtcacctgttaattaattgttagactagctagtaattgcacacaagtgtgctgtgtcagtggtgacaacaacattagcagtccagtccgggctagtgggtgataattaatgatatgatcctatacatgcatatataaaaatgcacgcacttatatatacacacacacacagatacattcgtctcatattatagatcgatcgacgtactcttataaagcgagatagttatcagtggttaactaagagatcgaggctgaaaatgtaatataattttactatcttcaaatctctcaaaaattgaagagaacaaatattattagccagactggaaattgtaatatattaattactacattgcgccaacgaatagctaacaaattaacatacataataatagtagtatatatataaaaaaaagatgtagccttactttgtatatccattttggctaatatatatagctactagctagcttgtttgcatatatagatcagcttagatgcattacaattaattgtatgcataaatggtaatatcgttccaactaaatagctgacatcagcatggtattaaatttggtacctacggagtagtatcatgtttgataccagagacactagccaattaatcccgtgtggttccggtgcaccgcggcttctgagaggagctcggggaggcatgtgtggctgctgttgtggtgccgacggcgaggggcaagttcttgtcgtctccggtgcacgggcacgacaacgaagctcgtgctcctgtgggtgccagaaccgccgagcaaggtgttcgttgcggccacctcgatcgccaatatcaacaagcagctcatcttctccatcgcgtgccaaggttgaagcgcctcgatcggtaggtggatcgctcgctgctgaaggaggatatgatggttgtgacaggccggcatgctggcggccggcaccgacgacgctggtggccacgaaggtagatgtcgactgagcaggctccttgccatcgcccttctccaataagcggcacacctgcctagtccctccttcctatccatgtctaccttacacattgtgtgctccggccagctcgtgagccagaacgagctggctggagctttgcttccgagccgagccgaactccactttttgctcatttagataacgagccgagtcaagccagctcgttatctaaatgagctggagcgacatatacccctatctgtatactgaaggtatcatatccgatacttagggtatcatactgacatcatcatgatacctaaatactagatttgatacttgtggggtatcatgtttggtaccagaggtatatataccagatctgatacctatttggtatcgtgctgacatcatacgttattctattgaaacggtataccactacgtagtctcactcaataatatactatatatgtacgggtaggatggaaggtacaatgcaatctttgcgtaagagaagaagagcgatttggtgggtagctagttatctatctatctcatgctgttttgtcttgattgctggaccacatgcatcaacatgatgtggcctggctctggctgtaatagttctatggaagagagagccagagccagcagcatcagcatgcatgatcaaggagagagagagagagagagagagatgcatgaagacgtactagctagctgtgtgtcgtcttctagctcgatcgtgttcgctgattctagattaggatgttaattgcgtggttgacatgcgtactgccaaaaccatccatcggtacgccagattaattaacaatctctaattccaagatcgatctacgctgtagcatgcagtacattttatatatgtatagttaacttattatatctgacatatatttgtttgggagccaacagacaaaatacatgaaagacaaattagttgaggctagctagctgcgctgctgcctagctctatgtaatggatcgatcgatcatatggcaccagctagcagctatcttcgtcctcattaagtttaaaccaactgcttgatatatatgcatgcatggagcgtagatatatatatatatatatatatatataaaagctgttgcgatggttgagacgattcaaacacacacagaaaaagcaaaaaagtatcgagcaataatccatatatgagtaaatatttaaaataaatccagcgtagatgctaagggaactcgagtcctcctatcccgctagatcaccatttaattaaggaggaagggagggtagaagaagcgggagaagaggaagagtaggaagggtagaaagaaaaataagagttcccctctaatttaattctggatatgctccttaatgcaacaaaagaataatattctctagagatagaaggccaaattattaatagagagaatcccttatataccactctaaattaaccggttcccttatatgccacttcaaattggcttctctcttctatgccaccagttcaagtttgttatcccttttatgccattgccgtcactccaccgtcagttgaccgttaacttcatagtaaaaagacgcatttgcccttgagagttggtatacaaccaatgataggtattttaatactaatatagctactggatacaacatatgaaaattgattcttttttgcattatatgcaattttagccatcaccatcacaaataaattttcaatataagcatgaaacatacagtttccaacaatatttttaatacaaagagcattattcattggtttggacaaaattttgttcactcaaaacggatttaaaataaaatagttatgattttttgaagtttacacatttttttagttgagagggcatattggtcatttacgaaaaaaactaacatgcgactaacagtcaactaatgctgcagtgctgaggatggcataaaagggtagaaaaacttaaccagtgatatataagggagaagccaattttaattggcgtgtaagggaactggtcaatttctagtagcatataagagattctctcttattaatatgacagttctcagcttgtgtatggcctctcaaaggccatgcttttatatattttcaccctatcaaaactcttttcatattagactacctcagtttatggtcaattatatagatcctattcgaagccaaccctcaatccatttttttcgcaaatttgtgtgaagctggatttaaaatatataattcttgaattaaatataaacaactctcttatttctattagcctgttataatttatatacaactatatctattaatttataatctagaccaaccacaatctaggaatgtaaatctttctgtttttcttattaatgtagtaataatttctaggtttttgtgaacgcgcaataatttctaggtctctctagagtaacatgaccttattgcggagttgtttgtccagtcatcaatctggtggtggcacaggcgctggggtgttttgtagtttctacttgagtaaattgcataaacgtgaatttcacgttttaaaaatcaaacatgtgaagtggttgtctaaatctcgacatagcgtcatgtcgcagtacaacaacacttctgcaacgccagccaaagaaaaaaaaacttgcatttagataacccttgcatgtccaagataaaattggcccaagtgaaaaactcagaactacataaataattttcgcaaatggccaaaactcatttttggatgtggtattttgacgtgtgggcatcacaggtgcacgtgaaaacccattttcacatatggatctgttgaggaggctgcttgcaaaactgatttttgcaggcaggcaagtaaggactttcgactagaacgatttttttttttaaaaaaaagaataaacactacagatccaagaccctatagctagggtaagccgcatgtggccgcggccgtgtggtccgttggctgggtacaaagagcagagtgggctaagcaaataccgggttgtggcaccatccctttcacattcactcgctcttgatatctttctctctcatggaaaagaagagataagtaattttaattgatgccgggatagagagagagagagagttaagaaggtagctaggggagagagcgaggttgatgccgtgatcgatcgatcgatctgttggcgcagcgtgtatataagggcgggaaggggagtgagagagagcagcagctagctagccgcggtcggtcgatccagctgctggggatgagtacttagttagctcggagctagctactaatggatgatatacttatgctagttagttaaatacagttattagttagttgtaggttgcatctatcatatctccatcggttaattaattgattgatagctagattatcaacaattaatgagcatggtggtgcagcaggagcaggaggtggtgttcgacgcggcggtgctgagcgggcagacggagatcccgtcgcagttcatatggccggcggaggagagccccgggtcggtggcggtggaggagctggaggtggcgctgatcgacgtgggggcgggggcggagaggtcgtcggtggtccggcaggtgggggaggcgtgcgagaggcacggcttcttcctggtggttaaccacggcatcgaggcggcgctgctggaggaggcgcaccggtgcatggacgccttcttcacgctgccgctgggggagaagcagcgggcgcagcggcgcgcgggggagagctgcggctacgccagcagcttcacggggcgcttcgcgtccaagctgccgtggaaggagacgctgtcgttccggtactcatcggctggagatgaagagggcgaggagggcgtgggtgagtacctggtgcggaagctcggggcggagcacgggcggcggctgggcgaggtgtactcgcgctactgccacgagatgagccgcctgtcgctggagctgatggaggtgctcggggagagcctgggcatcgtcggagaccggcgccactacttccggcgattcttccagcgcaacgactccatcatgcgcctcaacta

SEQ ID NO: 55770 - DNA, 6565 bp, Oryza sativa
  unsure (1)..(6565): unsure at all n locations
ttcagttcctagctactcctacatgcatgctttgcttaattagatctatctatctaatctatcccggccggcctgttttaattccatatatcatttggtttgcacgtacccatctatgatctatatatacatgcatgtcgactattgttggtcgtacgatattatattatatatagatgtaatacatatgttganaatatattgatttcttcttgctgtaggagtaattaattactccagttgttgctgtcactcgatcaatccatgggatatgggatcgatcggacgatatgcaggaagctcaaggacgatatgaatgatgcatgcatgtgtaaatgtgttgttgtgtttggtttctcttttgtcgtttcccctgcccgtccgttcgtccctcagctttttacctatatactatagctacctacacaaacaaacaaacaaagaaagagagacatatgaatcgattactagtaacatcgatctatcaatggttgcttcaatttctacttctcaaaagaaaatggctggctaaaccttgggtggggcgggtgacgccatgtgatgaagtagataggaacctcttcgccgcctcaacaaacataacaatatgggacggaaacacggtgcgatcttgggagtccgcgtggattggtgggcgaagacccaaagacctcatgccgcttgtctatgcgatctcaaaaaacagaggaaaatcccttcggcaaggaaaggaggaggacgcctgggtgcaagatttgaagcttgattcacaatcatctatcacagtcgacctcgtcgaacagctagtcgcactgtgggaagcggtccgaaatgtgcacttagacgttggagaaccggatcagattatttggaagttcacaaacaacgggcattacacggcctcctcggcttaccatgtgcagtgctgcgggacgccgagtacaaacttcaattccttgatttggaaagcctgggcgccggggaaatgcaaatttcatgcttggctcatcattcagaacagagtctggacttcagaccggcttgcgaccaggggatggcagaacaatggttgttgcgctctttgccgccgcgagactgagacggcattgcacctcgttgccacttgtagatacaccaagaggatctggcacctcatctctgcatgggtgggctatcagcagatggacccaacggaatgggaggaagcccagtcagtcaaacagtggtgggagaacattgcaaacacgcctagtgtcccgaaaaaaggacttcgatcgctcattctgttagtcgtctaggaaattggaaagagaggaatcggcggatttttgatcacaaagaggtggcaacgaacttcctactaatgaaaatcaaagaggaggcgagcctttgggctttagcaggagctaagcggctgcgtgagttaataatcccgcactctgtatagtgtacagctatagtggttctccgttttccttttacgtctaggggtttgtattttctcttgctctattcaatgaaaaggcactctagtgctgctttccgttcaaaaaaaaaaagaaaatggctggctagctgctgacctatatatactgtatgtatgctcgatgcttctcctttcagacaggcaaaggacataggtacatactgtacgtatatactctacagatagtatttattatgtagtactgtagatcagacgacggcggcagcaggacgtacaaaacaaactggtgactagtctcctccagctacctatagctccattgcatcacgtgctaacgctaattaatgctaatgctaatgcaattctctctgctgcactgtgtgtgctactgtacgttactgaccaatctctatagctagcttttcatgcttgcgcctcagtggttacggatagagatctggccgggagagatcgatcagctcagcttaatactagtactgaaagaaatatcagatatcaacttcaagggattgattataatatactagcatcaaaagtaaattaattaagcaaatataattaatactactccctctgtcctaaaatataacaacttctagcctttaaaatttattccaaaatataacaacttcttctcaactaatcaaaatcctctaccattcaattttcccacctaccttcacttatcctaccatttaatcttaccaactttcttaataaccggaccatctctaaaaatacttatattctggaatgaagggatatgaatacatatatagagcaaatattaagatgccgatcaagatgcttagctagctagtaatgtcttggataattacatggtctctaaaatatatttttattattatactaatttataagaaaaatatatatattattttagtattttttaaaaaaaattaaatattttaaagctgttaaccattaaatttataaaagtttaactttaaatttatctaaaatgtcaagaattatgaaacgaaagaaaatacaatgcaattagaaaagaacatgggaagggatgggcatcggcatggccggattagatatagtatcaccattttaagatgatcagtatacatgactagtcgtatatactacactatgcatatgccatgctacatgtatgctgctacctccgtcccaaaatgtaagcatttttagctatgaatcattttaggacggagggagtagctagctaggaaacgatcgatcggcatttcagctatactacagtacttacatcagatcgtttcctagctatcagatcagggtcgggtcgatcagagtgatgaaaatcaatcgatatatattgatcgaggccgcttgctgtcgcctatcgacctactagtataacaacgacattttctctaaaaaaaaaaagaaaaacaacaagtacctagaaacactccacttagacacaacggcttggctatttcttaggcaaatctcaatcatctgatcgcgttcgttggatttcaatccaatgcgcttctctccatgtatatattcaacctctgcatgctcttaatctctccactcaactaaactctcagttaattactaattatcctcttctccaccaacagagtacgtttaccacaatactcctcgaaacagactttcagccccatcgttttccttgtacttatacttatccattagtactacttgttaacaaccaaaaaaaaagtcacgagtaaaacttttatgtgtgtgtatccttagcgatttaaaagcaaatgcggtagaataaattatgatgaaaaaaactaaaaaagtaagttttgaaattaaattttggcatataggcattagcataagtgaaacgatagggttgtttgttcttttttttggggaaaaggatttcatcattcatgaaccttagagcataaccaacatatgcccagtagggctttctaatcttaaaattttggttttctttaaagctggttccaattgaaccacttgcattatatccatcagcattcattttggtgcatccttggttaggacagcttcatcttttgtccattttgtcatttatcatcacgtgaattattgcatatagctagacagttctagtatcacccggaaagattgaccattgaagacacacttccatcctcatttgtggccataagttcagcttctagagcatatgaacagacctctagtgatctataggcagctcatatgaccggccattactatcccaaataaccatttgcattacaacattcagttaatttgttccatcctatgttaggatagcttcgtcttttcatgccaagatccttcttcgatcagcttcccacttatcaaatgcaaatcttctccatgatagtagttgactactttcttaattagcgtgtttacatatccgtcactaagatgttttgcacaactagccaacatatacttacatgtgcataatgcacacacatgtactagtataatatcatagaagatagactcattttacgtccttcgttataagttattatatatatatatatatatatatatatatatatatatatatatatatatatccttcagtattggtagtaataatgatcgagtagcgagcattgtaaagagagtctattaactaacacaacattatctttttacgagttactcatatgtggatccattatgttatagcctctcaaagtttctcaagcattggaacagctaatcatagtttgtcgcgacttgggcatagtatagggagggcagccagctgcaggaaggatcaagagagaaggcaggccaactggaactgtgggcgattccttggtgccgctagccgccgcgccgcctgctttattttgtcgattgtcgatcagtctgcccacaaacgtcacccatgtactgtccatctactgtacgtactgtactgctacaatcaccgttactcagtggttctacgtactactagtactatacacacgcgtgacacgttcctttgcatataggagtactactgtacacaaattcttactgaaattaatagtacagtgtgtgttcctttgcatatattccctccctcccccataaaaaaacatatttttgagtttatatgttcaacatttgaccatccatcttataaaaaaattttaaaaataaattatacataaagtattatttatgttttatcatctactacctccgttccaaaataagtgcagccatatgcatgctcagcgttttgaccatccgtcttatttgaaaaatttatgaaaaatattaaaaaaattagtcacacataaagtacaattcatgttttatcatctaataacaataaaaatactaatcataatcttttttcaaataagacgaacggtcaaacgttggacatgaacagtgctaaaactgcacttattttgggatgaagggagtaataacaataaaaatattaatcataaataattaaataaaaacaaagagtatcaaaaactgaaaaaaaatgtacttttcatgggacagaggggagtacgttattgaattccttattaatttgtactgtactactgtggatgccacatcagccatccagcaagaataacctgcagccacacgtaccaatcacactccaccctgcaacctgtgtttcatgctactatacagtagtgctgtcagatattctcttgtcaagtgtaccatgcacctatgcatgcacgcttctttcttgcagccgaatcgtacgagtacaacctaatttagttttgtttttcgtcactcagctggatagcaaagaatagaactgtaaaaacttctaaggcatcgttcgtttaggggtgataggggagattggttctcgttttccgcgcgcacgcttttcaaactactaaacggtgcgttttttgcaaaaaatttcaatagaaaagttgctttaaaaaatcatattaatccatttttagaatttaaaatagttaatactcaattaatcatgagctaatggctcacctcgttttgcgtatcttcccaatctcctcaatccccttctcctcaaacactccctaagcgatcattgcttggcagcttgggtgaaatcaggttctaggaaaacacgttttagattatttttttccaacttccaataaggttaaatcgctaaggtagcttaatttgctcaatggatggacggaaggatcggtcctgcatgcatccatgcgtggtgaggtttggtggggaaatctgatctgatcgacgatcgagtagatggatttggacatgcatgcatatatacagcaaattaaggaccacaaaacctaatcgatatcagttagttttatactagctatatcgaacaaatgcccatcagctttgcattgtccacaccaggccatgcacatatatctgtggtccctcccggccgcccccgccccgcgaatgcaatctaatcaaatactattgtaatctaatctaaatttatcagtatgtgcacccatgcagcagatagctgcccggccggcctccatccatcaatcctttctcaaacctgcacgcgtggatcgaacactccttttattttgtttgcctgacccggcccatatatctctctctagctataacgtacggtacgtactaatagtcaaaagtaattaagatcatgaccaacagtttccccccccccccttccaataccaaagttttaagcttttaagtaacggaattgctacacttcagttgacaaaaaacctacctccaaatcttgcaaattttggttcactggatgtgcttcacgattcgtactccagctgcttcttctccaactccgacgaactcctcttcttctccggcgccggcgacaacccaaactccggcgaagagccgacgaattagggtcctggagtggggtggggtgggaagggtgggagggggagggggaagaagggggagttcgccgggcttagagggatgactgggtgaggcggcagcccggcgatgggcggcgaggcgtcggagccgcggggctggaggatggcggtgggccggcgttggtggcgagggcatctcgccgcagacggctcgaggaggaaggaggggggagggggagggggagga

SEQ ID NO: 55771 - DNA, 3062 bp, Oryza sativa
  unsure (1)..(3062): unsure at all n locations
agggggaaaaagggggagttccccgggcttagagggatgactgggtaagccgccagcccggcgatgggcggcgaggcgtcggacccgcgggactgcagcaccccgccgccccccgttgccggngagggcatctnncgcnacacccgtcccgcgcgagcgacccgccaccgccaccgcaccagcgcgccgccgccggcctcgccggtgccgttgacgccctccggccagccggcgaggcgggcggcggcgcggtggggcggtgacggcgggggatcgcacgcgagagacgggagtagcggtggcggcgcaatctggatgggggaggaggagaggagttagggttaagggtctgcatgaatcttgaagcatatccaatggtccaaaatttgaaagataggaggtgggattttctgtcaacagatgtgtagacagtcccagtaagtaaatattaggctctaatagtaccccttctcttcctactttaaaatatgtattcccttctccgtcattctcactctccacgagtcggaaatcattctcgccgactctagcacaagagaaatggcgaacaggatggtggcaccaaatcgtgtgatcttctagcttaggtacggatggagggagtccgacttctattgctatagctaggactcacgttttatagtatggacctaaaaactaggtcctgatctttcaatagatattgataactctcaatttgatagaaacttgacacatacgatcccgttttcgatcaacacgatccgaaccttgcaatcacagcaccacgtctcctctggttatcaaccatgcgctgttcggttgacctcgctgagaaggctaatccctacgggtgtttcacctaggcctctgaactctcaaaatgtatttttgggtccctcaacttgtctcgagtgtcatatatatccaaacaggcttcaacccgctccatgtgctgacgtggtatgccatggtggcgcgtacgtcagtagaacccatatatcagtcacatatagaaaaaatcaagaacatatttttctcctctatttttttatttttttaaaaaaaataaaaaaaatccctttctcttctctttataaattttatttttttttctatatggctggcatatggatcccactaacacgagcgtcactgtgacatgccacgtcatctcacaaagcgggttggagcccgtttggacatatatgacacttatgacaagtttgagaacccaaaaatatatttcgagagtttattagggatctagatgacacatccgtatacaagtttaagaaccgtacgtgtacttcactactcttaatgtttatgatatagctactactgtctgcttccaccaatcaccgcgtctatttttttaccaatcttacttctaatcacccctccttgctcccactgatccccaaccatttctcatgcattcaaggaacaatgatgcatatgtgtagagatgcatctattctcgaaataatttagagctatatatgtcgatagggacaagataaattgatgatttgccattttttggatatatcttagtgtttatatgcatgtgttgtgttaattacaaaggttctatgagttgataaactagcgtgtaggttgtacttgtttgagtttgaccgctgagctcaaacagaattaagatgcatacatgatgggcatgcatcaattagctaggttattgctttgaaaagtaagttagactttggtaggaacgtactgggtgggtatatatatatgcaataattcgaaacacggatgctacttccactaattgaagaatgaatcagtaggcgcgtcttcacacacttgcttcaatcggtcggatatatataggcatgttattatgattttatcctggttttcgttagcacattcaaattattaaatagaataaaatctttctatataaaagttatttaaaaatatcatataaatatcatatatatcgtttgtgcttgtctactcccctcccatctcctctgtcacatatggctagagggaaggagcccgacggtggaaagggtggcggagacggcggctggcagcggaaggtgtggcagctacggtttcggccggcctcctccactcccctatctcccttccctctcctagatctggccggatgggatgaggtcagcggcaactgctggggcttcggtcgggcctatccactcccctcactctcccaaatctggtcgaaagggaggaggtcggcggtagcaaaggggtgatggcggcggcaacaggggcttcaaagggctccttcattccactccactcccctccctttcccagactagctctccctctaccagatctagctagaggggaggaggacgattgtagctgcggccggcagtgacaagggaagaggagcaaatggcggcagcgcagtggagaatgatgacctagacgacgacaacgacgatggcctcgatagtgcgcaacggcgacggcaaggctcctggatctagtccatcgcggtcgcttgattgtagttgttgcttcttctttttcttgtgaatttttgttggatttgtaaatacaaaatattttggagtagcttgatttgcaaatctgatgaaacgttcttcccattttctctttgatttgtggattgttctatgaaaattgatgtggcaatgggcagacaaagggcaattgtatgcccccccccccatgagccaagtggggaaattgatttctacaggcaaccgaaaccatcctctagaaatacccgatttttgtatgtcttaattcgcaaacaatgtatggccgaccgtgtgcgaaaacctgttttgttcgcatacgaaaaccttttctctcatagtgatttctacagccggctaaaatggcatgtgtccatgcgtataacatttttttcctactgtccaagaatatataattaggagaaacgtacttaacagctagctagcattgtttcatgcatatattagttgaagaaaaaaaattgcatgcgtgcgtgcatatagggatcgaaattagccagtgtcaaattaacatacatgaccgat

SEQ ID NO: 55772 - DNA, 2121 bp, Oryza sativa
aattcaacttagtagctagccaagactacctccggctcaaaatatttatatttctaaaaaagagacatattagctgtacaaacaaattaccataataatcctaaaaatatagaataaagtaaatattgagacaaatggagatggaaatataggagggggtagaaggtaggatatttctaattgggtactacctccgtccttcccagaatataacaatttttggctaaatgcttatattttgggacggagggagtaggttttatcttattacaaatacaattattttaggagaaaatttaaaaagtagaaatacaattattatactccctacattctaaaatataagggattctggagggatgttatattatgcgacagagggagtaagaagcagtagtcttctttatagtgaagcttaattaggaacatacatacatatatatatactagcaaaatgcccgtgcgttacaccgggtattagcggggtgtttgaagtttgatattaatgatttaccaaaacaccatagtatgattattagcatcggttatatgtacagtgataaaaatgatgcccgtgcgttgcaacgagtgaagataattttaatcatgtatagtgttggacaaaaatgataaaggaatcgtaatcataataataataatgaaatgaaattgcagtgacatttggaaaaaggataaaaatatataattaattttccgttaattccattagctaaaaataatttaatatgaagtaggaaaagttattctcaaattttagcaattttcaaaaagcttaaatagagcaaactaattttgtaaatgaaaaaaaatttaatcgcctaaataaaacaattagacctgtaattgaaaatctgttggccatctcgtttaaacatgagcctgcgggtgcgtgtggtcacttgtacgtcgtggtcttttttttgacatagaaaaaatgtccgtgcattgcaacgagtaaactgatattataacaaatataaaaatattatatgattaaggtttagctttacatgatatgagctctttaagaaaatatattcataatgaaataaaaaaggttcaactgaagggacctaaagtgaacttattccatacggagcatacacgcggtccatgaggcggcccaaaagtgtgggtggcctgggaacaaaatcagggacaacttaagggacctaaagtgaacttattccatattggcggcctgggaatggcgttcggcccgacgcgggagatgttggagccgtccgatctgatggacgatcctgattgatcccgacttatataaaagttcaactgcccaaaccctaaccataaaatcatttcccctcccccctctctctctcaaaacaatggtggcggcaacgcctctctccctccatcattcctcctttcccaaccccatcggcggcacctctcccccctcccctcccccacacaggcggcacgctcccccttcctctcatcccaccggcggcaccgctctatctcccccacttcccttctggaggcggcaggcaggggcggcgccttcccctccgtcggatctagcgggaggggaggcggcggcagcccgacgtccctgcgacgacggctctccttccgcgggcagtggttcctctccgccctcacctcctctccctcgccatggggccgcatgagggttcgacggtggcgggcagcaccctccactccgtcggatctaggaggggaggcggtggcggcccggcggccccctccaccggatccagtgggaggggagcagccggcagcaacggagacaccctcccattctggcgtgttttcttagtgttcttgaatctgatattgtgttattgtagtagtgttttctctagtatttaggtccaaatttgacaacggacgaaaactctaacccggaagctttacaaattttttaattattagaaataggtatatagatagattgaatcggactttctttttttcatgtttttttcaccctgatttcgctattacggacgacggaaacatttttaattttttaagtagtagagatagaaatagagtagtatttaacatgatattgaaaacattcattgctagtaaaatgccagtatacta

SEQ ID NO: 55773 - DNA, 816 bp, Oryza sativa
tttttgacaaattgacccctttcaaaaacttaattcgaaactaacccctgccaaaaacttcaaccaaaactagcccgtcggctcagcgccaagcgcattggcgctgaggttgcccgtgtcagcgctaacgggactggcgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccacctagggttcggtcgccaccgcgttctcctcgcccaatctcccccaaaaacctctctaatcgaaggtgatttgtgcggcattgagtttggaatcggaagagaaggtaaacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttattta

SEQ ID NO: 55774 - DNA, 892 bp, Oryza sativa
tggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagagggcggcaccctccgcaacgccctacaggtaatcgttggaaagagatgaaactacggtgttttcttccaaaagcgataacttaacatggattattttttatgcagagactacggcagcgatgtcggaagttggcagcaaggctcggctgcaggtcgactgatgtggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatggatgtatggactggatgtatagacgaggatcgatgggatgtttttatttcttatatatatggacttcatatatggatgtattgatggattctatggatgtatggaatgatgttgggattgatggatggatgtatgttttgtatggttctctggatatattactgcctgtaaatttctgtgatttgatgtttgcctgtgttgtgtgcaaagttttgctaaagtt

SEQ ID NO: 55775 - DNA, 1973 bp, Oryza sativa
cggcgggagagccacggttggagcaaagcgaggcggaagacgggcgaccgaggcaggtgggcggggagcgaagcgacgacttcctcccctcccacacgcatcccgtcatctcccttgatcccctcttgcgtggatcctcccctcttgcgcggatcctccaccagtgactggatcttgtcctctctctggccgctagcggcggccgcggccttccccaccgtgagcagccacggcggctccctccactacttccgatgggtggatccggcggtggcggtggcggcggccgagggcggatccggcggcagtcggtggtggtggcgtcggtgacggccgcggcctctcttctgccttcggtggcggtggtggcgttgggtggatccggcggcagcggtggcagcggcgagtggatccggcggcgatggcggcagccgagggcgattcggcagcagtcggtggtggtggcgtcagtgatggccgtaggtggatccggcggcggtggcggcggccgagggtggatccggtcgccttttttttcgcccgaatttgtttctttttcgtgaattggacattgggatcaagttcatgagctttactcggattaaaattgctcttttatgttgtttttggttgtctcattgtttgattcatttggggatcaagatgggggattttttttttaaagaatcggactcgaatcctatgagtgtttttggttgtctcattgtttgatttatttggggatcaagatgggggattttttttttttgagggaatcggactcgactcctatgagggacgacagacgaaacggatggtatttttgaacaaaaatcacgggtgaaaaggaggtgatgattggaaaaataggaatcttttaattagttaagatataatttgagttgttttgttgataggtgtaggtataaatcgaattcttataactaggtatatgctcataatttgaaaatttaaaaaaaaaattgagtgattttgtgcatttgataccatggtgcccgggcaccatggtgtcccatatgagtgtcatatatatatatatatatatatatatatatatatatatatatatatatatatatatatatatatatatatagagagagagagagagagagagagagagatgtgatgcgtgcggtgcatccgaaccagcaaactcacgagtgcctgtttcatttcgatcgaccggccggatatatatacatatattcgataatgacgactggcgagatgatcaggagtgcacatatccaccaacctaatttggcatccatcgaatcgtatcggtggttggaatcagatttatttattatggtactagttagatgcccgtgcgttgcaacgggaaataaaatcatcaactttaactcatactactactactcataatttctaaagaatatatttcacccttgtaggtccatgtacaccagctatcttctgacccactaatatcatgatttccattttgaaagaaaaaaatagataggatgcaatataattcagatatgtggattcagaaagattttcactcaatgtcaggcgcaattaagttacaacagaaaactgagaccagaaccggctagattcaggcttggtttagttcccaattttttcttcaaactttcaacttttccatcacatcaaagttttcttacacacacaaacttccaacttttccatcacatcgttccaatttcaatcaaacttctaattttggtgtggactaaacacaccctcagcaactttttactccatcacatcgttccaatttcaatcaaacttctaattttggcgttaactaaacacaccctcagcaactttttactccaattaaaatacaaccttggcaccaggctactggaaggcaccgccttcctcatggccacgtcgtttcttgcatatttctttgctgcacatatttgtccacacaagacataccaaaataaaat

SEQ ID NO: 55776 - DNA, 1087 bp, Oryza sativa
taacatggtacaaactgcctacatgtcggctaatccagaaggaagtaccagttccaaagagcattaaagaaagtttactacttatttttgcattgatagaatgagacatgaggtgcaggaaatatgcttatcaatatttggttgggggctgggtaggtcgagttcgggcgtgcctccatatcaatatgcttatccaggcgacgaacagattacaagataatccctctaacatgttataaagaaggatacatatttacacctattgggtcgagttgggtgaaagaaaaaagaatgttctaaccgagaaacctatgcatacagatgcgccgttgcatacctcttgtaagaaactgtctgcagcctcatcctctaattaagcaaggtagcaggctagcagccaaacagaaacctcttctgtatctgaaagtgtaaattgaatgataagccacgtgatgagtagcacacatattgtttagatcttttcgttttggcacagaggcagcaaacgtgggcgccatccgtaaccttattatcaccaggattagccctgtcctacagagcaagattaaaaaatatggtgggtggttgtatgcactccgatgaaaagcatgaacctatttgttgagctaggaagactctcacttgttaggcagctcaaggatgtacgctggttttctagcagcttcaagcctccaactgtgtctctgttcagcagtgaggatcccgaattcagcagtgacgataacatgaacacatcatgtagaactttatggatagtaagttaaaagaccataagcttgttaactggcagtgataaatgaattttgtttgtggagacgcttttttaataccttttcatgcaagaattactgagagtttttgtccttcagcatatgcatttttttggattggttttgaaaattatacttcatcctttagcatattactttcagtttttcagtttgcagactactgagagtttgtgtccttcaatatatgcaatgaagtaataagaatttatctttggttcctttaatagtactttcagtttgcacagttttggaagaagagttctcatagtgtgaaa

SEQ ID NO: 55777 - DNA, 1460 bp, Oryza sativa
agagcacacgcattttctggctgcttgcaagtcaaaacggagtgaaagaagatgggccggatagctatctatacaggccgcgcgcgtacgtttttgggctgacagggccggcctgcttcgtctttttgtgaacatagctatgctgctgcttctttttcctttttctttttttgagaactaacattagctatgctagctccaccaacctttccctcaaagaagagacaaaacagtttctatctccaacacacatatgtgtgtagtatttcagttgagtcagatatcagtaaacatgtatgtactacattttatatactgtacacaacagcgcttaatagttagtagtatagaagtcgatctacatttcttactgtagtatatatacactctgcatgcaatttgtgaacacccatccgttacaataattccattttatttgttgtttcctacctgatcacctccttgtttgcatctctccatctggcatcgtaccttgaagaattcaccattcatttcattgcgatggttctggaagggtgatgagccgagatttcgagtcatataccatctccgtgctacaactgcaaaacaaagagttgcacattttcagattgacacaaattgtagtattatatttgtaactcgaacagtactatattatacacaatcaacaatgatggaatatgtacatataaaagtataggagaatataatacatactctgcacatttcactttgtttgtttcaccgccactagacactgacaggatagtcccgaagaaggaaaggttttcagcgccacaattcggacatggcccctggattgcccagagaataatcatcacttcacttgaacaaataatcatatttgatgtctaatgtctaatgcaaaaaagcagacaagcagagaggagactaaaaataataccttgaggattaagaagtcgttcactatggcattagttatcgactgtgctatgaacaatattagaggcaaagcagcaaaccatgtgaaaatgaaaccgaaaggctctggcagctgcatttgttcataaagattaccgagtggggaaaaacatgtcaaatagtcagtcgaataattaattggaagaaaggaaaaagaatttacctggaatatgttgatctcaaagccagtcaactcatcgatgaagaagaacctaaatgcatgcaaatcgaaattagaggtgacaaacataagtaaagtctgataaaggatgaattcgtcgcaaccagttcaaatcccaccaggacaatggacagtaaaaggtatactgacagtccaatatttatttcatactagctaggtatattggaaggaagcaagagtgagatgaaaagaactcacagtcctagagcaagagtagttgctggaacatttagcaggaacatctttaggtagtcaacggtcaaatcactgtacacctgcgccaggtagcata

SEQ ID NO: 55778 - DNA, 3599 bp, Oryza sativa
  unsure (1)..(3599): unsure at all n locations
gcttcgagcaggcgttgttcgtcagggcctgaaaagatattagtgttaattagtgggcaaagaagatactaacagataggtatccgcagaagagatggaaggagtagtacttacttagcatgacaacgctgctgccttcccacatgagctcctccttgaggttgtcgaactcctcgttggacatgatggccttctggtcgtagtagaaggcctgaagagcctgaaggaactcctgctccatctcacccagcgacctcttctcggccttcttccccttcccgtcgatgctgcagtactggagcacgttgctgtccacaacctcatcaccatcttgtttgccttgctgctgctgctgatcggtggcgccaaggcggaggcgccgcccacgcgtggaggttgcgagtgcacaggaggagcggcgaggcaggcgggggagcccggaagcggagaagaaggcggcggtggaggagcggggagggtggaagaggcgggaagccggcgacagccacgcctcggaggccatcagcattaactcttctcttctcttctctttgatccaaccgaggagctagggaagcagcacagccagcagtggcagaagcgagagagagagatgtgcaaatggccgcagcagcagcagcatcaggtaaacaaacgaacaaacaggaaaacattttgtgtggacgaggacgaagatggagctagggaaatcctttgcttcgctcacattcagagatagatttcctccctcccatctcaaaaaaagagagagatttcttcttacacctctcctctccacaccctttggacctactagctctccatttggctccttctcagatttttcttcccctcctccttccctttctcatacttacttctgggctaagcccaatttcacatggcacaaactatagcccacacaaatttcccataccaactccaaattggatcggcctgtctcaatcaggcctaagggcaaaaaatatatagagaaaattcatttgcctcgctctttgagggtgaaattacattcgtttcctaggattttttttttttggtaccatcctgacactcaactgactagggacaaaatgttcctctactcaaggtggtgtgcttgtaatggtccccagttattattatttggtatcttcctttgtatgatccacataaaattcatattatttttctccatataaaatcgaatatttttttctgcatcttagtatgccctcgagattgaacgttctcttttgactcatattagtaatacggccggagtatatatatttaactcaagcgcaagtttacagtggctgggtactatgccgaaaaatatatgcagctccacatcaatccaagcaaaacactagttttatacctaaagtagcatgatatagtttctctctctcaaccgcttctttaatttcaatgtatgttagcatatatagcttactcgctatgtattgagtgcatatattcacagatgtatcagtttttgctgttcatgtaatgttgttagagttacgcaccagcatgaaccagcactgatgcattgtacacttgagccaactcctaatttggacgtgccaaatggtaacaattaatgttgaagagcacaaaatacactgagactaggatttttatatatgtaatgagagggagaaaatcgtgtatagtgtatggaactgatctatcacctgtctgggaaagaatttgtgaatgtttagtctgctttactttacacaaagtgaatcttctaacagcatcacgtcaaaatgcttgtgttgtgtgtgtgttggtatatgattatgtgcaaaggcctaccagtttcttcttcagctcctctgtctggcatgatcatacatgtgccggttcccgtcagagaaatatgaagcagcatgccaacataatttgcagccaccatgatataggggattgagaatgtgcatgccctaccaccccaggggaaaataaaatggagaaataaatacggtgctgaatgaattaccatacaataaattgtaccagacttaatgcggttttatactttctgcatattatcatgtctccactgtatgttaagacctgaaagttgtagtaaaagttttgcaacatcttgagaaccattggtcatttggcattcaatttcactccacatcttagattattttccttcgtatttgtccttgccgatttgctatgcacaatcattttgatgctatcattctcaaacacaaacacaagaaaggggacactacactttccatcatgaaaagtgtaacacactaatggtcatccgtactcattgaatatgatgaagttgtactgggctaaattggaaaatttaattataccaagccaattcaataatcataagaatgagtggtccatgaaactaaataagaaaagtagaacataaggtgcgtagtctcttagctatttatctgataaaagaaaaacaacacagagaggactagagcgtggaagtaccatagttcaaataggcttgagccaacatatgtccaagctggacttgcgcttgggtgctaaggtgcagatggccatcttctagtggcaaaccctttgcatcaacaaatctcacgtttcgaagtttgatccctttctgagcttcccttactacttcagtatattgcccaagccctgatgctagtcctacctgaaacaccaaacagaggaatggggattgcctactgtattatgtgatatagcagcgaagagtctaatttacaagcgatttgacgaataccacaaatagttttgtcttgcattgcctgngtggtttgaatgaggagaagatatgcaatggtccatagtaagatgacagtagttgtgcatgtagaccttggacatatatatgcctattctatacagatatatatagggattgtgtgcatatcatgcatgattgagctgaggtggcggtgggttggcaacatataatgcataccatcatctcagactttgaaaaccaacaaatctaaagtaagatggaatgccttaaactacaatggaatttattttggcatgtctacctgacggaatgtgatggtatgttattacattaggagaagaccagaacagaccagaccagaggaaatagtagcttggaatataagtatgttggagtagtatagctgaaatcttgatgcagacgctattaacaactctctattccgtatggccaccctccaccttcctttattattacattttgttttctaattggaaaaaagagtagatgtagatgtagcaacaacagaagaagaggaaggaacagcaagcatgcccaagtgacaagtaaagctaacaaatctagggcaggcattgcatagaaggtcagcgtgtattggattggagagatatggattgataggagaaaaagaagagaataataataagggataatacctggatgaggagaaggtgtggcatggcgagatcggcgcgcaggttgcggacgagcatggccatccggcgggcgtactcgttggcgtcggcccagcgcacggtgtcgctctccccctggtaccagaggacagcgccgatgcggccgccggtctcgagggcgaccc

SEQ ID NO: 55779 - DNA, 4229 bp, Oryza sativa
cagcatccgccgcattgctgcttgctaccgttgggcttggggcctggggggttgggtttgggacaaataatttgaaatctactcctcctcactactctactcgtagtcaatttataatgcagctagcggcatgtctgtttgagtttgtttgacccaaccaaaccaaaccaccaaagaaaggaaacaacatccacccatgtcgtgcgctgctcttcccttttcttttcttcttttttttttgggttttgttttgcgcgagtatagcaggaaggaaagtagtacgatgggcctagtttgttggatggccgtgggctccttatcctagggctacggcccaggtgcatcggaggagcgagccaggctcgttcgccgtcgctccggactacagtatactggactggactggaggtcacggtcgtcgccacttctgcccgccccgatcactcttccatctggattcaaaccatcttcttctcctccgatccttgccataaacacatttcactcagcaaggtcatccaaaggttagctaggccggaacatccatcattcacggtacggtcaactaaattttactgaaatacactactactagtagtaccaccacctaggtgtctgggcaccaagcctgatacttgtggttatcggctgtgattttctgacgtaccaggcctaatacttggtatcagccgtgataatcaccttataccagtcaagaatgacttgcctatgcacaatgaagaggagcagcatgacgagctagcgacaagtacaatgtaacaacctcgagacctccatgaactccgagattgccctcacaccgagaacgaccgacttgcttttatccttggtgcccttgacctcatctccctcagcctcgcgtcctccctcttgtccctccccagccacgacaaatggtgacctcgctgtcgcagttacctttctacttgccgatttcaccgattccaacagctacataacctcgttagagtccacatgcccattgatgtggtgtggggaaggggaaagaggatgtgggatgtcatcgtgttggggatgatggcgatcggtcctccagcaaagggaggtgggattgattggagtgaaggagggattgattggagtgaaggagttgggaggagcaaagtggacgacggagagaatgagtcggagaggaagaaagaggagaaacagatatggagaataagaaataaatctagggtgtttgttgttaagttgtatcccattctacgggatctagggtgtttattgttaagtaggtgtactagtatcctaattcacgggactccatccactagtttctgtaataaaaatatggcctctttgaccgtatcgtactagtaggtgaaaatggaccattgtcgtatgaagagaagagaaataggatgaatgatgatgagataaaaatatgggaaaattggttccataccatcgaaagttcctgagttttgctttataccatcgaaaatttgtggtgcactttaataccattcaaagttttctccgttaactctctataccacaactgtttatttccgtcagtttttttttcttttcaatatttggctggaagacaaacaggatatgactgtattgcccttccttcactcatctaaatctggcccaaattttctcgttttttcctctttggctgacatgggcacatcgctccatcgatggggatcgggagcaacaagagcaggcagcacaggccggaggaacattgtgaatagaggactgcacgagcaccggagcacggcgagtgggttacgagcgcgcgcgccggagctgcacggccgacagggacgggctgtcgccctgtcttctgtctatcttctccccgccattcgccaatctacacgtccctgctactgatctcttccctaccggtgagctggtccccaccatttcaactctcaagcaccattcatcccatcaatccgcgtaatctcgccgccggtggcccaatttgcctcaagctcttccaagccggccccctccaggaattgcagcgtcggtcaacatcgtgctctcccgcgccaaccccttcctcacacagcggatggctggccagctccgacaggtgcggtggcaagaggatgtgatggagctggcggcgatgcttggtgaagaagatgctgcttttgatctggatgcgtcggggaccggagacaagggcaagcaatgtcatgtttaacgacagatccactaaagttgacggtgatggtgaaataagtaacggagtaaattttggatggtattaaagtacgccacaaactttcgatggtataaaacagaactcaggaactttcgatgtcgtggaaccaattttccctaaaaatattcctctaagagcaggtagaatagtactccctccgtctcaaaataagtgtagttttagcactattcatgttcaacgtttgaccattcgtcttatttgaaaaaagattatgattagtatttttattgttattagatgataaaacatgaatagtactttatgtgtgactaatttttttttaatattttttattaatttttcaaataagacggatggtcaaagcgctaaacatggatatctatggctacacttattttgggacggaggtagtaggctataaaccagctataaacatattttaaagagataaaagaagagagagaatagcagcggactatatatttgtagccagctacagcacggactcaaagacgtaatgtgtgtatatgacaagtaggaccaggtattaagagtatagtaagcaactattgtatgaattagctattacattaactatgatgatttggagcgctctaacgagcgtgtatatttttattgagccaatcctctcactctcctctcctccatatatacggtagtactcctatattggcctgcctgcctgcctacctgtcctgtccgtccaccttgctgtgttaaatgcgtttctagcgtagcgtagcagatccaacaaacacctagcagcagcagcattggtacgtactcctcctagtcctagctagtgagtgagcgtgaggagcagtgagcatggcgtcgccacagctacagctgcaggtactagcgctgctgctgctgctcgccaccacggccacggccacggcgacgccgacgccgacgctgatattccttttgggcgggcagtccaacatgggcggtcgcggcggcgccaccaacgggccgtgggacggcgtggtgccgccggagtgcgccccgtcacctcgcatcctccggttgtcccctgagctccggtgggaggaagcgcgggagcccctccacgccggcatcgacgtccacaacgtgctcggcgtgggcccggggatgtccttcgcccacgccctcttccgcgccatcccgccctccaccgtcatcggcctcgtcccctgcgcccagggaggcacgcccatcgccaactggaccaggggcacggagctgtacgagcggatggtggggcgcggcagggcggccatggccaccgccggtgcaggtgcaggggccaggatgggggcgctgctgtggtaccagggggaggcggacaccatccggcgggaggacgcggaggtgtacgcccggaagatggagggcatggtgcgcgacgtccggcgagacctggcgttgccggagctgctggtgatccaggtggggatcgcgacggggcagggcaagttcgtcgagcccgtcagggaggcccagaaggcggtcaggcttccttttctcaagtacgtcgacgccaagggcctccccatcgccaacgactacacgcacctcaccaccccggcgcaggtcaagctcggcaaattgctagccaaggcctacctatccacgctctaattatatcatttgcgttcactgctggctactaagtactgattcattcctccccttcccctctatgcaaaatctgtcatatggagcgcgtgctgtatgtaggggatgagtatcttaccacttcttccttcattccggattaaaatataatgttactgattttctttttcccacaattattactccactactttggttattacacacacacaggacagacacctggattgatttctggactaatgcttctttcttcctacttacattactatactctcctagtactcctgaaatgtgtactgtcggcagctccaattgtactcatgctgtgatgatctgttatgtaatgtagtatgcaacc

SEQ ID NO: 55780 - DNA, 2534 bp, Oryza sativa
caaacaggcccctaagagcaggtacaatagcaggctataagccaactgcaaatatattttaagaagataaatcaggagagagaagagtagcgagctacagatttgtagcccgctgtagcacggactccaagacgcagtgtgtctatgacaggtgggactagatattaatagtgtagtatgtaactattgtatgaatgagctattagattagctataaataaattagagccagtagttggctatactattgaacttgctctaataaagagcatcaatgtagaattaatcccgttgctctgactgcatctgcatgctcaagcagtcattgggtggatctgtatgccaaaagcgtcacacgcatacatgaagaccaaacacagaagcgcactcttggaagatttgaaccagaaaacacatcacgccttctgtcataaaaaattgacgccctctaatatgtaatatgggatggagggagtactaagttaaatctcatctcatactgtattgctatattttaaaatgatgaagggagtaacctactacttcctctgttttaaatctctctatttcaaattacttgttctaacaaacattatagtagtacaaaccaaaagatgtggtagattacatggttaccctcattcaatacatcctatttttttaaaaaagcaaatgagtcaataagacttgagattgtattaatgtatgactgcatcaataaaagatagggaaggaagatctttttaaattaaaactactttgtaataaaagtgataagtattttgatataaaatttaaatactaaaataagttgtatgaaatggatcaagtatatgtaggtaaaattctttacattttaggatgaagacaacagtagtagcaaataactgttgaaggtcaggatctggggacctatcacgtgctcatcctatcatacagcaacttgtgacactgcactagtgcagacgattcccttgtgtggccaagatagccagattcattgattcagggacctttgctttcatcatcccaccaattcaaccttgcttgccggccagagtactgaaataatttcagggctcctttggaacaaagtaattttagaggattggattactatgaaaaaaaattccattacaggcatttggaacaaaggaatggcttctccaaattcctttgaaagtctttaggactgtctcaaatcataggaattttgaaggattgtcaacatgagattctaccgctagaaaaaattcctttgtgtctatctttctctctttcgattcatgtgtttttgttgtgttacattcaaactgtaattcctggagttttcttgtgttttttcatccataggatttgagatgacaaagcaatcgaattctatttttttaaaaggaaatcctgcgttcaaataaaaacaaaactcaggctgctgctcattcatttgaaaaggggaagagaaagaaaatagtagtgataaaaatacaaatggatcaatgagggccagtccgcccactacatatggagtattatatattgcccttttctttttcccaatcatcaacgtgaagatcatccccactagcctaggagtatgaatcttgttttgacacaagaaagagcattggtggccatgcgggtgcgcatgcggaattgcggagtagtagtccactactagctagctaagctagtgatgcagctgtgtgaattacttctagtttgtgtgagtcgcaatcattgaattcaaatggaagtggagtacatacaaacatacatacatgcatgtgcttgatgttgatgagttgataatgcatcatcattactgttgttcgcaattatcctgatcctttaacttgaactggagtagtatttgggattcagatccatgtcattcattcatatcggaaattaagtattactacatagcagtagaaattaaggagccatctcatctcatatgactgaatttattgaaatgattggtgattagtattacagtaatttgtttgtaggcgtggcgttattagtgaactggagtagtagcatacatgagaaagaaagaggaatacaggcggtggtggtatacggtatacgtacaaggtaggtaggtaggggtgagcggctaggcatcggcgtcgtcgtaggagaggtggaaatcggtggtgcagccggcggcgtcggggtcctcggcgccgcagcagtcgtagaacttggcggcgtagggtgggtcgccgtcgcgaagctggtagtacctcttctggtcgtcgtggcgccggcacacgaaatacgacgggtggaacctgcaggagagccgcgtgttgcccgacggcgcgtacgtcgccttgcaccgccggcacagcttctccttctcctcctccttgccgccggtggtggactccatcttctccttctccgatgatggggatctcatcacctcccctcattggggtggggatcttaatttcttctttgcgttaattagttgggccggggcccatctttcttgttttcctgtgggcctgcctcttattcgc

SEQ ID NO: 55781 - DNA, 8264 bp, Oryza sativa
tgcaagtatgatttctttttcctcgttacacctttgtaccttgatttaaaaccacaactaatgaattggaccaaaattaaagtacttgcatataagatttattggagctttgtcaaacacaatatcattccggataagccaaagagaccagcataaaacataaatgttcatactaaaataagctttttgatttttaagtcaataggactaagctaactcccgaacaaaacaattattgaatagcgaaatcctaaccaatatatatgcattgttaatccacaacaccagaatttcatggtaattgaacaactattatactccccttcctaaaatatacgcattttcggattttgacaagagtctatgagattttacttttactaataatatttatataaaatgagttgttttaaatagaagagtttcacatcatgatagttttgtttaatgataaatatagcaatatcatcttacatgactaatattttttattttctcgctcgtcaaaattcaaaatgttcaattgcttatattaaaaatgatgggtgtactgtatacgatttttttccgcgagcaacattgttggattgcataggtcacaaccgaagctaacgaattcccaactactaattatgacgattaacaaattaaggacaagctagctagagaatctttgacgagagctagctatatatttggcatgtattagcaaagacaaaacagtactgctactaggtagctagcgtgcatataaaagatcaatcaaggattatgcatgcatacatccagaaaacaaaattaagggaaattaattaagttacagctcgatcgatcgtctcccatctaccaacaaggaccacactaagctagtcgttcctttattttcttatgcttttgcatgcgcaggcacaaagtaaattttcaacggtttaaaatcaataaggagttgctgtttggatgaacctcatgttaaaaatctttcaaattcctatagtttaagacaatcctaacgaatttcaacgaaattcaggagagccatttattagttctaatggtgatggaaacgggatgtctgatcttccgtcaggtgaagatcgattactcttgatggtggaaacttgacacacacgatcatgctttcaatcaacacaatccgtcgtagcaccacgtcttctctagttattaaccgtgtcaaaacccgtttaacctcgccgagaaggctaatccctacgtgcgaaccggagaacaaaatcaagaacaagaaagacaacaactcaattgcagatgaatgattaatcacgaactgaaagttgggattccacaaaccgaactagcgacgaaactgcgatggcagaaataatctaagaaaaacccaaccctaattcaatgatagctactgaatatataggttctaggatcgacctcgaacccctggacgcgtcctcatcggactccgacatgatacaaggcccaacgggcccaaagatggtgacacaacacctggtcagattctgaacgccttcttctttcgatgatttccattaactcggaaggaattttgacgtgtgaccacacccattggaaagatagtctcgttagctttccatacatatagaacgtcaaaatcggagtccgaatgcaatctgagtaatgattttagtgtcgattgctcctggagcacgaggtggactcaaattcgatataaggcggaccttcatcttggcttgaacgtccatgacgaccttttccatcttctagcctctctccaagtgctacatcattctctccatagttactaatcgtaattaaattaataggtagtaatctatcctcaaaattacataaagaagtactcaataacaagctcacatgtaaattcaattatcagacgcgagttttagttattggaccttacttaacaacttgagaagtaagagtactttgtgtatctaaaggactgatgtcttcatcaaatggatcataccgcaaatttgcaattgagttctttcccataggaatttaatgctttaaaattccttaaaattgtttgctttaaagagccctaaataaattaagcaacgatgtgattcacacggtcgcttaacctgcatggagaataatgtgtgtcgacaaatatccaacagactacatatatatacgtagttcctctgtactcgtaaaggaagtcgtttaggataatatttaagtcaaatcttaggaatataaatcatgaataacacttaagttgttgagtttgaaaatgtaaaaaattatatgaatagatttgtcttgaaaaatactttcataaaagtgtatatatatatatatatatatatcacttttcaataaatatttttatagaaacaagaactaaaagttgtgttttggagatcgtgttgatgtcctaaacgattttctttacgagtaatagggagtatatgcatccgattaagtaggacagattaattaagatgatcgtcatggagtaataatatactcgtattgggagctagcaaaaccgcgttgccagagtttagtctgcggcccagccgataattaatccagtagtcaaactgatcgagtgacctcacagcttacgtacgtaatagtggtcgccacgtgtcgctctatccgactatctacctatagatcatcacagatggaatggaattttggggtttagggcctgttcactttgttgacaaaaaaaaccttaccaaattttagcatgatcaaaattttggcatagttattaaaattttggcatattattaaaattttggcaacttgctaaaattttggtaggattttttatatagttaccaaaatttggcagcaaactaaatgtagccacttttttttaagtaattttaccaaaatttggtaaggttgaaaatggcataaagggcctattcactttgatgccaaaaaaaaccttaccaaattttgacattgtcaaatttcaaaaatagatactatccctatctcaaaatagatactatccctatctttagctatgtatttgtatagatccttgtgtacgtatatatgcatagtaaacggaggagtagatggtgatgggacaaggtgtatactccctccgtcctaaaatgtaagtatttttagcttacatatgtatctagatttatagctaaaaatattgtgtttagatttatagctaaaaatgcttatattttgggacggagggagtagcaaacaggtcaggattcggcacaaacgtaacatcgcctacactgggactatatatgtaccgtgtaccgatttaagaaagaagaggtaaaggaaaaatatatatcttggggttaattggccgcgcgctgcactgcttattactagcaagagtgtcgatctgcagtgtcttgtagttgtatactactggcaaagtggcaaggctgagttagagaggttggagaatggagatccaagaacagagcgtgacctccgatcccctgtcgcgcgctcgccatatgtacagtagaaataatcacccaacctactgcctctcgtggtgtatggtggctgtgttatttgctcaggtttccaacccctctcccttctcgttccacgcgcacgcttttcaaactgcgaaacggtatgttttttttacaaaaagcttctatataaaagtaattttaaaaaaaattatacaaaatcatattaatctatttttaaaaaaatggctaatactaattaattgcatgctaatagatcactccgtttttcatgggcactgtgcttgttgggaacggctacttccgaacatagcctatatactcctgcttcctgtatccactgaatgttactactgctctgctcttctcctcaatagctagatactactattccctccgttcaaagttacaaaacacttttgaatttttttaagttaaatttctataagtttgattaattttataaaaatgcagcaacttttacgatatcaaattagtttcattaaatctaatattgaatatattttgatagcatgtgttgtttggtgttaaaaatattgctatgtttttctacaattttttatcttaaacaactttaatttagtaaaaagataaaaacgtcttttataatatgaaacggagaaaggagtagatagggctctcctctctcacaaggacaccacagtggctagggagccgtggcgacccaaggagatagaggcaccacccctcaaatccaggccggatccggcgaggagcaatgctgcggaatggagcgttggcaatgaagacggcagttaggcctctcccatagggtgtggggcatcggtggctaaatccaacgtctctacagtcggatccgtcacccccgcggccgaattcggcgcctcctgtctaggctcgtggcaggagaacggtgcgaggaggcactatagctcagagacgattgcctgctgccgtggaggtaggggtctagccacggcggcgaggccacgggaaagcggaggaggcgaaactacgggtcagcagcgcgaggcggcggtggatatggccgtggaggctgaggcgtgggtccggacggtcgcctgcggggatgcggcagctgctccttggcttggggagaggcggtgatgaccacacatgaccggacctccatggtgttgtggtgcatggaggatggttgagtgccatcgagctggtgcaggggtgctggccggtggaggggtgccggtgcggcgagcctacatgctggacgaggtcgttcgggtggcagggcttttgtcacgccccgaactagtaccgaccggaactagcccgtgacgctccaaataacctgttaatcgataccagtcccaggaaacagtgctggtatcgcaggaagacggattatcacagcaacagaggtctctttattatagagtagaggtacagtcatgttgggctgcggacagatcccgagctcacaactgcattacaaaagggggaaacggaagccaggacttggaccaaacaacacaggcgcgacttgggaactaggccgaaaccctaaaactcatcgaagccggcttgctcctggaagaactcctcatcagcaggatccgcttcatcttcttcagcaactggggggattatttatatagagcaagggtgagtacgggggtactcagcaagccatgggaaataagtgtttaatgcaggcttcaaggaaggctgttgtttttgcagttgattttatttgaactcttttctaaaaacaactaagtgagtgcttctcaaacgacacggatgagacagtgcgtctcgtccggtcggagtatgtgtaatgtatcagtctttagaattgattcaaggttggcacccggccaacagcttttcaaacggccacccgggccaacaactttcaaacggccacccgggcctagctgatcccatcagctgcagatttttcaatcatcgaacccctttccacaacagcaatttcacaagcagtagtcaaacaaaactacgctaggaatcacctcacatccgcccatgaccgtgggcacggctattcgaacagcttgttaacctctgcagagggggtacactttacccacacgacattactaacccggatctcccagcccatggggatccgccacgtcgggagacctccaagctttcatgacaaggcatttccaaagccgacacaggtttaccatatgccgacgagaggggtcccagaccaacaactggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggttttccaagtcttttgtaaaacccaagttttacccaagaagtttttcagaattttaagtttgaaggcgtccgtcgatactcgcacagggtgcacgaatatcgagacgcaactagatggttacaaggggacacgatataacaattatcaaaggaaggatcaaatgcaacaaattaggtaggtccgccaatctgccttgcagacgggacaacagattaagtgcgatcctatcaatacataatatttttcaagcaacataattaaatttcaattataggctcaagatgttcaaaggtggcttgccttgctcgagatctagagcttgatcctcgaaatcctcgcactgcgggtcttcgggctccgaaactacacgcaaaacgggacaactcaacaaacggcgaaaataaagccctattaatgacctctaagcgtgccattagatagatctcgagatttgaggaattttggaagttgaacggagtcaaacggatttacggttgggaagatattgaatttctaatattattggatttttggtctaaaggaaaaatgatttaattaaatcctttttggaaaagaaaagaaaagaaggagggggaaaattagacttccctcgggcggcgagggcgcggcccgagagaaaggaggcggctcggccgagctaactgggccggccggcccgaaaggcggcccaaagcgcgcgcgggggaggggagggagggggcgccggtggaccgggctcacctcgcgtggtcccgagtgggacccgcttgtcagcggctcggctcaccgtgcggagggagcacgcggcgcacgcgcgtgggcgggggagggatgcggtgcacgcgcgcggttcgcggtggaacggatgcggcgggcccacgcgcagcctcacggctcgcggtggaacgcgcgcacggggaggggctgaccggggtcaattcgacccggccttggccgagcttgcgccgacgtggcgcctacgtggctgccacgcgggccggcgggaggtagacgacgacgccggccggaacgaacggcggacgacagcggcgagcggcggagcgaaccacggcgatataggcgaaagcgagcacaccgggtggttgcacgagacgaggggagacgagccaacggctcggattcgccggagggagcttgacggcggcgaatcgcggcggcggcaaccggcggcgggaggaggggaaaacggcgacgaggtcacaaggggccgattcctggcggcgagagcatctacgcggctacgggaatccgatgctagcgttggattaggaggaaacgcatcgagggaggccggcgacgagaggcgcttccgagctcgggcagcgacagcggcgagcacatggcgagcggcggcaacggtcggggcggcgccggctagctacggggaggctactcgtgctactacccgagtctaaggggaggagatggagcgaggagggagaacggagggatgcactaccgtgcgggcggggcgcagtgacgagaggccgacggcgcgggagtaatctctccggcctcgggccggggaagaggaaggagagggcgcgcccggagtccccttccgcgtccttgctcgtgccggctcctccgacacgcgcaacgacgaaaggcgacggcgaacagagcacgggaggcggcggcaatggcgtggaggcgaacgggagaggaaaggaaagggggaagcttaggtttataggggcggcaatgtcagtttgggagaggggaaccgacattggacggtcaagccgacgagctggcgctccggctagcggccaaaacggcgacaggaggtgacgccggcgagagggaaaaaggaagaaaaggggggagagaaagggggcttgtcccttgcctcttcgggaaaaggaggggggagcggggcgacgcggcagagggaggagggactctgcctccgccccttgtgggctagcgcgcggagtggcggggccgaggcgatgatgacggcggggcggtgtggagcggagcggcgacacgggcgacaggcgcgagcaggcgctgacgacggcggcgaccaggcggtcggccactcggcactcgcgcgcggcttgcaacgggaggcgcggcggatggagtggcgcggctcgggcacgcgcgctggctgcggggccgagcggctgcaggcgtggcagggcagcggggccgggcggcgcagacagcgcagacagcgcaggcatgatgcgagcgacgaccacgcgggcgcgcgcgcgcgaacgacgcgcggggagcggcagcg

SEQ ID NO: 55782 - DNA, 6590 bp, Oryza sativa
  unsure (1)..(6590): unsure at all n locations
cagctctctccacccgatatgacttttcgggtgaaaacctagtccaaggtggatagcctccatggaggcaccgcctcgaaggtcatgttccctcgcattcattgccttcttcctagtttggccttctgcgttcggttagtttcgtctctaggttggtgtaagaatgagcagatctttccccctctctctctctctcatcctcatcctcaaacctcctgtgagggtggccgggagtctgtcgtcgacattcttggtgaaattggtttgaagcgagagcgtctgcgacctccttgtagggctagcaattatcggtcacgtacaacgggtgtgtgtttggagcctgtagcatgtggtggagtagtcttttttttttccctaattatgaccttcttctgttgtaattctatacataatttttttcatgctatatcaatatgaatcttcttgtgttgtcttgtgcgggtcattcagaaaaaaacactattagtaagtgggaaactagaggccgaccggaggtttctttctatcgttgggagcctctctgccttccgacctccatcgaattgggtgcagaccagcagcagccaataattaaggtcgtcggccgtatatatgatgatggagaatagcagggagcagcagccggagtcgtcgccggcgaacaacaatagcaagaagaagaagaagaagaagacggcgtcgcggttccggcgtgtgtgcgtgttctgcggcagcagccccgggaagaaggcgtcgtaccaggtggccgccgtgcagctggggcagcagctggtggagcgcggcatcgacctggtgtacggcggcggcagcgttgggctgatggggctggtgtcccgcgccgtccacggaggcggcgggcacgtggtgggcgtggtgcccaatggcgtgctgccacgcgagctgatcggcgagacgctgggggaggtgagggcggtgggaagcatgcaccagcggaaggcggagatggcgcgggagtcggacgccttcatcgccctccccggcggctacggcacgctggaggagctcctcgaggtcatcacctgggctcagctccgcatccaccacaagcccgtcggcctcctcaacgtcgacggctactacgactccctgctcgccttcatcgacaaggccgtccacgaaggcttcgtctcgccgcccgcccgccgcatcatcgtcgccgcacccaccgcctccgacctgctctgcaagctcgaggaatacgtgccgccgccgcacgacgccaccgcctctgagagcttcaccttgggagatgnntnccaccggtatctggagcagcacgccggaagcatctactcccccaagcccgacatggcacgctagctagctagctagctactcgatccacttcattattacttatcttgtttcttctcatataatcttgctgctaattatttcttccatatattaattccctatatatatgtatatatactcgatcgtactatattgtatacatcatcaattacttgtaacttcaattaatcctagctacatcgaagaggcaggcggccctagttagttttcctgtactagaagctagttaattttcctctatggagtgttattatgagttgattgagttgggagtattaatttgttctctcatcatttactagtacacacgttgttttgttgtcatcgatctctattactcgtagaaagggtaaggacctagactaggtactagaggaagcagaccgatccaactatccaagggaggaagccctgtgattgggaagcagcaattcttttcttcttcttcttcttcttcttcttcttcttcttcttcttcttcttcttttaaaggaaaactgcaaaattaaaatagagcaatctaatactcgtttagggcaccacctcatgactaatcaagtactaggtttctgctttctccgctttaagatatattaacctagtactgaattatacaaaatctagtatcacgaatagtccaaataacctgttactaaaaatatgaatagcctggtaataagttgtgtctaatctaatactatgttgttatattttgggtcagaggatgaagagagtacttactaatactatgttgttatattttgagtaggattatacttactaatactacttttgtgtgcatacatagcaaattagcaatcaatcaacttccttcccgtgtcctctttgcaacacgacaggtcctccatcgatctcacacgtggagagatagagagagagagaggcgcaattggagtatatcggcaacttttaccaacaaggacggaaggaaggaaggaaggaagaggaggtgagacaccaaccgatcgatcgatcgaccgaccaaacgaggtgaggtcgacaaacaaagaaaagccagccgtagtgacaacactagctagtcatcgtcgtcttgtccatcgagtaacaaacaaacaacactggcattctggcaagtggcaacagcatttctcttctcttctcctctcctgtggactactagctagctaggagatgtttttccagtgagtttcccctgaattctgatcaagaccgaaaatgacaattaattaattggagtaaaatcgatgcatgtggactactctctctctctctctctctctctctctctcactcactcagagtctcagtctccttccaggaagccctctcctctcatctcctctttctggaccaaaaatgagaggacctcatctcttcacacaagagaagagccccatgctactgctagtggatggataggaatatagacagggaccatgcatgctatctttctgtttggctgtccatgtaaactaaatgttggataagaattgtctggacatgtttggactgtccagataatagccagtaattaatatagggaggtaaagtcaattgctgttgagttcaatttggaattcaggcatatgtataataatcctcctaaaataaaaactagactagtatccctttctacctaatcatcttgactagctccgtcgtttatctcataattcaattcaattctgtgtgcatacatatttatcccatgatgcaacgtgactagtcacaagtatactagtagtagacagaaacaggcgcctacacaccaagtgaaaatcttttaactatttggcagctgctttccatacgtccaagtcagatgatcaataataggcaacagacatgcatgagtgataatatatttgttcagaatgaccttaaggcctctaattaccttaaattggagtatttgatttgcctatttttgtttctacaggctatcttaattaggtgttgatatttcagtagctaccctattatcatatcatatgtacctggctacgacttgcgtcctgcagcaatcatgcatatgcatcctcatgaattaatcggcatcacatattgctcaactgaccactagaaaattaagcaatgcatactcattgttacatgtaggaatgcgattaatttgttgaatccgcggagtagcttgacgctaacttagctagctcaagctctctagatagcgaggaagcaaaagcagctgcccaattcgattttgcggcccatgcgcgcgtccttttccttgtcgggtaataatctctcaatttgtcgcggtagtgcttaatttcccagagttgaccatccgacacagcagaatggggaaagcatggcccattcaccacctgcctaaacaagctagtacatatcatactcaaaaccatacctttctttcacacatgaaaaaaaaaacacctttcagctggttgtgcttctaatgagctacgaactgatcaatacatcctcgctctaacatataagttggcagaagcgttctaacctcgttagaggccgctgtacgtgttaatatatgtttgggaaaagcccccaaagtggcgcatacaatggtgaagattggttacaaaacagaaaacaaaatctcttcctatcttatcatctcatgcgttgttatctcacgtaacaactctatgtaacaaacctctatctctaacataacacactgcgtcgtaaaacaaaagtcgcagtagctggcatcaaataacatgacacgttttcacacatttcatacaaagtgagaaacttctccaacttcccgtttgcagtgcactgttcaggaggaagaggaaaaccgcatcaaaaatctatataaccatcatccaaacgaaaaatctccatactccactagcaactaacacatagtgcttgttttgggttccttccgacaagttgtagcctctttcaaaatcaaaagttccttcaaacagtcaaaacttttcactcagattctaagtaactgtaattatagaatccagaaaatgaactagaagccgaaaaagctaggtttctcagcttcttccggttctcacggactacttttccagttctcacggactacttatcagaatttaaaactcccccaaacaagcccctatacacacttattggagcccaaacgctcctgaagaatcaggcttgaatatgaaaacataaatcaaatcgtaattcgttcagaacttgcgttaatatagaaaaaaaagtgacgccaaagattcgctccatgcatgtgggtaatacacgcgggcgatccgactttgatacagactcgacaaatcacgagcgtcaaaagaaaaccaaacagcacatatgcgggcaatgtaaaaagaacatatttcacaaaatagtacactacgaatataagtttctatcctgaatcttgtccacaatacagaatgcggccgatctataaactaaactaaaaatcatgatacaatgttgtaccgtgatcatactatatgatggccccgcacacgcagcaatgttagcaaaatacaggagcacaagagctgctgtcatcacattaacctgacagctcatactgcaaaccaatggcagtccaaaacagctcttgcgacaaaattgagttggcctttcctattgactagcagaaatctcgcaatcagcaccaagtggaggtaaccgaaaataaaattacagcaggcaccttctttcaccaccctggaagagaacttgggcaatggggtgttgagggctccagaggtttggaggccaaagcaagaaatggaactggattagcaaggctgaatcacagaattatgaatcaaccatctcatcttgtaattcgcttggggcaataagccctggaatggcaagcattcgttgacgctccctctctctttgtgcagcagcctcttcagcatacaaatccttattatcctaaccaaacgaacatgaaacaactcatcagatgagttcaacagcaagtaacatgaaaacaaataaaaaatgggcacttgtgcattgtaaaggccctaacattaacgctaaacttggcacatgattccatatctatcgttttctcaagtaggcaccatactaccacgtggcaacatccactctctggtaattagcaactgttggtttctgataaactatgttcttactatttctggtatagtgaagtattggttcctctaattcctttgaattgtgaaaaatcaggtccatgccagtgtcaaggggtaggagcaaattacctgagccgagaactcctttgattgcaccaggaaatccctaatatggtttttgaagcttggaaggtcatgttttgaactaagaagcccatcaacaaattttgtaacctgtgcgggaaaagttgttaggtctatgatggccacagaagcacaggatagctgcaaaagaaggatcatacctcagtaggtgtcatgttgggaaatgatgaacctaaaagttttattgtgtaatctcggacaaacatagcgttgtcagtatattggtatggtactgaggatgcatcccagagaggctccgtcagaccatcaacctacaaattaggaaaattaataattaagtgtatccatacaaacaaaagagaacagataaaaatgaatattgacataccacacaaaataagtgctgcagcaccaaaacatgaagcttgaaaccaggcttgtggaatgtgtctgtcagaactgcaaagatctcttgttcaatattcaaaaaataagttttgtagaattgattttggaatcctgaggcctgcaagtgaatcatgtaaaaaaaacataagcaaacagaatattatgcaatggtagcaaattgtggattgtattttctacctgaaagttctttaaaatttccagcaatagactgagaccagtctctgcgatgtttctctctgtatgtctaaatgcccagttgatagagtcaatcacaagtttcaattgctgaataagataacaatccaataatcagataaaacagaagaatagaagataatatgttgatgtatctgaactcaatagtaaatttaaatcaacaaggaagaatgatgttttaaatagttggtactaacctgacttgaaagctgaattaatgcttggaagcaatgggtgccaatcgcacgaagcaaagagaaaaatttgaggcgatgctccgggtaatcttcaaagtttttagtgatcatctgacaggacagaacaaattattaatccaatctaaaaata

SEQ ID NO: 55783 - DNA, 2144 bp, Oryza sativa
ctccaggaaaccaaattagaccccagaaacacagcaaaacctccagttgatcttctgtcatcaattgatcctgcccaatcagcatctaaaaaagcactaacaagagtggatgatgaacgacttatcttaagaccaagatcaactgagaatttcacatatcttaatatcctcttcactgccatccaatgatctatagttggactatgtaaaaactgacagaccttatttactgcaaatgaaatatcaggcctagtcaaagtcagatactgaagagctccaactatacttctgtatctagttgcatctgtttctcctagagcagttccactatgagctgacagtttttctgatacagacagaggagtactaacaggtttacaatctagcatacttgctcttttcaacaaatcagaggcatatttttcttgtttcagtaaaataccatcacctgccgtactgacctctattccaaggaagtaatgcagatcccccaaatctttgagtgcaaattcttgactcaaatctgccagcaaagcagatactgccttctatctagaactagccacaattatatcatcaacatagataagtacgaaaattgtaacacctcctttgttataaaagaacaatgatgtatcagctttggaagcttggaagccaaggctaatcaacttagtacttaaccttgaataccaagctcgaggagcttgcttcaacccataaagtgctttgtctaacttgcaaatgtaattgggcttactcttattttcataaccaagaggttgcctcatatatacctcttcttcaaggtatccatgcagaaaagcattttgcacatctagttggcgaaggcaccatcccctggaaacagcaatagacaagacagttctgatagtagctgctttaaccacaggactgaaagtgtcctcataatcaataccatagcgttgtttaaaccccttggctactagacgagctttatatctatccagactaccatcagactttctcttattttgtagacccacttgcagtctataacatttttaccatgactaggtggaattaggtgccaagttttattttctaataaagcagtaaactcagcatccatagcatctttccagtttttatcagtcaaagcttcatctaggttttgaggttctcctgtagttgtcagcatgccataccttacagtaccatcagtataaaccttctgttttcttatacctcgctggagatgagtgaccggccgtgcgggctcgaccacggctgtgtcgggtgcagacgatccgccggtcagagggctgtcgctccccccatcatgatggctgcttggcgacgtggctgcatgcgactgctccccctgctgcagagacgtcaagccaccggtttcgccgatttcttcatcgtcgggaaaagacagtgcaggcgtgtgcacaggtgagggctgaaatcctccctcgggatcgctgcggcatctagatccggtgcatctccttcaatatttgctgcagaactgtgatcattttgtgctgtattttctgaaccttctccgaattgtatctcctgatctgtcacatgctcaacaggcacattagattgctcaggaacattaggcatgcggtcattatattcaaccccattagttgcaatattttgatataaggaggaaggaagcaaaagaatttcggatctcagccttgctccagcgtttgcatgtaacctttcaaagggaaaaatattttcatcaaatacaacatctctagagatgtaaactctgccagttgatatatcaagacacttaaaacctttgtggatattgctatacccaagaaaagcgcattgtttggagcgaaactgaagtttgtgtttgttgtaaggacggagattgggccaacaagcgcaaccaaaggttctaagagcagaatagttaggcttttgatcaaggaggcgctctaaaggagtagtatactgaatgaccttactaggtgtgcgatttatgagataggcagcagctaggaacgcctcatcccaaaatttcagaggcattgaagcatgagaaaggagagccaacccaacctctactatgtgtctatgtttgcgttctgcagaaccattctgttgatgtgcatagggacatg

SEQ ID NO: 55784 - DNA, 2468 bp, Oryza sativa
  unsure (1)..(2468): unsure at all n locations
tagtacactagttataacaagagtttactgtagttcgacttgaataattaatgtcagcggactatgtagccatgtcccatattgttgtctttttcctagctcttacatgtttctaaattcgccgatcttctttttcgataccttggcgttagctagaaacctcttgggttttatttttcctttacacatggttcttggctacaatatcgggcaatatctgatataccgttacaaccaagtctgacaaacactactgctatggcttctttttataacaataatcattcaatgtacgcctaactagaacatataaataatattttaatctaaagttataacgactagaatagttagcattaacacgtatcattgtcctattgtagctgcttttcaattgacgtcatagaatctatggcattagacacatctttagtgtgcccgctaatatgtttaaactgtttttatttgtaaaatgagatttatatcatttttgtgaagaagtatacatcaattataaatactctcataataattgttctttttaaatttctatacataatatttggggatttgtcccacaccgtatatatttgagtatttagcagcaaaagcggctgttggctgtgtgctgcacaactctagataggggatgtaaataatttccgtaattgaaaaaatgctctcataatataaattcatgagagtagtataacacatgtaaaacaaacaggtaataactcaagtaagtagtacttagaagtaaacaacacggggagtatatatatatcatgaaaatgagaaaggaaacaaataaacaactagtggtattggaatgtattgatgtaaaataagaatacggagttgtagaggggggcagagtgaaaaagggggggcagcaagccgagcatcgcgtactttccccgcaaccccaaacaacaaggaaggaagacgctcctcccctcccatctcttaaaccccaaaaaaaccaaaataaaaatcctcctccttctccgcctccgcttcccttgccttccccgatagaaatncatncctncngncgncgncgncgncgnncgttctagggtttcngcacctccccgaatcccccctcacttcgacccctgttcgcttcacccgccgccgccatggcggagaagctgagggatctgagccagcccatagacgtcccgctgctggacgccactgtcgccgccttctacggcaccggatctaagnaagaggtattctacttctccgcccgctcgctcgcccgcgccttgcgtgcttcttccccgccaccgccgccggacagcttccgagacttagggtttacgcgctttcttctcctatgcgttcccaaccctatccgctctcaccgcccgccaatgccctctcaaccttactctttttcatccttagggtttcgtatttactggagtatgcgtcaagctgggcgttgctgctgctattatagcaccgtttatgaccccccccttcacgctctgtgtttgctgttgctgccctgctgcatattcgtttatccttttattttaacctcctgccaatatacaatgtcattatcacctttaatgtgtttcttcctaccatttttttgattaagcaatgtcatgcatgcatccatattatccttatgtgccttttttcttctttcagaggaatgccgctgatcagatactacgggatctacagaataatccagatatgtggctgcaggtggtccacattctgcagaattctcacaacttgaacaccaagttctttgccctccaagtaagtttccgcacctcactagttagccatgttaggtttctttgcaactcaataaagatggctgccatttctcttaatgattagcattgtagtaagatattttttcatcccgtaatacctgcactttacattacacgtttgcttatatgattgtagtgtaactgtgttaggagaggttctcatagtcaccatatcctatatttgagcattcagattgttcaacagtgttgagtgttttatcacttatgtactaccacattatagagacgaatcaaccctaggagaaacacatgttgcttatttgccttcgcaggcctagcgcataggctagattgaatacatacataggccatgcttaaaaaatttaaatgcaggatggtagcatgaagtttgtacagaaccctgtttacagtaaaagtggatgcttccttttttacagaaatagatggagacctaagtttctaaatatcagtttgcagtttttgtgctatgcttattttttaacatgctggagaaacatggtttataatggcctctatttagagcagtgaaaggtgacatgttggttctattgtttcaccaacagaataaaaagagcttctcttttgccacttcagaatctctaatctctttcactattcaaataaggctcatctctttttttgccatgactccat

SEQ ID NO: 55785 - DNA, 3741 bp, Oryza sativa
tgttattatctatttgttcatctggcaagtcaactgacttgtattattaattgttgcaatataataggttctgaagcatgagtggccagctaggtggtcatctttcgttcctgaccttgttgctgctgcaaagagtagtgaaaccatatgcgaaaattgcatggctatattgaaggcaagttgagttatcacctgtttctgtttaacaacatggaaccaactactgactctgcgatttgcagcttttaagcgaagaaatttttgatttttcaagaggtgaaatgacacaacagaagattaaagaactgaagtcatcacttaacaggttggttcttgttaccatctttgtccttttagggtgttctgtatctatatatattagaccacagtcaattattttgacatatactttattgcgactgccttttgaactgatgcaacattattttccttattgttgaacagtgaatttcgtcttattcatgagctatgtttatatgtcctatctgcaacacaaagacctgagctcatccgtgctacactggctacacttcatgctttcttatcatggataccagtgggcttcatatttgagtcacctttggtatgtagcttatttctaaacttatcaggaaagatcctacatagaatttatcaaatcatgtcttatttttcttcatatatgtttgttagctggagacattactgaagttctttcctatggctgcttatcggaaccttacactccagtgccttacagaggtaaattggtgatgtatttcctgctgtgtctaattagcaatgtttctaactgcgtatgttcctaatggagtaataaaaaatggaccatatccattagtttggttcagttttttttttctatatatcctttttgaatgggggcagtaaaccagccctattgcatttgagaaacatgtaaccttgttggtttaataccctatttatcttttgtatatatggatcttgcaggtcgctgctcttcagtttggtgatttttataatgtgcagtatgtgaagatgtatacgattttcatgatgcagttgcaggtaaagaatgtcttcaggaatctgttgcttccttctttctaaagtatcctcgccctttccccctccttttaaatatgtacttatgaacgacccttccataacatgtataggctattcttcctcctggaacaattcctgatgcttatgctaatggctccagtgaagaacaggtatggcagtgattacttcaataacagtcagtcataggagtctggttgatttctcattttttaaataccattgaggtactgtattaataaaatgtattttccttggtgcaggcattcatacaaaatctagctctttttttcacttctttcttcaaggtaggatttctcacattctctgtatgcctaactatcttattttttgagataataaaattgcacacttaaaatatatgaaactttctttgagatgctgtaactaattaacctactcttttgatgtcatattcccagttgtgacaaaaaaagctgatttgttcttgtattggccttgtcaatttatacactgaaaaaataacataaatgttagttacgccgtacgaaatcatgatttagtttcaatatgctctgatctctttatttggtgatacatttagaatcacatgcgcatattggaggcatctccagaaaatagagctgcattacttctgggccttgagtacctcattggaatttcatatgttgatgacacagaggtttttaaggtaagtaatttatagctagattcggtacatatatgaatggttcaagagagatgcatatcttataattttggccgatttgcaggtgtgtttggattactggaatgtgtttgttttagagctatttgaagcacacaatcaaatggagcctgcagcatctgtaaacatgatgggacttcaggtgttcctctatgaattttttacatgaattcaatggctttgatatattcacctttgcaattcatgcactttttgcaaacttttccttctatttcacttgttatttcttgttttgaagtgctgcactcttctacatcgtcgactcatcgcacatatgaataatctgtaggctcagatgctccctggagttgatggcaccatcacagctgttcagcagaggcgtcagctttactcaggcccactatcaaaattacgaatgttgatgatttgtcggatggcaaaaccagaggaggtactgattgtggaagatgaaaatgggaatattgtacgtgaaacaatgaaagacaacgatgttcttgtccagtataaggttagtaacagaatgtgtagctattttccacccctgtacacaaattgtgtcacatactctgtgcttcacctgtttaatttaattgtcaaacttatgtgttgcctcctttctttaattaattgttttggcagattatgagggaaacactgatctacttgtctcatcttgatcatgaggatacagagcagcaagtatgtcctgtctacagatattttcattaaaaaaacacatgctataaatattatgctttgttcatgctatgtgatatccattgaatttgttccatttctatgttgagatagcgcaagttgtggcttaaacctgacttcaaatgatgacaacacatggctttagtttgaaagtgcctactgtaatattagtagttagtaagctacttgttggtcaaagctcaattctgtgtaacctaggaaagttatgtgagcaagctcactatgtgtagcccaagagcaattaaaaatgtctactttttcgatataattgttgcacaatttctccatctggtttagtgctttgtacgaagttaaaccagaaaactacaaatttgttttgggatcccagatgctgaagaaattgagtaagcaattaaatggagaagactggagttggaataacctcaatactctctgctgggcaatcggatcaatatctggttctatggtggaggaacaggtttgaataatcatacactgttccattctttttgtctttggcaaacgttaaggaggactaatatttagctttgtgataattttgaccatttcatgcagtgctgaaattcttaatggtttctgtggatctttttcaggaaaataggttcttggtaatggttattcgcgatttattaaatctctgtgaaatcacaaaggggaaggataataaagctgtgattgccagtaacatcatgtaagcattcatctcaactacccatgtttatactaacaaaattaaggtttgactgatctgatgattgctttgttaggtatgttgttggtcagtacccaagatttctcagggctcattggaagttcttgaaaacggtggttaacaaactatttgagttcatgcatgagatgcatcctggagttcaggtcagtgtgcattcacatgtagtctgttgtgttggtgcagaatcactgttttgcagcccttgtagtgtggaacttagattggaactgcttgcagccatctttccttccatgatcttaataacaagttactcatgtatctgttgtttgatcatcacacacgctgtttgctgctatctccagtttgtgcaaatagtttaatgcctcaacacttctgttagtgttgtatgtaatgtatgccttgctctgctgattgcaggatatggcgtgtgatacttttctgaaaattgttcagaaatgcaagcgca

SEQ ID NO: 55786 - DNA, 731 bp, Oryza sativa
gcaactgtagatatcctgtgtggaaagaagtggcccacaaaagttaaggacattttggaggagcagcaaagacgaaccttggggcaaagagcagcatgttttgatttcccttcgatgaagtatgaggtcagcgagcaaggcggagtcacggcggctggggttcaatggggtggacgtcactacgtcgtggttgcgagagataacacatgtagttgtcagttccctcagctccatcacttgccatgctcccacatgataaccgtttgtaagttgcgaggtttggatgtggaggtggccccccgaatgtgttatgaagcttccaataaggctgtgcaggactcgtactcccctaggtttgaaccttacctagatccatcgcagtggccaagttatgatggagagttcttcgtgcccgacttgtcgttaaagaacaacacacgaggaagaagaaggacaagaaggttcaagaacgatatggacaaagcatacaaaggctcagccaaccgacggtcacaaaagccgaacaatacaaattcagagccggtcatgcaaaatagatgctcgctatgccacgaactaggccataagaaaactaggtgcccgaagcgagacaagtctaaggatcgaccgaaaaagcgccgtacgacagggggaggtggtgagggtagcacacaggtgggattggatgacattcatttgctaaagtcatattggtgcttcaatgttacttt

SEQ ID NO: 55787 - DNA, 7369 bp, Oryza sativa
cggagggagtaccaattaacgttaattgataagaaaattaattttgtcctaataatattgtggttcagtttaatttcacatcgtatgaccacagtgataaaatctactagtgtcttaatagagtagagtagtacatatttatctattgcaatatatgcttattggtggacttggaccatcgctctaataatttaaactagtgatagagcttagcctgatcatacaaccacacctcaaacttcaccaccaccggcgtgtgggagtctcttttagcgtgtgaatggcttttgttgagtgttgagctcggtcgtcctgttcttgacttctcgtctacttacttggtagcttagattagttggtggaatgtatgagtatgatagttgtgtggtttttaccccgttttcgctaattaattctgtatttatggcatgatcatgttatctccttaaaatggaacactcgttctttatataaaatgtcagcaacagtctgaccgttcggaaaaaaaaaacaccaccacgtactggtgatatagttagcgctatatttttattatgaaatagtattgcccgtaatcaataaaaacacttgttaattttgtaggctcgaaaatactatttttatgggcttgatgatgacactggctctgcaacaaaagtaacactgcgactagtgttatccatgtcgtcaaaagctagctggtgcaggatgcctcgtgtgatcttctcccataccttgccagtgagcaaagatggcttccctgcagtgttttttgtttttatttttacgcgtgctcgcaaacaaaaagaagattccgtgaaatctatcgcaattttccctcccctttcattcaccgtactaactttatcttctctacagaaatttaaaagaaaagtatttcttttctacatacaaatcaatatttcttcgtcgagcgtgtcaggaaggaaggaatgttccgtgctgcctaaggaaccgctcccacctttcccactgacgcgcggggcccgcatcgccatcgccgcgtggtggcgcaccattcgcgtcaccacaactaacctcctcccctctcccctcgccgcgccgccgccgcctcggctcgatccgcccatatatttcccacgcattcatcgcgtcgtcttcccatctctcccagatcgcaacgaatccaatcgaatccaatccgaattcccccccatctctcctctcctcctccaaaaccctaacccccactccccatcggagagagatcgagaggtggttgtcatggcggagtgctcctcctccgacgactgggtcatgctcgactccgacaaccccgccgactcctcctccgacgacgactacgtcctcgcgctctcttcctcctgcaacactcccgcctgctccgacgaagaggaggaggacgacgaggtggggagcgacgctgacggcgacgacctctacggcggagaactcgaggaggaggactcgccgcgcccgccgccgccgaggccgctctcgggcctcttctaccacaccgcctccgacaaccagcccgggtacctcgccttcgacgccatccgcagcgccaagcacctcatccccgacccgcgcttctccgccttaccggagcacgtcgccgtcctcgcctccacccgcggcctcgtctgcctccgcggcgagaccaccggctcctactacgtcgccaacccggccaccttcaggcgggtgcgcctccctcgccacacccgcgaccacgtcgaccccgccgtcgtcatcaccttcgaggagcccaccgcctccgcctcctgcttcggcggcatcggcgtcgagcactaccacgtcgtcgtcgccttcaacctcgggggcggcgtctggtccttcgagtccttctcctccaggacatggaagtggcgtgtctcccccgggatctccatcgtcgagcaggtcgagtccttctcaggtgtcggcgcccacggccgcgccttctggcgcacctccatcggcttcgtctactacgacccggagaagggctacccccacgagttcgccgcgccgcccgaggtggaggcccggccgttctgggagatcggcgagatggagggcaacctctgcgtcacctgcatggaccagcgcgtcaccgaggtggcggtgctcaacctcgacatggacgtcctcgccgccgatggggtcgggtcgtggtcgtgggccggccagttcgagggcagcagcctcaggaaccgcgagggcgtcgagctgctccgctcgcagggcatggcggaggtcgtcatgtgggacccctcggaggagcgcgtcgtcgccatggacctcgaaggccgcaccacccgcaacatcggcccgctcacaggcgaggactactcgagaggtttcatcccctacgttgcctcaatcgccgaaatctccaggtacctagctactggctactgcattcgattcgaatttgccgctcctacttgtgaattaattctgtgatgtgttgttaatcttctgcatccgattcgttttgatttgccactcctagctacttgtgaattccgtgatgtgttgttaaacttctgcatccgattctatttagcagcgctactcctgatgtgttagatcgatgcgatcgacgagtcaattggagtttcgtaccaattcgtcaattcgtgtattgctatcgagttggtttggatctgtagcccattcctgattaattggcgattagttaggatttctgtaactgctacgtacgcgtcgtttttagctgagtttttgcagtgccagtacgttttttgagttcgttatagtcagatccagacaatactcgcaggatagcttgtgtatcgaggctgatatcagcctactacattcccaaacgaaacgtgttgttgacgctttaaatcgaattgggatcagttgtctgtaactgctacgcgcgcgtcattggtcagtcgttgtctatgtctagatgatgcttgtggagttgtgatgtactgaaatgtggacatggatgcatgttactgtggagtggagttgagtggagctgatagacaatagataagatctctgtttgaccattccaatggcttagctggtttgattttgtcagtcttcaatagactcccaaagtcggtctccttacccgagtttaattaatcaaccgatgataagatttaatggaatgagacccggcaaaaaagataagatttaatggaatacattgtttatgttacttccatatatgatttgttattaatataagagcacaacacactggaatcatgcattgcaatttagtttagttaatgatccaaattcttactgtattaaattgtccgatgtcttgtttcccatatgtgtatcctgtacatatatatcctggcattaccgcattagactgagaatgagtagagatcgatagctcgtcctgctttgtcatctgcttaggtgtagacattttaccattaattgctgtctgtttcattgattacttgaaaaggtgcacaattttgtgataatagtcatatctatttcgttacattataattaaatttctatacccatttgtatgcaataaatcatgcatgggcaaaatctgtactgtactgaatgacaatggtttgcacttgtgcttttgagttaccagaatttggatagttcaccattgcatagtctgagtaaatattcagagcaacaacttctaatgctgctgcaacagagtaacaagtactctttagctgaacttttctgcatttgtgtgatacatgattagttggtcacggactgtcaagcgcatgcagctttgcattcgttgatgttgatgtgttatccactaacagttgtgtgctctgcttatgtttatgttgtcagcgatcaaataagttcaaagtgctctgctagtgctgctgatgccaacacgcccaatcttggagcagcagatgcgaccacgctcaacaacctcgccgcacctgctgcgcaagttcactgaagcttcaactaatctgtaagtcgtatcgtatctcgtcaattccaattcagacaaataacataacctgattgattgattgataatataatctatctgtgagatatgatgatactctgtttgcattgcaatttatttatcggtggcatgcatggcttggcaggtaccaatagctagcaggcagacaggaagattcgttgacgatgaccaggaataaacgaggctagctttcagattgatttgtccagcataaaaaggaaagcgaaaaggcatccttgattgagtggcaactggactactactgccataagcattctttttgcagctactccgtatcggatatgaacactaagtatctttcttgttaggttttgcgtctgccttgtaaatattagcagtagcaggctcccttttgtgtccgtccgtcgaactatcattgagtccttcttgagttgcattcagtcagtcagtcagtcagtcaggtccaaactagttgatcgagtgggtaaactttgaaactaccaccgtctctggtgttcctgatatgtcattctggctgggctatgcaattatttcttttgcttaacccattcattcatttttagtatttcctttttgttattccggttgtttctttgctgtttggaatcaaccacccagcaatttttgctttcctgggttatgacttcttttcactaggaataggaattaccattttgttgtacagcgctttgttccatcttccatggactgttgtttgctttgttccatgtactgattgctgctatacaggagaatgagcttcatatgcaccctgtaattgactggtgcaaagcttgttgacgctgcaaccccaataattgtttgagatgtgtagatggacaatgctaatatatgtactatgcttggtgcttttgatttggttttaccaatcctaggatgtattgcggacattgcctcctcctgttgttgttgttagttcttagttatataatgtgaagcgagtaaaagtcagtcagtcaatttcaggaaactgaaatcaggagatttagtgaagaaggcctgattctacaaagcactgttgaaatctacaaagctgctttgctcaaatgcaaagcagatttgattgatttgagatattgaggtctacggagtagtggcttgcacttgcagcggaataagctgcctacattctggaatctggagattcagatacctcaggtacatctccaccgcgcagaccacaacgtaccacatgacacagtgccatatcaatcgtgacaacggaaagcccttgcaactatctaaaatatgttgttcgatgatagtttcatcaaaatttacatctatgaaagttattctagcaaattaacatggaattttttttttttgccacagtcaacaatagacataatatcaagcacaataactaaagcttgcgcataagaggctacaacttgaaaagatgatctaaggtacgtttatacctaggtagtgtttagcaaatgggaaagggaaatgatttcccagccatctttaaatcctaacaattcattcttcctcttccatttaatcctaacccttcattcatttcccaatcccaatcccacccccatttcccattatccaaacacacccctacagtatggagaggttgcaataaggttgcggcaatggagacgacgtcttttgtgtgggctcctaaatgagtaggtgccatcagaggtggagcattgccgatgtcacgaggagatgacgacgatggtagtggaccacgagacgatgcagacgataagagaaggctaaatattagtactactataaggaagatgactaataagagggaaggaaagaactaggaagggattacgtcaacgattcaacgcctctacacggtctttttctctttcctctcttttttttaaggcaatgtgcaacttgctagggaatcaaggaatccaagcgcttgcaatggttagagttggctatgagctctataaaagagtaagaaaatatgtcctaccacttcctcaccggaggtgtgttgggaaggaatactatttaatacaagaaaaaccaattcttcgcaactaaaaaatatcccaaatcctccatggtaaggtgtgaactaaaaggagaaaagtgctcctacgtcctctacgttacacacgacatgcagccttacaaggaagagtaatgcactgttcatagaaaaaaaaacaaagcaaagaagcaaaaacttgcactgttgatagaaaaaaacagggagagaaatggacagtaaaaagagcaaagaagagaacttgcattgttcatagtaaaatattcatagcaaaaatatggcaggaagaagagagaaaacttgcagtcttgcactgttgatagaaagaaaaaaaagaaaggaaaggacagtaaaaaaagcacagaagaaaaaacttgcagtgttcatacaaaaacagggcagagaaggaaaatgttcattgcaaaacagggttaaaaaggaaaggaaaatgttcatgcaaaacagggcaaataaaaaaaattactacgcgccaggtaggggtcgaacctacggccttctgcttaggaaacagacgctctatccactgagctacaggcgctgttgtttacttgagagcaaacaattattgtgacaaatactcttttctccaaaagaatcaaaagttatgtaccgagctaaatctcctcgcatattgtatcggttgcttttgcaatggaaaatgtcgtctaaattcgtttttcagatatatggcggcagaaagaaatggcactgtggagattggtcacagatagcactgtgttcttttctatggaaaatgtcgtagacattcattttccagagatatagcggcacaaagaaatggcactgtagagattgatcacaaatattagtatgttattttcagctctttttagctacctcaccatacggatatgcatagaccacttgttccaagatatttgataattgttaaaaaaatatttaatttatcctacaatcaagtagataatccgatgaataatatatttcagacaggctgcaaatagaagagaacaaatgcaaaatatcttcatactgggaaatagggtcaggtggcaaagaatgttcccctctctaaactagaaagtcggccaattaattcagaaaatgtgcctctcctcaagaaatgtttgtccatttccttaatatgtgagctcacatggcacaggtgtttatacctgatgtctgatgaggtgcttttcattctgatggaattcggttgcttttgcagtgcagtgcttgaacgagacccagcctggtgtcaatcaccgtttccatgtttcctcgggtcaccatctattttgtcctgagatcttccaaaacaacggaggcagcgt

SEQ ID NO: 55788 - DNA, 3218 bp, Oryza sativa
cacgcaaacagattacctgttaggccaaactccctttcaagatcaggtggagtcagcatatcatagcctaccactgatgagctaaaacccggtgcatattcatcaatcaaggaaaagcatctttcagcaaaggatttctgaaaattggtttcaattaaaatgtcaggggtgcctctctgtggatagtaactggtgacaaacaataatgcataagggcatcatcatcatccactctgttcgattaaggagaaaggcatatgtgggaaaacatacacagcaaaatctgtgcagccatgaaagcataaattaaacgaagtgcatcatgacatcaaacttcaagaaggaactacttactctaacattagaatcctgccagctgccttctgaaagtttgtatggtgtgtactgaacaaaaaggttaataacatgctggcctatcaaaggataaagcaaaggatgaacattgattcagattatataaagcataagaagaaggtgaggtttcacagccacatatccaaattaaacttggattttttggggggtgaggaaaattaatcttggatatatgaactgtagggcacaattatagcttatacaaatcagacaccacacttttatgcaactgcaatgctgggaacaagaaattggcatacctggtggggagatggtcttatccaacacagaaggaatcgtcatttctataacaggtcttgtggatgagacgccatttgcagcttccctgtacgctagatcgatttcctccatgctggagttccagtaaagttcaatatgaaaagataaggataaagttcaataacatgaaaatataaggatttgcatagagaatccaacaaaacgctacatcatccagtagtttccaatcaccaaaataatgagaaactagcagtaggctgcatgatcccagtcaaatgtatttgacgttgggagaactgagattagtttttccaatgtcaaatgtttttgactagatgtagtagtatattaccgttaacatgttcagattacactcagtactgtcctaaggtactaatggagacatgatatttctatatacacgtgcaggtcatcgatttggtacatagaattgagacaccaagtgtatagtatttccaaagtagaagaatatgttaacggaaagatgacatcatggaattaagagattatttcacttgcctactcattactcatgttggcaaccaatctatactacacaggaacgggaggcaatataaaagctggtgtctcaaagattttcaattgtgtacagctacaacagaacaaagattaacacaactgaatgcaataacatgccgcagatcatcatagttgaagtagaaaaggttccataacttcagtaacctacctttcagatccaatgtgtatggtgcccatgtgttctggaccgccttcaggattaaagtctttgcaacaggaaaactgtggcagcctgtcaacagccacattaattttcgttgttgcctgctctccacagaatcatattacattgttatcaatcaatattataacacttatttattatgttatgcttcaaagtacgttcttacagagctataatctgcagttttgatagcagagaggaagttgtctggaagaacattggcaggcactaggtcctgaaaaggaaaccagatatcagtgtacaaatatttgtttcattgtgtctacaaaattggaacaggtattatatcttcacgttgttatatattctgagtagctcttaccacaaatgttctatatggagttgcatttgataaaacaactgatgtcagcacctctgttccatcagccaaaactacctacaagttcccataatttcaagaggttcaaagaaatgaaataggagtaccatttatcggttagtcaaagaacttaccccctgtaccttcccagaagtgtgatgaacagatatctgggaaacctatataaaaccactagagtgaggcatgttgcttaaacagaaatctgggtgcaggataataattcaccactaaataaaatttgaccttttcttgtagaaaaagccagcattttacagctgtcaataaatagttactcattttttctattcaaatttgaatgctgctccaccatacgtaatcaaagaggtaatatcatggcataagaagagaaaatgcacctctgcatttgttaaaatttccacacctgcttcaagagctgctttgcttatagctgacgatactgaacccataccaccttcaacatacctgaagcgaatgtttttgttttaccacataagtttttcaacaagcaaaataagaagaatcaggaaaccaactactaatgaaccaacaatgctaaaactagcatatttggctagaaaccatatgaccattatatggcatttgccctgtttgactagacagtggagatatgcgccagcaaaacaattcctgatgctagggccacaaaggcttggacatggtttcaggcctagaacaatgaaggacctattatttttctgcgggaacagaataacagagagaagctcaggttaagagtcatacgcccatactccacgttggccaccagtttcccccataacatgatgcagaagaacataaccagatcctggagtgtggacaccagcctgtagaaagtccatgcagcatcaaatgctaaaccattaccattggccacaacacatttcttggttcatccaaagcacccttaccatagaacctatcacagcatcagtcgcaagagttgccttcaacacatcaccctgcagttaaaaaaaaacacaattgtccatggttacaagaaaaacatgtgaatattgtcaattcaatagtgaaactccacgttgcttcatatgaacaatgtgataagaagtatttcagagaacgggtaaacaagatatcaacctcaaaccagttgttcaagatcttggatgctggtgaaaggagaaggtcaaagaaatccctgtgaataacatatttccaaggaaacagaaaaggaagattaaagttacacatagcactgtcgagtcatggtgttgatggtggcatttgcaaagggtcagtatttatactcacaccatgtccttctgcccctgctgcatcacaatcccaagaagtttgctccagaacacagacttgtcaaccttatccttcatcctgtccaccatggagaggtggtattcatgcctcatc

SEQ ID NO: 55789 - DNA, 3534 bp, Oryza sativa
ccctatcaagaaaagaacccacatcaaagctagcagcatcagaattcagttagtacagtgcaatattataacccgcatttgcagaatgattacagaaatgcatatgaacacagagctgtgggaattccgattgacaaatagtatttgggtgggtagggggggttttactggatcagggcggggcggaggaggctgaggaggtagctgcagcgggagaagcggaagcccgggacgaggtcggactcggagacggcggcgccgccgatgacgccacggcgctcgagcacggcgacggagcggccggcgcgggcgaggtaggcggcggcggcgagcccgttgtggccgccgccgatcaccaccgcgtcccaccgcttccccttggggaggagctgctgctgcggagtcgacgacggggcctccgtcgagaagcggcggcgttgacggcgggcggccgatagcaggaggctcctcgccgccggcgacattgggtttaggggttcagccgccgccgccgcctgcagccggtggcgaatatttctctttctctccgacggcttgtttcgattacgtctacgctactagggaggcggatttctggattacgtgtctccagtctctgcctctattggctcatagtttgaaaaaggttattccgaccatatcgtttttggctatttatattttttgttttttaatttctttatgtattgtattaatattgacattgaatagtttaaatgataaatatagtcaattaccgaccgatcgagtatcgtttttaaagagatgctactaattccgaccgttttcactcaagtgatgtgctttggtagcaagtacaaggtattatttgtaaaagaggggggggggggtttctcgtcgtttgccctatgacttataaaccgataccaaaatatgcactaaaacataattttgatgttttttcaacgtagttttcttagtttggatttaagtcgctaaaatacatgtgcaaaagttttacctataaatcatttttagtcgctaatcagtcgtaagtaaccaatcgatgtggattgtgatgcgctggttaaagttgatcattcatttgctattgataaagttatggtacacacgacatgattatattcaaagttaattggtgtgattttgcatcaatgggatattcaaacttattacggaaaaattcagccattcttgacctttttgtatttatttatttgtttgtttgttttccaaggctgggaggaaaagaaattgcattgtacaggcatgctatgttgaagaactccaaggacataatgtgcaatcaaacgaggtgaatgagtgtgaaactgtgaatagctttagcttaggattccagtggttgaaaccagggttcaccgtaccgccggtaaccgcgcggttaccgcggttaccgggcttaccacgggggtacggtaatgtaaataccgcggtaacctcattaaattcaaataaatttaaaaaataatttgaatttttgatgaattttgtacggtttttcacggttaccgcggttaccgcgcggtaaccgtgcttaccgttggggcacagtaaccccggccccgacggtttgggaaaccctggttgaaaccaatccacagaattttagtaagacttagcacgggtactcatatttaaaagcaaataaattatacttttaaaaacaaaaacttgacgataatattgtaaacaggtgccgccactgtcatctactactctatcttctagtaatatttaacgttgattagtaagaaagaaaattaaaaacgaaggagcatttttcttttaagaagcaaactaaaccaaaaaaaaacttagagaagtaaccaaccacagcacaatacactcacataaacagccttggtcaagtaaaaatggtcgcttattactgttggtcatttagcagtttttacactaaataaaaaaccatattgccattcttcagaaaaggtcccatggtctagcggttaggacattagaccctgaatctagtaacccgagttcaaatctcggtgggaccttcttttttcccctttttattttttattttttatttttttcccattaaaccttaatgaccttttttactgcaatcattaaccgaggctgttttaatcaacgggcaagattttccaggatctgatcagacgtgacagcaagactttgactgtgcgagtcaacttttgatctgatcggtcggttcaggcagccgcgtcgcgtcggctttgccttcgcgttcgggtcggaccggaggccgacccgtgggtacaaccgtcatttcgcccgtaagatatttttaggacactgtcaggacacgccgacgtcagctgggccccacgtgccgacctatgcacattttttgctccgtgtcccaatatcacccaaatcctggtgctcaatcatcatattgccgaaagcaacctctcctagtgtactatatatatatatatatatatatatatatatatatatatatatatatatatatatatattctcttgtaataaatctatcatttagttattatgcttttaatataaaagttgtttggaaaagaatcttgcaataatgtcactactctagtcatgagttatagaatatatatggatggatatgaatatatattcttctacaaattttagatatgattttgtggatctggtgcgtgcaatgatagatggtgatacaaaattccactttgtttaatctaaaaggaggttccactttattttctataaaagcccctaacaaagaaaacaacaatgattatcttgactgaaatgatatggattaccatgtttaaagtggatcctttttctatacaaagtattattgatatctaaacaagaacatatatacttaaaaactcaaaagctaggctatccacaaatatttttatgagtagagtctatccacatatttttttcgctaaaaggaaatggaaaatgccataacagattttaagaaaactagcaataaaatgtgaatttttcccattaaatagtaaatacaacataaattccatcgctagccaaaacgatacaataagatttgctcatttacttggaaaaaatcctctccaccaaagtgaaaggtgaataaaacctttcaagtatgtggttgtggttagcattgctaaagaaagaaacacatagtcatcaaaattgatcccccatccacataaaaagtgcacaagaaagggatgctcatgagctaaagtgaaaatacacacgagtgcgtgctttacaaagaatatgaacattgcgtgcaagaaacgttacaaatgaaatggtgagacaaaatgtgctccgtgcatacgtggtggtgactcacattcgtatgaatacggacaaacaaattcatgcttcgtgtatatatactagttgcaaacgtatcggcatgtaagtaaattaagtgtacgtgcttagcctaacttagtaagttaaccacactaaaaaaaaatgtatacgctataagcgtgcgtgacacattgctacgcacgcaaaacca

SEQ ID NO: 55790 - DNA, 1529 bp, Oryza sativa
ggttggtggaaaagcatggcggcgccggatgttgagtaccgctgcttggtcggcggcctcgcttgggccaccgacgaccgctccctagaagccgccttctccaccttcggcgagatcctcgagtccaaggtccgatggattgattccctcttctctgtgtttttttggatgtgatttggtggtggtgttcttcagatctggttgcgtagatctgactatgggggttgtggtatgcggtgcagatcatcaacgatcgggagacggggaggtcgcgcgggttcgggttcgtgacgttctcgagcgagcaggccatgcgcgacgccatcgaggggatgaacggcaaggagctcgacggccgcaacatcaccgtcaacgaggcccagtcgcgccgctccggaggcggaggcggaggcggctacggccagcgcggcggaggcggaggctacggtggcggcggcggctacggtggtggcggcggcggtggctacggccagcgccgtgaaggcggctacggcggtggcggcggctacggtggcggccgtggcggcggcggcggctacggcggtggctacggcagccgcggcggcggcaactccgacgggaactggaggaactgagcggtggggccctcatggccaagttatctatctatctaatcgagctaccatcatcatcatccgatcgttatcatcgttagttttgtgtggaactactatctagtttgtgttactgtgtggttgcccatctgtgtttttgatcgcaagaagaaagctcgtctcgtgtttgctttgatcaaatgaaatgaatgaatgaatcttagtgtgctccgctctcgtcaaatccatcgaattatttaatttgtcatggttgtgaatcatgggggttgatactatttgttgttgatgctagtgcaaatgatcatcatcatcacgatttgatgatttgctaagcataagcagcatcattagctaccactcacactgactgtgatgaagctgtgaactcacactgatgctactactgaagcgtttgtctgatttccttacgattggatttgttgctaaacagcatcgttagctagcagcggtgacagtgatgagcagtgatgctgctggactagagatctgctgatctgtgtacaaatagattggagcaaagcttttgcaatacagatttttcttcagtcgatgagaatgccggcagcgatcgatggcctccagcttgagcacttgcaaacaaaaaccacagctccatctatccagtttccccatatttaacaacacttgaaacagtctttgcaattgctaatcttagaagccatgattgccacaaactatgttttctttgctctaattttagcagagttacagctgaccaggtgacgcttgttgtgcccggtcataatacaattcagagaacatgaccatgagatgtctctgcgacagaagctcggcctagcagtgtgaatgtgtgatggtaagatttgtactgtgttctactcctatgttaatcccggggatgtatcggta

SEQ ID NO: 55791 - DNA, 5816 bp, Oryza sativa
catgtcacaatatataaccctgtaacaatcctagatttctagtttcttttctgtgtttgccactcaaaagcattaaaggcaaggtgcactctcatgcttctgaagcaatcatcaaattttgaaagtaggtactgatcagtgtcatgtcttaacataataatagcatgttaactgaataataactagagaacttcgcgaccaccttatgctgtccacccaaaaaaaaaaattgaaagcagtcaagcctactaaagtactatctattttttttcgaaaggtgctaattctacctattatattgccagaccatgtgaggtgaatttcctacaaaaaatgttgatctatgtgaatcactaggcactccatggcataatctcacattggaaaatgtttgttaaaattgatcttatggaactaaataagctagggtgctatgaagataacatattctagagcatgtttgagcatattctggagcatacttcaataccttatacttgtagaggttaagagaagacacttgatatcatcaagcagataaaaaatcaatatagatcagtaaactcacactctattgactaaaatgatgaatccacttccaccattccacatgcttcagtcttatgttacatgcacttaaattgatacgaaaattttcagaacactacagccagtatgctctcggagacttccttttttagataatggtatgatcccggagatactatagcatttaaatgataaatcatatcatcatcctggaatttccttgtgatgccatatttataacttgataattgacagaaggagaggttgcaatgcaatgcatacttgtggtacttgatggtcttgatcctgaagccaaagtgtagggctaatgacgctggtgtcatcaccattttttcttagcacaattgttgtcttaccctagttgtggaggccactgtaaaattcttcacatcagtgatgtctccaagaaaatgaaaggaacaacaagagcaaccaaaccaatggtacaaagtacatataaaccctggtaaatcaagaaacatactacaacccaggaatcaagaaaagcatcagcattggaagctggaagaggaggggaggatcagcttacaccatgagaatcctcatcaccttcttctcctttcgcttgatctttctgattatgctgagcagacccattctagagccggcacattcacacagcagaaatgactctgagccacactctagctggacaaacaaggattagaattcctcctatctgtaaaccaaatcttgcgcgctgcaatcagtagtatctgaactaggaatcctgacaagcgagagatgacagaatcggtgcaggaaacaaagaaacggaggcgaagagggagagggcactgaacctatcggagggaaaggggtcggatcgccggcggcggcggcggcggcggggggagacatgagagatggaggaggaggaaggcgatggatacatgggctgatgttagaggcccggacggttcattgggccgtcggatttagtgggcttaatgggctttgcctgtgcctttaaggctgttttattttgaacaattttccaacttctattctctggttttgacacgtacataactgctaaacggtgtattttttttaaaaaaaatctctataaaaagttattttaaaaaattatgttaacttttttaaaaaaattatatctaatacttaactaatctcgtgctaattcgtcgttccgttttgtatactgagaaggaagtgttcccaacaccaatgaacgaacagaaccttattacttgcatggtaaaattgacttaattattagtcagagcattttaggagcaagaatatatttagtttttcatataatctttgttggtaaatcattggtaacatctaaatactgatattccgattgattctcttcatcgcatttctttatttttatctatggacatacacatacttactggaaaaatgtaagtttatatataaaaaagcctattagcttgacatacaagcgtgtagacatatccatgtactatgggtcttcaaacgtatacaacgattgtaattaagcttgctcaggcttcgtaaaattattgtctctgccactgattcaaatacatgcatatattaataataaggctagggaaaaaaaaaggactgatagatattggggaaagttcttcgcgttctacactacgaggcagttcaaggcgtcgactatcacatcttttggtctccctcatccagaccatgcttctgcatgctgcacaaccatgtgtcagttatttatttttaaaaggaaaaagtcaagtaccccctaaattttagatagaaatccgtgtggagataatggataccccatacccacatggcatgtatatccgactagatatgggggtaccatatatggatacaatatctttagtaaagaactcggttgttttcctaacttgtgtatgaaatatccgaggattctagtcggttacgattgcaatttttatttacttgcatattctgttaggaacatgtgttgtatcttgtaatacggactcctccccctatataaggaggggttcgggtgcctcttggggcataacctttctctcatatcatacgatcaataatacactcggtggatcaatccccgaacagaagtagggtattacttctcattgagagggcctgaacctgtataaaccttttgtctcctaacccatccacttttcctgcttgatagccaccccctttaagtattgccgaaatattgtttcgacagtccatctagcaccctaaattttaaaaccggacgtccaaccccttaaactttgcaaaaccgttcatgttaacccctaagatggttttggatggtggctttgtatattttaaaatcttaaatgaacaactttaaataactaatataacatatttgaatatcatcagttgtaagtcattaatttatacttatacagtgatatcatacgattattatgttggtacttgtttgtaagtaagagctaacaactggtaaaatgaaagatttaagtggagattataataatatatcccctctgtcccaaaaaaaaaaagaccaatcctacctacgaacctagacacatatgtgtgtccaggtttgtagctaggaattcgtttttttttacagagtagtatatgtccaatgtgcatggcacatgatcaaactcatccaatttatacaaattagataaaaaaatcactatacaaaaccatcttatgaggtaatatgaacggttttgtaaagtttagggggttgaatgtccggttttcaagtttagagtgctagatggacttctatctaaagtttaggggaggggggggggtggtatttggactcctttttaaaatgaaagatgttgaggcatagtttgagagcatttctagatcgagataagttttattggtgaccttttgtcatagtgttctcataaaaatatgcttaaatcattttctcacagttgattaccatttttgtaatcttttcttcacttcacatatattttctagatctatgataccgctttattagttattttcataacctcatatttcacttaaatatcattctataaaatcccgcaacattgcacgaggtatcatgtaaataattagcaactcatgactagtcgatggatcggttgggggcgttggttgtggcgtaagcttccgatttatcgcgctagctagctacggggatagtggcttcaaaaagaagtgcatgtgaaggaaatggaaagaaaccgccctatcaatacagtgtatatgtatcacagacccagggttcgacttaccgtcggtaaccgcgcggttaccggccttaccgcggggtacggtaatataaataccgcggtaacctccttaaattcaaataaatttaaaaaataatttgaatttttgataaattttgcacggtttcgtacggtttttcgcggtaaccgtgcttaccgccggggcacggtaaccccacccccgcggtttaggaaaccctgcacagaccaaccaacaaatgctacaactccctctgtctcattttaagtgcagttgtggatttccgtgtccaacgtttgatcgcccgtcttatttgaaaaatttatgaaaaaaattaaaaaaataagttacgcgtcaaatactattaatgttttattatctaataataataaaagtaatgataaaaaaattcaaataagacggacggtcaaatgttggacatggaaatctataactacacttaaattgggagggacggagggagtacaactctatgtgagagtgagatcagaaatatattagtgaaagcaacaataacacatccatgtcaccccttctgaggcatcaaaaggaaaggggaccagttgatgtgtttgaatgtaagcttttgtgaaagagatcattgtgcagcgatacgacaactaatctatgaagaatagtattgacagagaaacaaaatgtacgcattaatcgccttaattttcactcccactattcaggaaatctgaaagatgctttcaggatcaccatttatctgttgttctagtactacaaagtacaaaaccctcagtaacataggcattcagcatgccatttcgatactttttttttccttaagatataatgcaagcttttaatcaagctgatacaaccacacatactgttgttatgtacaacaaattcagcctatgtagaacaacaggtataagaaaaaaaaatcaactaaaagagttaatttagttgtacaaaaagtgtagcagaaaatattagttatacagaaatcaaatattatgtgctcgaatcctaccagtagagagattcttattgttgcctgagtatttactctctttgagacaattttgtaataaatggttatagcttctttgaagcaaagaccgaaatttttattccattatagaaaaaaaaaaaaaaccagcagacatatgagattaagatggatccgcatccgggtggtcctgactcctgaccctgaaagacaaccgctgggacagtgtctgcatcctactccaggatcaagagttgtatacactaattgtacactaatccaaattaggacaatgtgagcatgcagtgggcacacctaactacacatggcattgacttgagttgaagtacttcaaatatttttagtaataaaaagactactcacaacaaaataaatgaaaattacatattttttaaataagatgaatggtcaaacgtgtaaaaaaaaaatcaacggtgtcatctaataaaaaacggaggtagtatgttctaatgttcacaaaatcacagttaaggtaaaaaatatatctagatagaatgtatgaaaagcaagcacatcggtagatttgctttttcataatttttgtttttctcataatatttagataggatatatgaacagcaagcacataggtatatttgagtcgaaataacttttagattatgggtttgacggtcctttattattattattattattattattattattattattattattattattattattattattattattattattattattattattattattattatatgaagggaaaattttcttatttttttaatcaatttataattttataattcccacttatttacccgcaaactctactataataattgactaaagctttgttgaaataaaaaacaaaatttatttatcgaaaaagataatgattggatggatggagatacatgcgtggtcctgcgcagccagcactgtacgtacctactccctccgtttcgaaatg

SEQ ID NO: 55792 - DNA, 8297 bp, Oryza sativa
tacggagtatatatattaccaactccaggtctccagcgatatatatggaaatggaaaaaaaaatcttatctctgcataactgcattattttgctagctagtggagtatatataaaatttaaactcgtcgattccgagcagagccatttaaatttcatatatataaaatttaggatatcgctcatccctgaaaatagaatatatttttctagctagtgcatttcatgtttcgtctccattcactggctagggtattgtactattaattgttatccaaatcatgcagatatatatggctttgttctaaatatatatacatatagatatatatggcttgttaaaaaggctaaccgagtttaaaaatatggtcatcccacgctctcttgtccacatgccaaaattgtcaagcgcagggtagttcattgacgaagtcattttacaatagttcgtatgcaaaccaccatttaatttttattatttttttaaaaaaatatactcctatctgaaatgcaggggaaggcatattttcactcgtggatcttgggtcatatatatatacagcctaggacggtaggacctatgttattctgttagaactcataaattaaatagtaccttatggatttaacttccagcttattgagtttatgcctaattttggttactaaaaagaacataactaaatgctacgtactgtaccaatgatattgatgtgtgcactaataataattaaagtatgcaagcttcacctgcactactactttcatttacctggcttttgttgacatgaagaaatataaataattaaataaagttgagctgtgatcttatggcggcatatacgtgcttaattagtacttcctccgaatttcctccgtttcatattataaaactttgtagcattgtctacatttatatatatgttgataaatttagacatatatgtgtgtctaaattcattaacatatatataaatatggacaattctagaaagtcttataacctgaaacggagatagtgctcacttaatcactcacttacgccaccctcgacgttaattactagctctctagcttgtcgccggatgacaaccaaatgcttaattaattaattagtaattaactagacaaggattagtgattgtttaagcgcaagatttgtcctgcgattattggctcgaggtctttaagctagcgcctgctgcatgctgattggattggattaggtagtaggagtatagattaaatctggggccagcagcatccagagatcgagttgatcatgcgtatattttacatgaccatgactactctgctcatggttagtgcagtactttgattaattagcttattatattcgtctccaccaattaatttaagggattcgtcatgatacgctgacgtgaccgattgatcgaatatgcatgtactccatgtatttgcagatgtcagtgtgtatttctttttacatatgtatatgtggacttataatttaattaattcatctcctttaattagtcggatcgatctgttcacgcattcattcgacgagatcttcccctgcttgtttttttctagtttattatataattcaaggcatcttgattttattggttaatgctagctagctgtatcgccaattaatcagttcttgaaaaaactgcatgaataaccaaagggatatggcacaagtagcttagctcatggttctcccaagcaaaaaatgttgggtgtgtttggctgcgtgttgcagtgctgtttggcagcccgctgctacttgcctactgcagctaatgaattactatactctgtcccataaaaacgtattctctccgtttcaaaatgtctgacgccgttgactttttagcacatatttgaccgttcgttttattcaaaaaaattaagtaattattaattttttttatcatttgattcattgttaaatatattttgatgtaggcatataattttacatatttcacaaaagtttttaaataagacgaacggttaaacatgtgctaaaaagtcaacggtgtcaaacatttcgaaacagagggagtaaactatatctactaatctgaacacgtatgtgtctaaatttatagttaggattagacttttttttttttaagacagaggagtagctctaaactatagcgcagcgctgtaacatgttgccgaacagttccattagtacatagtatgttactgtgagaactgaaaaagtaaccataaaagcctacaaattgccacatagtcgcaggacaaaagctgatatggacgtgagcggcctatatgctatacgcgtggcgcagctacatgcattagctagcaagatgattcacgtgcgccattgcatacatatatgattatttttagagatgtgcttctatgctaaaaaaaaaaaaaggttaattggatccgtgccaccgtaaatgtggcaaataaaaaaatgccacacatatttacgttattggctggatgccactgcaaatttttaaaataagaaccatgccactccgtcatgattttcgtccaatccatcacattttctgccgtctccgtcttcgtcctctcgtcgtcctcgtctcgacggcagcaccagcacggcagtacgaaggcgagcgcggatggcagcacggcgcacggcggcacggcagcacggtggtggatggcagcacggcaccggcgacggtcgtgcccgcgtccgctccccgcgcccctccgcgacctcctcgccgacttcctctctgcaccgttgcagccatcgtcgttgaccatctccgcggtggaccagccgccgtcgacctcatctgcgcgggagagctcgggagccgccgccgccgttgctgtcctcgtcgtggtcgtcgacgagccgcaccgcctccgcccagatctggcgaggagggctgctcgtcgttgctgccgatggaggaggcgtcgagcctcgaactccgccgccgttggccccaagctttgtcactggtgctgccgacgcccatctcctctctccacatgaccatcctcggcagcagctgcgccccctccgcgacctccccgggagcgtcctcgtcggcggcggcggcggcctcgctcgcgaccgtcctcgccggtagcggctatgcccgcgtccgcctccacggctgtcctcggcagcagctatgccccctccccgacctccccgcgagcgtcctcgccggcggcggctacgcccacgcccgcctccgtgaccttcctcggcggctgccatgcccctccgcgaccgtgctcgtcggtggcggcaaagatcgatggttatatgttgattggtttagttagctagctagctagcctcgcgcgctgcatctgtagcagctagctagctactacctgagcttgttgggtgtttctgcctgagctccgttccgccgaaccccgtcagacccggccgcgaccgcgccgggctgtcctccgcccgtgccagccgtcgcgccagctccccatcctcttctccgttttgtcgcgtgaagccgatgcgtttttgtcgcgtgcgcctcatcggcttcgactccggtggtcgagctgctcacacgcgtctgggggcagcagacgtgagagagagagaggaggatgacggcgtgagagagaggacggaaattgtgatggagtggcatggttctcattttaaaaatttgcagtggcatccagcggataacgcgaatatgtgtggcatttttttgatttgccacatttgcagtggcatggatccaattaaccaaaaaaaacttgcacgaaagttaaagctaatcagcggctgtgattagaagcgagattagcacttaattatcattagcgaggggtaatttcgtccaaagattttcgagcccatatccagcccagtccatctgaagcgatccccacccccaccggtctaccacggcgccgctcctcaaccgcaccgcctccactccctcctcccctcgcctcgccgccgctgctccgctcaacgccgccttgccgccccggcgctccgctctcttcttcccctagcccttaaagcgcgcactgcagccgcgggtcgaaccggcccagccgcgcctccagctccgcgagcggtcgatccacgcctccagctccgtcgtcgccgcgggcatcctccgcgccgtcgtcgccggggccgtcctccgcgccgtcgtcgccgcggcctcctccgcgccgtcgtctccggggaccgcctccgcgccgtcgtcgccggggccgtcctccgcgccgtcgtcgccggggaccgcctccgcgccgtcgtcgccggggccgtcctccgcgccgtcgtcgccgcggcctcctccgcgccgtcgtctccggggaccgcctccgcgccgtcgtcgccggggccgtcctctgcgccgtcgtcgccgcggcctcctccgcacggtcgtctccggggaccgcctccacgccgtcgtcgccggggaccgcccccacgccgtcgtcgccgtggaccgcaagccgtcgtcgccggggccctcctccgcaccatcgtcgccggggaccgcctccacgccgtcgtcgccgcggtcctccgtgctgtcgtcgctcgatttgggaggacattacaggatgtatgtcatttaaaggcattttgtggagggcatttctttaaaactgcctcaaatcatctctttcaaaggcaattttcataaaatgccacaaaaagtatttctatacatggcaaatttaattaatgccttcaatacttttatcattagaaggcgttttaaagaaaaacgcctcaaaaactctgtgctttcaaggcaatttcattagcgccttagaaaatctcctatttcagacgtaatcacggaacgccataaattttatattatttgggggcattttgcaaaatcgccagggtaacagatagaaggcacttttgagagaaatgcctcctaatctataccatatatgcaaaaagaatcctgaaagaatttaaggtataaaaattagtccttccaccacacgtatgctaccttatcagatccgaatcagaatagatcgatcagatcagatcgaaaaaaaaaaatctcacgcggctagcgagcgcgcgtgatcgactcccggccgccgcccggtgactcgccgccggcgaccgcccggcaccccgcgcgcccgcccatcgcccgtcgcgccatgccgccgtcgacggtcgaacgtcgcccattgcggcgtcgcccatctccgcatcggcgcatcgcgccgtagcgccgcccgttgacctagctcatagggagattcgccgccggtgagcgccctgcgtcccgcccgcctgctgcccatcgcggtgccgccatcgacgctcgaccgtcacccgttgcgccgcctcgctgcctccaccctccagcccacggcctcacgcgccccgagcccacgacgccgccgcccagaggtccagcttccacctacagacgaagccacgcgtgaattggtaactcttcccctcatccactgcctaaatgctaaatccagggatggttaggaacatttttggtttggaacttaggatttagttaatagttgaatttaggctctctcgatctattggtgatatgatttaaggtgtgtgaaatgagaattttagtagacatgttagtctccatctctacccatcacactactgtttgagcacgatgatatcttgaggtttgtgcttttccagttgggttgaatttacctcagtttttcatgcattgaaggtgtttgtagtaatgcctaagcgagtttttatggttcataactggttcggtacatatcattcatacagtgagctatagggaagcaatttcttacactgaaatagtgttccaattcattgtactgaaattgcagtgttcataacaagcttatgttctactacgtatttgcaactagtagtgaacttcagtgttctgcatgtcaaagtgttaggtgcagtaactctagcatccaaaattccaaacgagatgtttgttttatgtttctcagagactgttctgcacagttcaataatcttggtatggaagtaacgcacgagcgtaatactctattttctataaaattagagttagttttgttgtgaagcataagcatgattgaataggaactctattggcagttttatcacaagaaatcttggtggttataaccttataggaacaaaaatatactatggtttgtgatgtgatctgaacttagtgattcattatgtatgcgtgcttagttgcaggggtgccttttgaatagttgggactggatttattagtatattaattagtatatgactcagaaatgttaattaggcaacataactggtagtatattggatctgactggttagctgaatatatagttctttgcattatgagaggctcaacgactaattggatcatgtattttggatgaagccaccatattggatctgctcttttgttttctaaaacagtaacaatataaatccattggaaatgctactagaacctttatgttcactttaatcttgatccaaagattagaatgctagttttctgtgggatattctacacaagtttttcccccataaaatttatgcacagttataatttgggttataattttctgcatatgcctcactagatttctgtggtttgatgatatgtttgaactttgaagagttgagctgctatctgtcggactgtcacaagtgcaaattaacttcgattgattgatcatggataaagggtggatgaaaggagaacaatacatgatctaacatgcaaggataacataggacatgaagatgtacattctaggacaagtactcttggaaaagccagcgctggttccttaagtgctatcaagttcactaatagccaagtgctaacaacttcacggttctagcttatgaaagtaagtctcctatcccaagttcgaatgtcttttctcaagaccatggcaataactctgctgttacatgataagaaatagaactattggtctggatatattgtttcttactagtatttaagtggatttgcattgtaaaatgtagcaactcattttatggacaattataatttctgcagatacctcatttgacttgtattacagttattttcccctagatactttcatggtgcattccccaacaattatactatatatgtttaaatcttacggattcaggatatttttcatggtgcattccctaataattcaaaatattttgggcacctactaatgattatatttacttcagtgctggcctaagaatagtaatcctgagagcaatataggatagtatgttatggttggttagctgaggaacactgagacagtaagtatcatctctttgtgtctctttgtttgtttgcattatgttctgtttaaaagagtatgtagtcatgtagaatgcaatctgactcaaatcgatcaacaatttgttactttgattatgtgcactgtatatattgtgaatctaattcatgtaattctagacttattcaactgcagcttgagagttaaatgttttgaactgatagaaaattggaacaccattatactgccacatcatatactgcaacatcatcaaaattggaacatcttgatgggacactaaaatctgtagttttgcaataaatgcattgctaaatcttgtattgatggaacattaaaatatgtagtcttaatgtatatttataatacattgctaaatttgtagtttttgcaatactgtgacttgcagctttttgataaatctagtgttataagcttggatttgttgttgtatgatttttgttttgtcctaatacttgcagtttcatgtaaagtacactaaatcaaatcttttttttttaaaaaaaaaactagttttactggaaactggctttggttatccattattttgtctgttaaccaaacagaccagcaattttccaagaccctgctagacctggtctctacaaaattcataacccaaacaacctaaatctttcctactgatttcatatgtgttgttgctatgcattatatcaaggcaaagcctctttttaggctggttgcctgattgtaatggtttgataatcttgtatactagacgtttctttttctttatacttttgtattctttaacagagcacaaaatataattggaacatcatttactatttttaccaccacccaccttctcaggttgtcatggagcacaaaatatctaacttttgctgtccatatcatacttcatcattttggttcttttagaaagaactttgctcaagttgtcccgtgtttattacagcatcatatagcataa

SEQ ID NO: 55793 - DNA, 2346 bp, Oryza sativa
  unsure (1)..(2346): unsure at all n locations
tcctcccccctccctcccagatctggccggaggagggaggagggaggccggcgccgccgactacggcgcggggcggcggcggctcccctcccccctccctcccagattataacatctcagcctagggcttaatagaattactaaaatactcatatcaacaagttgcaacttcttttccggaagccgattttcaaagaactccagggttaagcgtgcttggcctggaccaatttgggatgggtgaccgaccgggaaattattctcgggtgcgcacgagtgagcacaaagtgtgcagaaaagacatgtgttggtctgtgagggtagtctatgacctataaaagctatcagatggaagcgggcccggcttgggagaggcaggacgctacatggatctggccggaggagggggggaggctggcggagtccacgacggcgcgggacccgcgggggcggcggcggtggcgacgacgacgacggcgatgcccggcgtggcttccctcccctcccctcttgcccggcgcggcgacgccggaggaggacggcggcggcgaccgccgcccgtgattttttttttgtttttttgaatgtattttcgcaagcgggttgttgccccgactgcgaaaatggatgattttcgctgtcgttgacctaccctccgcctgcaaaaatcactttttgccgcctggaaagatagtttttctagcagtgatattagtgatattaggttgatatggtaaaacaataccggcgtactcaccgtaggcagtttcgtagtattgtttcgccacgttatagttgatgtagctaaaaggtttatattagagatagtttatttttaaagttaaaatattaagaggtttaaaaaatttgcattcttgcttgccttaatttggactgacaaatgagctagagagatgatatatactatttaatttggctggctaattcgtttgtatttactttaacttcttaaaaaaagaattcgtttgggtttaattcttttatttaatctttagataagggtattttttttacccaatctctacatccaaccggatgtatgtggcctttttaaattgggaactagccactcaaacaatacaatgatctgaagctcgctcttatatagatttgaacacaggaccttagagtgctgctttaatatgtgtataaatacatatatgactactgttctttccaacaattaacagtcaaccccttaattatgtttgacgagtgtgattagcacgaatagctagctagatattggcagctaacaacagaacgttgatgtacatgtcactagacagttaatctccggtggcgttagtttctacacatgcagggttcccatgcacacacatctctcgattaattctccctccgtattttaatgtatgacgctattgactttttaacaaacgttcgactttccgtcttattcaaaaaatttattcaaaaaatttatgtaattatcatttattttattgtgatttgatttatcatgaaatgttctttaagcatgacataagcatttttgtatttgcataaaaattttaaataagacaaatggtcaaacgttggttaaaaaatcaatagcgtcatacattaaaatacggagggagtattatatagtagcatattgtttgcatagtcagtagggagcacgtttctaatttgttaaggcacgatcaacnntcgatcgatnntagccctttttctttttctgacagccgccaatttgtacagggctcgaatgtgcacgtttacgttacgtacgtgtagcacgtgctgaatttgttggtgccatagctttttctattcaccaacttctgcatccatatgcttgccttttagtcaatttggtgaaaaatattttaggattcgtgcaagcatcaacaaggaaacactgttaatccgtacgctccaacgacttaaaattaagttttaaaatgcaaatctatactttctatataattagtacccactaacaattattataaactaactaaacctcaacatgcaagcatgccacaccatcacacaccagcaattactccctccatattttaattaatgtatgacgctattgactttttgaccaatgtttaaccattcgttttattcaatctttttgtgaaaatatgaaaatatttatataattcttaaataacatttaatgatgaatcaagtcacaataaaataaatgataatttcataaattttttaaataggacgaatggtcaaacatcggatgaaaagtcaacggcgtaatacattaaaatatggaggtagtactattctagcctatttaaaatcccatgcaagcatgccacatcttccctc

SEQ ID NO: 55794 - DNA, 1758 bp, Oryza sativa
aattcctgcagccctagttttccatgatttacttaaaaaaagagaccctaaacattcgacaaaaacaataacacttcaattttaatttacacttaatttattaaaaattatttcttaataaaataagtcgaccttctttctcgataacgtggacagataattactcgtagggatgaattaaatattttgttgcataaaacaaacaaatagcttataaaaattatcaaagcaatatcgttgaaaaacattcatagagaaatactacttttgaaatttgaagcgtagcatgtactatctggttaatatttcaatcttataagtttctttaacacatattacgatacatacccgcgcatacgcgcgggctaccttcctagttacttaaatttgtttgaataagacgaacggtcaaacatatttaaaaaagtaaacgtcgtcaagtatttagaaacggagggagtatgatttttgctcgaacatgtacgcaagttgtttcgaaatgttcccagcagttatttttttacttcttagtccgagatgaagtcaagaaagatacacaggtgctcttctagtcatttatcttcctaatagacacaagccaggtcaaataactgcgaatatgactttgaattgagccttctcgtgtattttgaatgatgctaaagggtatatgaattagtcaatggttgtcaaatctccaatcaagaagatatgtgcattgaaggaagcacaaagatgagtgccaaagttcagtgggtcacactttatgtacttagattccaatttaaagatcacttcagaatatctcattttcccttgctcattgtgacatgctaaagctcatttgagagctcaatcaagttcattagacgttaagaataaaagtggttctaaacttaacttttcactgcaaggacatagatctctgtactctactacttcaccgtaataaacattgtcctaaaaagtttatgacttgacttccactcaaattagcttagatctctaaagaaacacgtgaattctggctttgtgctacaaatttcatgagtattaatcttgggctaaaaaaaggtttgaatattactttatccaaaatttcgtgattttaaacctttggcctaaaaattcttgattttaggctttggctaaaaaacacccataaaggattagccttagtcataaaagagcgtgattattagacttttgctcaaaatttcatgattataaacatttggcctaaaaattcattacttttagacttcggcccaaaacataccggtatttatttagcgttggactaaaaaaaatcatgagtactgggcccaaacgagagtgaatattactctcctgtccgaaaatgaatctttatcttcggcccaaaaaaatcatgcatattaaccaagagttgaaaaatacatgtgtattgaccttgggtcttaaaaaggcatgaatatcagggtccgctaaaaaattcgtgattattaacctttcacctaaaaattcatgcattttagactttggtgctaaaaacatatgagtatataacgccctgtttggggagcttaaaattatgagaagcagctactgagaagctagctggtgagcagtggcggatctagaaaaaaatagtagtgggggctgaataaactacatcagcataaatcgaacctccagtccccacatcctatagatctatggaaaaaaaattagtgggggcttaggggggtctccactgtctcgggggcggtagtgggg

SEQ ID NO: 55795 - DNA, 9630 bp, Oryza sativa
catcccatataacatctacttggcacttatagtaaaggaaagaaaaaagatagagcccacgtgggtcctatttaccagtggctatcgtctttctcctccacccttctctctactctattcccctatctgtctccacctctccccttttctctctttcccgatgatctccaaggcggcggctcccattggaagatataacaaaatgagaaatttgaaacaaagcctttctcaattgttctttgagttatttttaatttcttttatcagcctttcttcttctatgatacattaatttgtttcatttatcacaactttttttatgtatatattcaatatactaactttcggaggagatcaggtacagacgtcgcacaatttgatacatgttcatcatgtgacagctttgctaaagcatactgttatctgtgttctactatgaaacttcagaatttcgcctcaagatgaacatcaatgatacatctacctactgatgtacatccttcaatttctcttgcaaagataacttgtaacaacatgatcaattgcctccaaccgattaaaaaaaactgacttggttccctatgacgctaacaaatggatttgcttggaaaaattaactaattaattaacggtaaacattacgctgacgttccggattgggcaagaagacttttgaacacgccggctaagaactgcagccgtgtagtctagtgttgaacagcaacttgatgagtaaacatgacttttaaggatcacaaacaaaaaaaaaaaattatgagctttcagtgtactgttgcacagcaacttgaggagttaaatacctgcagatacacactgtcatctcatcttaacatccggacaagaaatcaggatggacacaagacaacttccaggtcttagggaacgttcgttcctgggcaatctgggggattgagagagattgtctctcgttttccgcgcgcacgcttcccaaactgctaaacggtgcgttttttgcaaaaaatttctataggaaagttgctttaaaaaatcatattaatccatttttgaagtttaaaatagttaatactcaattaatcatgtgctaatggctcacctcgttttgcgtatcttcccaatctccccaatctccccaatctccccaatcctcaaacacacccttaaggtagaaatactgtactactatctgataaattgttctgttgagcttaatcatgcaagggagtctctggcttgcattaaaacgtggactaatctctgcaatgattcccggacaagagtaccatccaaccttgatggcgatgccaaccttcctgtcagcacaattcaaagccgaattgttcaaaccatctagaacacgtgcaggtggtttgtctcatctgattattaatctaatctccagcatccagtactttatttatctgcacaaagttgagcgagtccaactgtccaagagaatgtttggcagagtattttcaccgcattgacctgaaaatgatttagcaaaatttactgttttacagttacacgcatactagtattagtactaactacagattccattattctgtggaaatctcacttgtgcacacatgctagtatgctactgcatcattgacctggaatataattcatgattgattgtcctatctacatatatattttgctaatttcatctcatctgaagctgatttgctaatgtaataactacaagctttggaaaccatccgatcgatgaagtacggttgagatcgagccacgacgatgaattatccgtgtttgatcacgcttgatctgagccgttgattctctgatcggacgaccaacaaggacccacgttgttcactcccccttatggtccaaatgcctcctagtcctaggggatcaccttgaccttcaccgaagtgaccacggcgaactcccggccgatcgccgccgcctcgagcatctgcacgacggagcgcatcgacggcctcatcgacggcgtcctgctggtgcacaccacggcgacgcgaagcaccctgacggcctcctccttctcccattcctcgccgatgctggcgtcgaggagggacatcaccttgtctcggctatctaaccggcgagacacccactccacgatgtccctactctccccgtactccgccatgatcgccgtccgccccgtcaccagctcaagcagcaccacgccgaagctgtacacgtcgctcttctccgtcaccttccacgtgtaggagtactcgggcgccatgtacccgagcgtgccggccaccacgcccgcgctggtggtgtccggcgtggcggcggcgccgtcgaggatcttggcgaggccgaagtcggcgatgcgcggcttgaaggactcgtcgaggaggatgttgctggacttgacgtcacggtggaggatggggcggtcgcagccgtggtggaggtactccagcccacgggcggcgccgacggcgatgtcgtagcgctccggccacccgaggccgccgcggccgccgagcttttgcccctcgtgcaggcgctcgtagaggctgccattggggaggtgctcgtacaccagcaggctcgccgcgccgtcgtcgctggtgatgctgcacaggagcttcaccacgttcacgtgccggatcgagctcagcgtccccacctccgagtcgaactcgcggcaccgcaccgacgccgtgcgccgcgccgccgacggcgaacggagcatggcggccgacgccgccgtgctcctcgccgccgccgccgccgcgcgtgtccgggtgatgtgcttcaccgcgaccaccgcgccgctcccgagcttcacgcggtacacgttcccggacccgccgctgccgatgaggttctcgtcgcggacaccgtcgatcacctcgtgctcgtcgaacgccaggaccctgaacgacttgaggtcccacgaccccttcttgccgaacaccttgccgccggccgcctcctccgcctccgcctccgcgcgccgccgcttcttgatgtacatcaccgcgccgagcgccgcgagcactacggcgaggccggcgaggaggcaggtgaccacggtgcgcgcggtggccgcggagtggcctcctgatcccggcgagcagcggcggaggaagtccactccgttggtggcgcacagcccggggttccccttgaagctctcgccgtaggccgcgatggagagcggctccggcacgggcccgacgagcttgttgtcggacatgttcagggagctcagcttcagagcggcgaggctcgccggcacggcaccggagaggtcattcccggacaagtccaaagaattaagccgcggcagggtccccagctccgacgggatcgcgccggcgagcttgttcccggtgaaattgaccgtactaagcgacgagcactcgccgatgctcgccgggatggccccggtgatcccattcctagcaatgttcaagctgccgagacgtgccagcctcccgatgctcgccggaattttgcccgacaacccgttcgacgaaatgtcaattgtctcgaggttgctggcgtcgccgatcgacggcgggatcgcgccggagaacctgttcccggccaggtcgaggctgctcagcaaggcggctctcccgatgccgtcgccgatccccccggtgaactggttgttggcgaggtcaatgatgtcgacgttggggagcgcccacaacccgtcggggacgtcgccggacatggagttcttgctcaccctgaacctcaccagcgtcgtgcagtttgcgtaggtggccggaatctggccggagaagttgttctccagcatgagcagcctggtcatcttgccgcgcttgcacatgaacggcgggatcgggccggacagcgcgttggtggacacgtcgatgaagttgaactccgcccagctgccgagatcccgcggcagctcgccggtgaggttgttgttgtacagggacaggttcacgagctccttgaactcgccgaactccggcggcacgtcgccggtgaagccattgtagaacagctgcagcgacacgagctgggtgagcgaccggagctcggagaggctgccggtgaggtggttcatggacgcgtcgaagaactggagcttcgtcaggttcccgaaccccgccgggagctcgccgtggagcgagttgttgtacagctcgagctgcaggaggttggtgagcttggtgatctccggcggtatctcgccggtgagcgcgttgtcggagagctcgaggtcgacgagcttggcgaggttgccgatgccgggagggatgacgccgccgatgttggccgcggagaggtagagcacggtgaggttggtgagcgcggtgatctcgtcggggaacgtctccgtcttctcgaagaacccattgtcgccggcggcgagcacggtgagacccggcatggacgccagcgcgcgccatgggaaggcgccggtgaagctgttctgcgacacgttgagcctctgcagcctcgtcagcggcgagaggtccgggacgtggccggagaagccattgaacgcgaggtcgagcacctcgagggcggtgcaccccgcgacgccgccgatccccccggcgagcgcgttcgacggcagggagagcttcgcgagcgacggcagcgagccgcacagaacgtcgaacgggacggacgttgcggccacgcccaagccctccacggcgacggcggtgacgccgccgccgccggaattggcgcagtcgacgccggtgaagttgcagggggaagccgcggcggcgtcccaccgggcgaagaaggcggcggcggtgggagggatggtgagggcgttcttgaaggccatgagggccgacacctcggagacggcggcggcggcggcatggaggccgaggaggaggaggagaggagggaggagaagggagggcggtggcatggctgccgggaagaggaggaggaagagaaggaagaaagatgcttcctttggtgtcagtgtgtgaagctgactgattggctttaaggtagtaagtaggtcagcagcctgttccaacgacagcacacagatgctattttaattagcttagcttagccaatttttgtactgttccaaacagagacattattgattaatggtggttaatttaacttgccactctctctgttcttaaatatatgaagctatttacattatagatgagacttaactttttacatgaaaaatcattacggaaaaaaaccacagacgccaattgccaataagtaatactgaggagttgattacgaacacatagtatacatctagccatcgtatccttcccatgccgtttacaaggatataggtaaaaaaggaaaaagctaagagtcataatagaaaaggactaaacgaagactaatcctaatatattgtatgtcgatattcgcatcacatatttaataaacttttttatccgatatctggccattcattttattaaaaaaatctatgtaaatgtcatttatttttgttgcattttattttatcattaaataattttaaacatgattttatattttatttttatttactatttattttttccataagacaactggttgacatggattgttacggtacaatataggagctgatcagtacatggttgtttatttgagataagtagctagattgttaattaatggagggactaacaactgtgttaagctagcgtgctaattagccagtgtaattgaccattgctttgcttccatgcacggcaacattgcatgaccaatgggcaaaaggttcagtccagatagcactagtttgtggaaccctgtttcttgtctaatgacggtcaagcaaatgcagaaatgctaactactccgtaccaggcttggactaattaatgaacgtttgtataactgtaaacccacttcaattaagatgtactatctctgtcccaaaataagtacagccgtaggtatccgtgtccaacgtttgaccgtccgtcttatttgaaaaatttatgaaaaaattgaaaacaattagtcccatataaagtactattcatgttttattatctaataataataaaaatactaattataaaaaaatttcaaataagacgaacggtcaaaggttagacatgaatagtgcaaaattacacttattttgggacggagggagtaatatataatgtattgagacttaattccagtagtgctagcctgtgcagcattttttttttgaagaatgtcacaaaggtagtaatattaatattcttatattactagcatccattggtgcaaaacagctataggttggacgagcgtgtgctggagtaatttaactatagttagatggaacggatatgcagggtcaataatatatatccttaagcaacaatcatggattgagcccttcaacgcacacaccagcatctagctatatatgattaagcggcagatattaattactattgtcttataagtcgtctacatatatctgattaataataatggaagaacgatgaaaatatattaaatggtgagatagatatatgatcaagaatgatctcagctggatagatataggagtatactactacatcatctatcgatcatcattatcttaaaaaaaatcatctatcgatcatatatttatccaagaatgggagaaaaaaatgagtccaacgacaacttggcttgtggggagcggagacgaggaactgatgactgaattctgatgattcagggagcactatctgtagcaggccaccaaaaatgtaatggatctctgaattttgaggctcaaattttggcagtttttgagaggaacaggtagctaattatctgacgtgggagagatcgcatacacacacatatacgatcgatcgtggacagatgtgatgcgatgattcggtcggatcggatggtgaattgctgaagtatatatcttcagtgtgactcttgaatgcaaatgctcgcaagttgctgcagccgccgcgtttgacctctcaccaacgctttcccacacactgcattcctgcacgcatcacactccatttcattatccgctcacagatcatatttataccgcaggattacattagttaatttcttctagaatgtaataatagtcctcctaaaacctgaattcctctgtagtttttctctctgaagaagacacactcaactgttgcaattcagagaatcttccgaaattaagcagagtgatatagtatgattgaggtcaaattgattatccttggatccaggtcctccacagtccagcagagaggaactgcagctacagtattctgagtctgctacagtgaatcaatgcgccgaacactgttcgggtactgtagcaaagtatttcgtaaacagtaatctttttgctgtttgattggttactattcccgtttactgttcccatctactgtatcgatttgttttagaccgttggatgtggatccaacagcaaacaacacaccctaatgcaaaagcactgtagctccctttgcattctcttctccactgcagaggatccaaattgattatccttggctttcctggtaaccttcctccgatcctctgctaatatatatcagtccactggccagtggacctcaacgactgatgatgatgaacctacgtgtgtgttgccaaatgccacacgtgctctcatatatggccactcttgaacactgtacttgttctcttttttctcctttaatttctctattgctttcttcttcctttgatgttgctgtcccttgtgatttgatgtgttgatggcttctttttgtcatgcatccatgtccactgccgattcttttccaacctctttctccctagcttccaagatggagatattgagctgaaacgcaaccagtgcaggacacctgtctctgtccctgtaatctctattactcctactacttctttctctgcaggaattacaggatcgtcgatgcgatgctatatgccgtccaattacacatgcagaaaacgaccagcttacctgcttctagatgattaagatagctgctcatggtaattactactaccatgttactgtatactccatccgtttcttaatatttaacttttttttaaaatatgttttactgttcgtcttattgaaaaaatttaagtaattattaattctttttctatcaatttgattcattgttaaatatacttatatatatacatatagttttacatattttacaaaagtttttgaataagatgaacggttaaatatgtgctaaaaagtcaacagtatcaaatatttaaaaacagaggaagtatgttttaacaagtaaatttagggccccctttgaatcgcagggttgaaaaaatggaggaataggaaaaacataggattctgataggaattgaagtgtaaaatagaggattgcaaaacacaggaaaaacataggaatggtcgtttgattggagcgcaggaaaaacacaggaatcggatgagagagatagactcaaaggaaattttctaagaggttgaagctcttgctatatttcctccaaaatccacatgcaatgtgtcattccataggaatttcataggatttgaaaagcttcaatcctttaaatcaaagagccaaataggaaaattttctataggatttgaatcctatgaaattgctacataaattctttgattcaaaggggcccttacattattatgacctcagggttcaaatttcccaaaattgtggggctatgagaacccttcatccgtacaatattatgtcagtcgaaatatttaattttctgaatcaagcaaattatattcaaatttaaccaaaatttgttcgaatactgacttatttcggtccgtaattccttttctatcggtcccccagaagaaatgcgcaagccgatatacagaaccctgatctcgtcatgaactgtaaaagatcccctaataataattaaactgctgctttatttgttgtatttcttttctgtttgtaaaattttatggtgggtaaatgttattgtcagtctagctatatgtgggcatcacaatcacatggatgccatgcaatctttgttagtttcatcttggtgctccaccattttgtcccacttacatgcatgcatcacaaaagcagacacaatgctcttttctttagtcaattttccaggtattgcccactaaggaagtaattattaacttaattatcttcctcatgtgccatatatttacaatcaagtcaaaaaggaaataatcacaaggaagactaatacaatgtgacttccgtgcgtagtggattttttttaaaaaaaaactggaagaattcctcaccaaaaagatgtgataatgaaagtacaattaataaaatggtaatgaacatgatataggtagcactagcagcttctgttgatctgtgcaaaaattcagatgatatgatactacaaatatatatatatatatatatatatatattcatggaattcaattagtcctatggttgagaaatctattactcgttttttttttgttttaagaatgttttttttctttctcttgccacggagactaaatattcagagagcgtatgtgaaattaaagaaaactcgtatcggtattatgtaatgatgtacagaaattaaattaggaagaagaacaagactatagcttgcctacgttag

SEQ ID NO: 55796 - DNA, 6949 bp, Oryza sativa
agtttattatgcatcatatataaggatcagggtggctgcaggctagtttaggccagcatgaaaattagacgtacgtgcaagtcaacaaagtgcatgtatgtattatttatatatcctcatggtggtttatctcatatatacatgcatgtagaccctataatttctagatatatatgccggtggtggtgcttaacagatcatcactgacaaatataattaacgcaattaaaaaacacaattaatataaacaactactacaagtgcaaagctgatgagcatggcttgaccacaccactatagccatatctgagtgaccacacaagcttccaaattaacaccgactagtgcacgcatgcagtttgtatgtcgtcatgccaactcaacatatatataactgcaaattaaaactgtagcgtgcatagtttacctcattattaattgtgtgcttttgatcttcaactatatatatatatatggtgccaatgcctaccccgtttataacagacttgattattacaacatgttatttaattaattatagtaataaattaaatgttttagaaaataagcttaataaatatgttagaataacaagtgaactgaagtgcgctagaagaaagttttataagaaaatatgtatttgaaagacgttgagcaaataattcacgaaaataatacggtgaagtagctgaaagaacacgcagataaatataaatctcagtggattaacgtgcatgtttccgaacatctacacggtgtgatgttttcaaaaactgtttatatatgaatttattatgatattgtcttaaattcatttttaacttcatatataataattaatttatttgtttgtgccttcagataattatcacaaatcatgtctatttagtcattcaaaaaaaaaataacacatgagtattaatctacttcccctatctcaaatatagctactacaaagatatctttattttgggatggagagagtacctgtagccatgcatatatatgtcagtgcacgagagcattttaatttatatagaagttaatttagtctagttttgaaaatataagttatataagcacaagcatatgctccctctaggctctagccatatgtaatgtacgtaggtttgcatatgcttatatttttttatagtacacttgcttcatattaattggttgtttgattccattatctaaaattctaaattgttgcttgtgtgctggtatgagagcgacagtactgacacattcgatgcatgggatcatcctcggaagaactagtgtaagaataatcccagcaagcgagtatatatattcttaattagtttggttaattaatttctttcaccactgggttaagttttgctatttgatggagtacatagaatgcatgggacaaattatattaaacaagcaaaatatgctataagtatctcatatatatactgatgtgtcgttttcgcactaactaaaaggacactagtgatgatcctatagatatatctagcaccacatgtgcatgtaccccactattacaccttttctctttttaatttctttgcaaacaagacccttttttgactcttgagaacatgataaaaagatcaagcaactaacgagacgaccctcgtcaaaatttcaaaaagatataacggcaccttgctagcattcacacattgatacatacagtatatatttatatttatatatcaaccaatgttatgttctgtgaaatgtgtgtgtggtgatgtgtattgatgtgtgcgcgtatgcatatgttatctaataaagaaaaagggaaaatcaatgttgcgtttcgctagctgtgtttgtatctctcatttccaaccgcacgtttccgaactatttaaacagtgtattttttaaaaaaaatcttagaaaagttattttaaaaattcatattaatctattttttaagttttttttaattaatatgtaatcaatcatatggtaataagttattccgttttacatgggtggaaagagagtttctatacttaactaccgaaagcatcaacacaacctggtgttctattgatcgtgtcgcgcttatgcatgccagctccaacacacttcatgttcaagatgcttcttaaatttatattttttaaaataatcggttccttcatgtatattacagtataatgtgatgctatatatatgtactgccacccccctttgtgttagtaatccttgttcagttaattaattagcaggctgctggtgccacaatataagtttgcagagaaaatgtacacaaatccagcagaaactaatcaacttcgttaaattaattaattaccttgaatgtaaatggaaatatgaatacacaaaggatgtgtttagatccaaagtttggatccaaacttcagtccttttccatcatatcaacctgtcatacacacccaacttttcagtcacatcatctccaattttaaccaaaatccaaactttacgctgaactaaacacaaccaaacatgaatgccacttgtacacacaatttgttcaggccccatttcccgtgaatttgtcgcaatccaaactgatcgataacatgcatgtgaaagtgaaagcaaaggcccttgtttgaaattaatctctgagatgcagcgcatgagatgtttggccggctgcagtgttaagcagtagcttttgtgtctccatcagtttgcagaaattctgcaactactactccactattaagcaagcaaatagtagtagacagacagatcgatgctgatgagcaaccctacataagattcatgcatattgatcaggtttgaccagctagctgatcctgacagacaaatgaattgatccatggatctgtatgggttattattatttcataaattaattaactagtagtaggcaataataacgaataattaagttagacttgctcggacttactattgtttttttaatccttgacactgtatatactatactagagttagcaatgttgggagatggatggatgggataatcagataataactattaagcacagttaatctgagcataataatacactacttaagcatagtagtgatccttatatatgtggaaaaaaaaactattgttggatgcttgcgattcagaaaatcagaatcgctagtggtagtagtactaatcatcatcaagcactgatcttagagtagcaggctgggcctacctgatttccttcgcagcaatgattttgggcccatatgccgtaggcctccagctccaggtgattatatatcaagttgggctataattaagcccatcaaaattgaacacccaccggcactagtggcccaactatatttgttcatattttttgtgaaaaaagtttttttaacaatggattacgtcggaccaaaagttaaaaaaaaaagtaataaaaaactatatatatatatatatatatattgattagttacctgacaagttaaaccagctagctaactacaaactaagtatacattgctagaaataattatgattgtattgtgtatgctggatggagtagacgactgcttatctatactatggtagtaaatatgtgaattttttttgaaaatatacaattttttttaccggaattgcaagaatatactgattaggggaagatttgagaaaatataccgccgtcgcactttggttaagcgagagcgcgatatcgcataatgaattagcgaagatgccagcgctatcgctaattgaaacagcgctatcgctaattgaaaccgcgagagcgctaacgcatcggtctcgcattccaaaagcgcgagaacgactcggtctcgcacgatcgtaccgcgatttcgcggccgtctgacgtgaaccaagaccggcgggccccaagcagtctcgagagcgcgtcccacctgctaatggaatgcatgagccatgcacatactggtatatatccatctatatgtgtgttcagccatatatagatgcatgcttggccaatgtataaacgtatacatgcatgagccaacaagaagatgatatatttgacggctatatatatgtgtatgcatattcgtatatacgattcagcgcccggattcactaacgatatatgtacgtatccatttttgattgagcgatagcaaagcgctctctcgctttgccagagcgataccgcgcgtcggtcttgcacattcggacagtgataccgatatcggtctcggtctcacgctttgcgcttgcgagaccggcggcccactcgcgtccggtcgtttcgccaatatgggtcccatgacatgctcagtctcgtgcgtcgggattacgagaccgatttcactctcgctcttgtacaccgcgataccggcgcgacaacgggtcggttccatcacgtggcactctcgctctatgaaagagcgatatcgtggtggtctcgctgtttccacaagcgacaccgccagctcaaatgcaccctcgcgagttgatagtgcgatagcgtggcggtatcgcattttgttcttgcgaacctcggtatcgctcttccaagccgcgataccgatagtatatttgtgcaaatcattctccatccggtatatttttgcaaaacaaatccataaacagtatattttcaattttttttcgtaaatatgtcacctcacctatttccattgtaaattttacaagttaccctttgaatttcttaatattaaaaggatcaaatagtcacataaaaaatcatattaagataaatattttctataaaaaaagatggataacatattaatacattttcgttaagaacattttactagtttggtcataaaaatctcctacccgtaatagtataaagtatacaaaaacagatagactaggctatgacggcgatgatgcacatactggcaatattattcatattgcgtcacaccaaacggaacggaaacgtacacgacacagctagttatagttatccagcaagagtacgcctccctagtgtagaagacgtatcccacccttacacgctctctatcccactacttttacaagaaagccctccagttttctggtatttctcttgccgttcccgcgccaccaaaccaaaccaactcttcgtcgtcgcgccgcttccgttcttccggcggccatggaggacgcagcagcagcagcaaggcggatggagaggcttgcctcccacctccgcccgcccgcttctcaggtcagcaccccacacgccgcccagatccccatctctctctctcccccaccctctttttcttttccacccgatttaattcaggtttagtttagtttggtttgctgcgcgtttgcttttcgggaagctgcaagatgatcttgctcatctagtatccgaggttaccttcttcttgcaagcttggggattacggggagttgagattggggaggtggcgagtcaaccatggggatggctggacctaggttactactactactattcagttacttttagtttggatctccttcttgaattacctacgccgcggggtaccgatttcacagtgcttctgatcgaattatgttttagtttatcacttgcaatgtactactagtgtaaagctaccaactttactggacttggaggaggtcccgttagctagctttgggggaaccaaatctctggttttgctacttcccacagattctcaagtgaactgaaaattgacttacatttttttctgatgatatgctctctggacgacttgttagtttctgattgaaactttgaaccctgatactaggatcttacccttatagctatttgctttctactagtgatagtgagtagggaatgtgatcgacaattatgctactttgcaccttctctgcttagccgtaagttttcaggggagaacattttgaccagaaaccttgttagaacagcatttgttcaataaacagcaattgactctgccacttttgtagcgactacaaccatgctcttcctttattatgtatactttaaaacgatagttagccattgatctaggaagtttacaagcatacacggtatgcaaatatggccggaagataaaagcttacccttccatgttctctgctctctgtttataatctgttttatcctgcttaattttctctgtttggtgtatgtgaagatggaggaatcacccctcctgaggggctccaattgccgggcaaaaggtgccgctccgggtttcaaggtcgccatcttgggagcgtctggtgggattggccagcctcttgcattgctcatgaagatgaaccctcttgtttctgtgctccatctgtacgatgttgtcaacactcccggtgtcacagctgacattagccacatgaacactggtgctgtggtatgttccttgacattatgtttagtatccccctattcataattgaaataccacattctgtaaccgttgcattttgctactacttttatggtcagttgcaatttctataattttcagttgtatgtcttgagggagggtacatatgcttcatctatattttccttacataacatgtgaatcatccagaagacaatctagttctgacaaatttaatttttcaaaccattgattatccagaatgaaagaaacaagtaattccaatgaaacttgtctatctgatagtcatatcttaataacttaaaaggtactaagttggtgtctgatcattgagcggctactgttgatcaaaatacagatattatataatactgctagcaatacgtcgtagccttcatgcatatttaaagtattttaactattattagatttcagctttgtagtttccagatatcctttttttatcaccatgtggtattcctatagttattcatctgtttattgaaccgtaaaaggtatttcgatcattgtatttaattatgctaaggtctcaaatctacaggtgcgtggtttcttgggccagccacagttggaaaatgcc

SEQ ID NO: 55797 - DNA, 3772 bp, Oryza sativa
tcctttcacaggttaggaataccttccattgttgcaaatctgaaatctgagccacatatgtaggacaaattagtttttctggatatagacaattagtattggatcaatgttaccctgtttattttttcaaaagattgatggaattttactactattccccctaggtgaatcctccctgctcattcacctcagaagaaattagttatcttaccactcgcatacagaatggtgggacagaagtagtcgaggtatgattttttctttatcatctaatgatgcatgtttagaattgtattcataaagaagaaagggaagttggtttcacagtccctgatatgtatcatgcataatggttgtagttgtttgacttgaaagttaataaatctggaaaagaatcaacatgctaattttgtttgaatataagtgaccacttatagcatggatactttcaatccttgtacatatgcatattagttaaatgaatttcatggtgttaacaacaaagtcaagtattaagtgcatgtcgaactttaactaaatatgccttgaatgtctgtttgcccatattgcatacatttcatgttgttggcagaaaactactagttcaatgcatgtttaagtgtcgaaatccccctttcttcatttatcaatataaaggcctcccatgttctagatttttctgcttacgtttgcttttgctaggtgaaagtttaacagtagtctgtctaacggtaaatgtttttctatggaggttacagagttgtttgttggctgaagtttaatgtgttgttccctattggcgattcctgtgtactgttggtttctcaatgtttatatgttgctaatactgagcattttaattccccccttcctattatccatgtaggctaaagctggagcggggtctgcaaccctttcaatggttggtttctgtcacatgcgtattagcgtatgaaggttagttcttttatcagaacaattaagatttaacatggacaatttttcttgtaggcgtatgcagcttctaaatttgcagatgcttgcttgagaggattgcgtggcgacgctgggatagtggagtgctcttttgtagcttctcaggtttcttttctcccttttatgctggttatatttgtcatttgtgtgaacatatatttctaatttgcaaattttgcttgcggtgggtattgaaggtgacagagctgcctttctttgcatccaaagtgcggttaggtcgctgtggcatcgaggagatcttatcacttggtccattgaatgaattcgaaaggtttgtatgcttttccagtatttggcatgcataacatgcactcatatttagtgctacatgctcttatatgcttttcaatgatgttgatcctaaatccccacactgtgtaattatcaagctatcttctagtagcgcacaacgcttatatcgccagctcataacagtctttaaaaccttcatgacttgattgccagatcagtagatactgactggaagtctgcctaatggtttctattggactgggctcaagtactattacttgcatttagtagctcatagcaaatactgacaagtcccccttttgaaagtgaaaaatactgctgaaaatatgaatgcataatcatggcagactgcggccgtataacagtgcttagaaagagtcctgaaagtagagatgccccactacagattgtatggcttcacattgcaatataaataatactattgccaagttatctcttcatatccatactgtagaactgcaggatatatgacccctccgacaagaacacgctgcgtctgaattgaaagcctctgcggcatatatatgacaatatatgatgctgcattaggtccacagccaattaagatttgatatatcctactgctgtattgacctgcattactgattatcttcatacatcgctgtcatgcagagctggactggagaaggctaagaaggagctggccgagagtatccaaaagggggtcgctttcatcaacaagtgaggccatcttggaatgccccaatttagttcaacatggaaatacacaggctgtgtctttgcttcctggggagtgggaagaacacttgtatcatcttgtctcaaatgtaaaagctgcctacacgatgtttatacagctgtagcagatgcaaaaacacaagtctgctaataaaagttgcttctgaataaaaaggaaccctgctctgatctctgccttgttaattatgtttccctggacagtgaacatctcatcaggtgtaatttgatcttgtgatggacttgcaaattatagaggaaaaagaaaagcggaactaaattttacttcctccgtttcacaatgtaagactttctaacattgctcacattcatttaaatgttaatgaatctagacatatgtatgtatttagatatatgtctagattcattaacatctacatgtatgtgtgcaatactagaaagtcttacattgtgaaacggagggagtacatatcaagtaaccaagtggtgagtcttaaacagtatgccatgcacagttaggaacagtggattgtttcattgtttgttcatgcaccaatgcagaacgtcaacaagatcatgtgacgtgtgagacatttgtgatgtttggtagggttgttgctttcatggcaggagaaaacaatattatcttggaagcaaggttacttgttttgggtctgaacaacactgtgctcctaaatacagtataaacaagcttgcgtggttgggacatccaaactctcaagaaagcagcagcagcaaatgaccttcaatggcgacactgacgctgtcgtctacagttattttcaataaacaaaaacagagttgcaaacgtacaggcatgaaagccagtggcctgaaggttcagttcatcaggtagattactgtgttggtcacatcaaatccatcgtcatggtatacgtgcattaccagttgctttgatactgttttctgaatgagtatcaagcaattgcagatatatggcagcttgatgcgtgaattatcagttgcttgatactgcagttgatcaggtggatcaatatatattatggaatactagctgcaagtagttaaccatcatggaaattcaggttcaaggcctgaaaattcatcaatctgagatctgataatattaatccctcaacaaataattgaaggcatcgatctggaccaagaaaaacaagagaaaacgtgccttttacagtcagaatgcatccattcagaactgaacatacaccggccagcagaaatgactaatgagacaattaattaatataaagttgctaatattataaactgctagctgctgcaacctccaagcctttggcaattaataaactatagacaccatgtcgatcctaatggatcgaccaattattgaagcctctcaacttttcatccatttatccatgcaggcaggcagcatgtcatgtgcccaattacacattgaataataattaattgtcgcgttgattggcttgatcagctaattaaactaaagtttacctagacataaaaattagtagtatatactttcctgagatatgcagcgctgtctctgatatcaaattgtaatttttaatgttgcttctaatcataattaactactactagctagcttgatactctactgcatccttaatatgaaattggaggactttgtctgggaataaccggacgggtccccgaaaaagatattcagtgttcatcgatcgatcgccctaatgcttcaaatcgtcactac

SEQ ID NO: 55798 - DNA, 3998 bp, Oryza sativa
aacacgtacatgtgcactagtattttttcctcagctgcagcacaaatgcagttactaatactttacaccataccaattaattttgaggccctagcttataaatatagcaggaatggagtgaattgtatgtatggaatggaattgcactcagagtagtcttaattttcagcagctgcatgcagcaacatgtatatatctttatatttttatatagcatataatacatatctcttcattattattgtagaattggtagaaattctatgtatgcaaaccatgtagagatcgatctagcttgatccgatccatcaataatcagttggagtccggactccggatcaagtaattactaataataatcaaggttaattaatttgctatatatgtagtatatgtgttctagctggaaattacacatggtaatttgatgcatatatataagcaaagcaatgcaggatggttagagagcgagcttgccttagcggtgatggtgatgatgacggtggaggccgggaatggcatgacgctggtgtgggtgatgcccagccggagctcctccacctccgacagcaacctcaccagcaaaccccgcgagttcccgcactgcacccgcaccagcacgctcctctcccacacccgcacctcgatctccggcacccgcccttcgccgtcgccgtcgccggcggcggactgccggccggagcacgacgacttcctcaccaccatggccgccggccgcccgccgccgtcctcctcctccagcgtcttcaccttctcctgcaactccttcacatacttcaccgcgtccccgaggatggtcgccttgtccatctgcacgaacacacgcaatattatctcattaattcagtgcaattattaccagcatccatcatatctagctaattaatcactgtacttgctgcttaattaggcactgcctttttctgtagattagacgaccgactgacacggtcaacaacattgtgatttcgatctgcagattgcaaacgtgtgatttctgtacttcatttggtttctttcgggtttgtctttcaatttgcccacaaatctcttggggttaatttttgttcaagttaattagatgatttgctcactgaacagtagatcagtactagactgtgcagctagctagtaataataacatgcaatctactagctatcttgttgttagcctaatcatgcatgaaattagaggagaattagaagaagaatgcatccatggattgaaactatagttaacctttttgaggccggggatgacggtggagagctcgatgaaccgctggttgatcttctcccgccgccgccgctccgcgattatgtggtcctgcacgtatcccggcgccgccgccgacgacgacgacccgccgcctcctcctttcttcaccgccgctctcgctgtcgcggtagtctccatcgcctgcagcggcgccggaactactccgccgccgcctccaccgccgctatcctcggtggtcggctgcgccgacgccgcgctgaagttccagctcatcggcctgtgccccctgccgccgccgccggtgacatgcggggaccacccggcggcggccgtggcagcgccgccgcctgggctgtcgctggagctccagctgttggcgcggtggacctggtccacctgcactgtcaggtcccggaatccgccgccgccgccggccgccgaggcgttgcggagagcttgcagcgacgggaaggcgccgctgtcgccggcgacgtcagtggcgtaggctgcggcggcggtggagtcggaggggagctggtgcagcgtgtccatcgcccactgcatgaagaagctcgagtcatccatgtcgtctctctctccactgcatcaacaaccaaatttatccaatcaaaatatatatcaacaaaatctgtgtataaccaatcctatctggaacagatcaagaaaattgtattcaatccgcaaaacaaatcaaatcggataataatttgtgatgagagagagagagagaagagaaatgaggaataatattaataatcaatcaacaaagacaataagcagcaggtccaacaaatcaagattaaagcaaaagaggcaaagacatcaatcatatggacgagacagcgaacaaagaatctgatttgagaatttgagatcgaggaggatacatggatgtcacggatgaatcgacatgagagaggaggccagccagctggagggaacaagatgtgacccaaatacatgtcgtctcatccttttccttcctttatttcttttgccgcatcgaaagcaagaagcgagaaacaagcaagcaaattaagctgatgcatgcatgcatgtagatttacctgaaattaaacaccttgagatttgctttgctttgctagcttggagatcaaattaagcaaagcctcttgctcaaatctggaggcagattgatctgttgctgctcctcctcctcctatctagtatagtagtattatgttgtagtagtagtagtagtgtgtatatgtattattgccttgatagcatttgcagctgaagcataagttgcatctggatcgatctatactaggtagtagacgatatatagtgtgctcattttttagcatatatggatggatccttgtttatcagcgtcgacatattatgcttctccctctctttgtctactaccgcacacggccaaacgttcgacacagaaatccgcaactacaattaaaatagggcggatggagtatatgtatgtttttcctcgttaattatttctctccatcacacacactacacatctctttctacaaaagagataaaactagttagccagcaaaagctgaagagaagaacaaacagaagaatagttttctctctgttgttgtgtggcctaatcctggcaattaattattatagaattggttatactgtgtacttcgcttttacacctacacaccccacagagaaaggtgtcctagtagtcgctataattgcagtgaactgttgatctgacacgacactatccatatatttataaactatagccatgatttaaccgtcctcgccctagccttaattattcgatcgagtagattgcaactatttatatatacggtagtactatataatatatagacgtagattatacatgtgtgtgtatttgtgtgctgatccacgttccaagtcaacttgagcttatattatataatacaaataagtttaattaatcaattaattagactagctagctactggtagcttgttatagttaactgtggaagctcatggaccgtttctagggttcatactggcatcatgtgcattatgcatggggagctgatcaaaagcatatgcatgagacacatatgcaagagatctctagaattcagactgtaggtagacatagtattatgtcactccaatatggcaaaattgcaaaattaaatcaaatgcaattattggtagaagcatcttagctagctagcgttcacaactatggagttaaatttctgaaatttcaggtttaatggtgtcctgggattttttttaaaatttttgaacttttttaattttaaattttaaaaataaactcttctaaaacttagtatagaattttaactaaaaccttttagttacgccagctcaccatcttatttcaataaaaaaatttcaaatagtttatttttagaattaaaaaaataaaaaagttcgtgtcttggtggttcctggtaggatgatcttctgaccaaaaaatgactctttttagtatttcacgattttttttaaaaaataatataacaattttcctccaaattgttacctggtatgttgaaaacttgacctactttttatatatctatcaattagtattgcccccatctaataggaaccgctgcttttaaattaattttttcaacgaactggtacaagacgatgctaatttatcaaatagaggagtaaaagtatttacaggtataaaacctaaaggagaatatacagggct

SEQ ID NO: 55799 - DNA, 9149 bp, Oryza sativa
gaattgaattgtacaccacacgagttatggaatctaccacgtactgacagatgaactgaattgcctcattcaagtagaacagctgacttgtgaaaaaaaaaaagggaatgatgaaatcaagcaccatggtatttctgcaatgttaatgtacctagcaagttattgaatcaggtgtttgagattttaaaactcagacggaaaaaaaacacttcatgttattactcccacataagctgagaaaccaaaccaaaccagaaaataggatgagctgccttgtccaattacagcgagttcagtacattttttttgttacaaattcatataggagtatattagtaccagccaacccgagtgcaggtccaaattcttaaagaccgtctaatccatggctatgagagtacaaaaaaattgatagggctgcaggtaatcatttttttttaataatggattcaaccggcctcaacatccaaatgggatgtgcacagccaagggttgcaggtaattaatcatggtgactatgtttgctaagcttctccctaagctatccctgattacttgtatggattttctggagggatctcatgggctttatatgttcgatctgtacattgtgtatttgtgttgctgcaactgtctgatctgcaattctgcatctataagcttcccaatgccttccatgcttatccatagtagtagatccaattaattaggacatgaactgaagaagaggtgagaaactatcaaacacatatatccaacgcagattaattgctctaggtgatgagcagcattggaggaagaaggaaatgaagcaccgttgactttttaagtacgagtttgaccatttgtcttattaaaaaaatataagtaattatttattcttttcatatcatttgattcattgttaaatatgtacacatatagttttacatatttcacaaatctatctaatctaattatatactaaaagtccattaaacttcctacaaacgctcctaaaccgccacgtgcccccctacaaacgctcctacgccgccacgtggcactctaataaattagaagaattaagcaaagcatctagccgttggttttcatttaatctggtggacccactatttttaaacgttagatatagcataaaaaaatatcaattagatttattattatctttaaaaatccacacatgccctgtacgtgtacgtgcatgtacgttacatattttgtacgtgggccctactcccccttttcttttttctttttcactaacacatgagaaaaaacaaaattcatattccagcccatatggttcggagtatgtacttgcatgtagggcctcacgtccccacttttcttgtctttttcttttttttcactcacatgagataaaaaccacgttaataatttcaacccatagttgtacaaatataagttattttgagttgtattgtactatacgcacgtcatcgaaatattcataaaatatctaaataaatgaataatatacattatataatctatctatctattatatactaaaagtccattaaactttctataaacactctcaaaccatcatgtggcgctctgatatattagagaaaatcataaaaattctaagaaaaaagaaaaacatctaccccttgattttacacttaaattggtgggtcctatattacacaccgttagatgaaattgattttaaaacaaaccaagtactatagggtcccacctctcctccttctcccgcacatgtgtgggtatacgtatgtaccatggtatgtatgcttccttcccttctttttttccttttttcttattttccccatttatataatagatatatatatatatatatatttaaataatcataatttcaccaacaaagaatgctcacaggtaactaaattagctctacaatttttgaaaataaaatttacaccattatatgttaccattaaattaataatattatatattttctacataaacatgtgtactcattattttgtactattattttcacataatgcactattttaaaataaagtttacacaattatattgtgtacctatcaaataaataattttagatctatattaactgatttatatgtgcacttaaactgatggacccattatttaaatcatcggaactatttttttttacattggactattattctcaaataatgcactaaagtctacatcattatattgtgtacccattaaattaaaaatttaaaatctataataactaatgtacacttataaagaaccggtggactcatcatttaaatcatctgatatattatttgctaataaataaagcgtccgaagttctctttttggcccgctacacaatgcacgtctgcacctttaccttttgcacgcgtgacaaagcatcgtgtctgaggcatctaaggtgatcatgactgccgcagcactaacgttttgccacatataaattcatacatagagaagattaatttattaataacatgaaaagaaaattagaggtgtgatgcagcaagagcagaattaagcaatatgggttgtgttttttctaacacttagctctatttaagttaaaatcgagagttaattacagaataattataatgtattgtgttatgtcgtgtttggattttgtactatttgtagctctatttaagttggaatcgagagttaattacataataattataatgtattgtgttatgtcatatttggattttgtactatttgttggtataggtaaaagaaatcattatgttataatatgagcacaatattaacgaatatcaatagaactcttacaaagacaagagtgctataaggaagtttaagaccctctttttttccttgattctatagttggattttcgtttgcacgctttccaagtttctaaacggtgtcatttttaaacaacattttaactttctagaagtcaattcattcatgtataccctcaaatagctatcacataaatcagataattcatcaatttcagctgtcctaaaccctaagtagtatatatttttttcatgcgagtcatggtgatcattaaattagggatcaacggataatcaaagtcgtaagatgaatatgtacaaactactatcaacaactgtaaattggtgtcaaaattaattgctactaattagacatctaatggcttgctagccacataattaatttctctcgacatgtatataaacatgcacgaagctagaacaaatattaccatatgccccatacatatatattaagcggttaatattctaattacatgtgttaagtcctttaaaatttcttaaagtgctctcaagctgtcacgtggtgctctaataaattagaggaaatattagaaattctatggaaagaaaagcaaagtatccattacttgattttcggttaaatcggtacgcccaatattataaaccgttatattaaattgatcttagagcaaactaaatactgcaaggtcccacctctcatcccctggcataggtacgcacctacgtacgtgggtacgtacgctttccatcccttttttcatttttccctttctttttctttctatgcatacactcccctcccccctttcctactatatcatgcgcttcatgagacaatttatcacaagaattttgagtatcttgctctcgtatttttcatttgtggccatacaacacggtatgtatatgaatggcctgtatgatatttaactagcaatagtttattatttactcgagaaaaaaatgattcaaaagtcgtaagtacttaattcatctcctactcaaagtttgtgaatggttttttaagatacattaagaaaaatagaacccttaaataatcataaaatgacattatccgagctttagtttgcccttaatctatgagacaaaatttttgaacaacaataatcttatctttcaataatataagtgcccgcgcatgcgcgcgggccaccttcctagtttttttaataagacgaacggtcaaacatgtggtaaaaagtcaacggtgtcaaacattttgaaacggagagagtatatgatagggactcaatctgatgacataatgtgggtgaattcaattgtgccaattgaattgaattgtgtgctataccactaccactatcagatgaactgagtacaatggcatgtggcctagcgaaaaaaatgttaaacagcatatacttgtcatggctttctgcagtgtaacaagttttttttttttttgagttgatgcaagttatggaataaaatgtgacagattttatgtagacactgatgaaatccaccatcttattactcacggtagggacaaggtttgaaatttcgttttgcgtatttacccagggaaatttcgaatgaaatttgtattaatgtgaataaattttgactgaatttgaccaaaatttgactattcaaaagaattgaaaatttctgttgaaaaagttcatgccaaaggggtccgaaattactgaaatatagaaattttgaaccgaaatttcaaacattgggtagaggacgcaaacccaacttgtgaaggagttcaattgccgcgatgaactatatcgagttcagtactttttttttgttccaaaaaaactctgcccgaaacagcttatgcaatctcattgctggcctagcttcttggatgattctctcaatcaccaccggcacttgcgacaacacgttctcaaagaagtgagaactgtattcccggcctccatgggtgccgcaccacgaagattaccgtggagtagaatctatggtgttataagttctgatatgcatattttattctgagagaagttcacccaaggcacctataagcttcctcatgccttccatacccattcgtagtagaggcgtagaaccggacgtgaactgaagaagaggtgatgatttatcagatgaatcgattcagaagatttctctagcctctaggtgatcagtagcgttggagggaggaggaaatgaagcacactatacatataggggtttctttctgatcttgaggaattacatttcaatatatatatattgggataaaggacctagaacaatagataaggtaagataattgatatgactcaatctgacaacataatgtgggtgaattggatggtactcccagctgaattgaattgaactgaactgtgtggttctatcactatcagatgaactgtactgcatgctccattttgagaagaactcagttagctctgaaatacaatttgtttcaacaagagttcactaggtcttaagggtacatcacatgtcatgcattcactaatccaagaaacagaggaacaaagatcactgatcgattattttcagagtacatgcctgtttctctctttgcaattgatggggttcaagcatcctaccgaggcatcccgcgtggttgttgatatatgcaagaaactgaataacaccgaggcatcctgaaaattagcagctacttgattcagacgagaaaactaatctatgggaaaagtcacaacagataagtaccatcaaatagcagctacttgatttttttagataatgaaaatggattacatccccggcttctgtcataagacacacagccacagaaaacttttatggtacaatgaactgctagtatatactgcaagtatatatgatctaacggtgtatattgatttgatattttagttaattagattgcaatataaaatttgaaagggtaattttgtcttttctttcgttattctatcatcaaatcgtgctatcgtcacgtgctttgtcatcaaatggcgatcaggatgctcctcccctagtgcacgataagatctaggaccgggtactcccaattagattcaatctgaatcaaaaattactaaagtattattttattttctatcaaattcctaatatgcccttctatatactgccagtatatactggtagtatattgtaccgtaaaagttctctatagtaataaaaaggtaaggtaaaagtaaatcaaaatgagaaataaagtgatgggacaaatcctcaattcccctttattattgactagcgttaaaccacataaaatttttttagctagcaattctaatggaactacgccaccaatagtggaataagagacccttagctaccgattccaagagtatagcactattgcgcatagtatcctgctcctcctgtgatagcatgatcgtataccaaaagtggagccagtaggaagacacgaagataaagcagctacttgaatcaaacgagaaaactgatccatgggaaaagtcacaacagatgagtgtcatcaagtgcagagcatgtcatcctctagaagatgagactaggatgtgattgtcaacttccagatgccttccatgcctagctacagcaacaactagcaatggcgattgtatttacacatgcagtgattttgcatatgagaaaggtttcgaagcagaatgagcattgctgggagcagctacactgttctacttgtatactccagtatatttcttgtatgcaatgcatatgcctgaagcaggggagatgtgtgtcagacaatatgctgacaatgatgatagagtaaattttgttaaggttagcaagggcattctagttattttcatgtttattgtgcacatttatatgctcctttgagcaagcctatctcaatgtatagagttttatccccaaatttcccttcttctcagcatcttgacaaagttaataagcagcttggcaggaggagcatgctgaactatgattgatggtatagtacttgatactgggggagttaaggatttgaatactattccatttattattactatgaaccattaggggaggacatgccctgttagaaactaaacacaaggtggttttatttgtactggaaaagtggaccatattcagaaattaatgatgattgatgatgcaagatactactagtatatgtttaacaatcagggtcagggaagaaaacatggaagaatgcccactcaacttcaattgatgccaaacaaaatatatgcaaatacacatacgattaatcagatgtaattaatcattgatgattagaacaacaaaccagtaacaagctagccagccatcatctactccacatttccctgcgagagaagtactaactacctagctctgatactaatcgacggagactcgctgggacatgccaagcactcacctttcaagtacacaggaaacagagtgttgatgatcagacggcgcctgtttccatcacaagtagtttgagttcatgtggtgattaactatagatagccaacaaaacgatgacgtttacaaggaagcactggatgccatgggaaaagaaaccaatgacgaattttatgaagtgcgaagaatgtcatcgtctaagtcaaaatgtgttgatgatattaccaagttcaggattcctttcatgcctacagagagctagagctagagcttgggtgtaatggagattgcatgtcacacaacacaatgtggtgatcatgatgatatagcaaaatcaacttcactagttcaggacttcagatcagaaccttggcagcaggagctaagctagcatgcatatatgatggtagtactataggagtaaaagaatttggatcctcttccatttattaccattagccattaggagtaaaataggagtactaccattttctacatgacttggcagtgtgaaaaaatattgcaggcataccatcttgtagtttcagctttacattgcaatttattttgcaagtatggattttctggagggatctaatgggttttataggttttattctgcatattctgtagctctagatctgtgcctcgcacctaaaaatttccagatgccttccatgcctattcgtagtagtgtagagccaaggatgtgaactgaagaagaggtgaacaatcatatatcgagcagattgatcaatagcattggaaggaggaatgaagcaaaatatagtgtggtttctttctgaacttgacgaattacacttcagtgtatgtatatattgggataaaggactcatatcatatatcttcactataatggagacaaattatcatatgcatatatctttctaacaggtaggtaagatatatggtacgactcaatctgacaacataatgtgggtgaattggatgatgacaattgaattgaattgtatgattctaccactatcagatgaaatgaattgccttgttcaagtattttatcaagctgtaaaaaaataagaggaagatgaaattaaacagcatgggcttgtcatggctttctgccgttagggaatcagatgtgcgagattttgaaatgctgatgaaaaatcaccatcttattactcacttttatgcaaagaccaaaccagacaatgagttcaattgcctcgtccaagtacagcgagttcagtacattttctgttcccaaaaaaaaaatgatgcctgaagtagcttgtgcttctcatagttttctttctgcaatgtactacatagaggcctcattttggttgtaacatatacccaatccatgggttacatacaaattcaaactagtagcaggcaactccaatgtagtgccgagttgtcaagaccacttcttgctcaatagtttcgatatggtcaagtcagtaccaccaaatccatccatgacggccttcgcagagtgaaactcagctctggcggttaggctgggaaggacaggcacaggtaagataaacacaagcaccaaaaaattggggcctaaggcagtggaatgatgactaaattgtatgtgaaatcgacttttacctgcttctaacaactatgcatggcataccaatgcgctcagctgcaagaacgccagattggctacctgcgacaagaacacagttttgcacgtcccgtccaacatactcggatccagcgcgtagagtgacaataatcttctcggagctgatgatgcaaagtaaacagtgtgaagttcagatatatttctcatcaaagtacaaaacctatgaataagcaaacaataataaccttttagacgctgcattgatatcaacactaagtttcagaatggacgcaacttcttctgctatcctctgcttttctgcaaaagctgtaacacagcacgcaggggaaaatttttaaca

SEQ ID NO: 55800 - DNA, 2492 bp, Oryza sativa
gcatgtcattcaggtccagattatcttgacagtgtcatgcatgtcccaaagtgcaaagtttcatttctatttattttgagaagaaccacaagagttgactgggaaaaaaatcaataaatatacaaattcaaccttgaagttttctctccatttctcccgtatgttgtcaatatggcgacaggcacaccctcattaagcgcatcatcaatgaacctttgaatggtttaatacacaagatcagacacaatgtaacttccaaagttcaagatagtagtaattcataaagcaagctcatggcatagaaaagaaaaaaaggaacaaaagatcaaaacaacgacagaacagaaagatattgcttacaaatgctcatgcattgatggaaataaagcaagatgcatgggtataaaaaaaacacactggatcttttgaattatggtaccatgtctgccatactttgcagaatgcaaattctcacataaatttctggtaaagcccctcaaaagaactaccttgcataccactatggttatcatatcttagaagtatgatttataatgatcctaaaagtgatatatcaatcaacaataacccaaatgatcctggaattatttcactagagagatacttcatagaaaattagataaactgggaacggtagacttactgttcaactccaggccgcagtggtaagctatcagaagctgagaacacttccaaagctttcagctatgagaagaagcacatgtaaacaagtcagtagaaggatattttttggtctataggaaagaagacgaaaaaacacccatcaaccattttgatctggactcccgatagaagaaaactcataagttgattgaaatcaaatgcaaaatacaaatagaaattaacagaaccaatcataaaagtcagtgcattggatggttaatatgcaatcctgttctcagggtatacccaaatgcaaatggttttctgactgctaaaccctgcaaaagcctaagttccaaaattcaaattgccatttatcttccattagcagaacaatgcatggtccatcatgagaaatattttgagactatacagccatgagaattgagattcttaactaaatacaatcaaccctaattcaagatagtctgcctatgggtaatcataatagaaagttcatttttttttagtgccagtatggtggttttttcttgttaagtacctgcatagcgtaaagtatgtatctaccttttcacgaagaacacttttcataaatgattctttctcgttagttggcaaagaagtaggccacccaatctgtgcaagtcagaggacaggatagtaataagtaatgcatgcatatctcaatcaatcaacaaatgaaattattcagctctgcaatagtactgtggtacacaatgaatgatttaaggagaacagaaacaatagtattattggatcaaatatgacagctaggagaagagctaggcgtactctgttgaagaataataacaacatcctttcctcgtcgccactagctttcctaaaaaactacatagcttcagacaaataaaaaaacaaaaagagaatgatagattttcatgcagtaaagtccaaaatatattctttgtaaagagaactatatagaaaataatagagactggaaatagcaggggaaaacattcattgatgccaatagtaaatccagtgcaattcaaaagagcgcatgtcccagttttgatgaagctaaagagtatagtatgcacctcactaaatcagcatatattggctctgtccaatttgcacaatccagcccaagattttgaaatgctgatgaaaaaatatgttagaaattgtgctagaagcattaagacagacaacaaaattacttatctgcagcactatatgttacacttcttctgttaaaaccaaacaagttttattctgtagaaaacacatgttggttattacacaggccaatggtgtcaatataattcaatgctttgcacttgtatattggcatcgcatagaccagataaatgatcacagatatggaatggaattgcattaagcaaagaagcatatttacattgttcgcacctacattgaaagcttggcgattgccgaagcgatacacatctgcaagaactctggagaaacagaggaaattctatcacacaatcatgaagagtcctcagagaaaaaaaaatcagaaagaacaagccacaaaaatagaacaaagtcccaagcaactactacctccgtttcaggttataagactttatagcattacccacattcatatagttgttaatgaatctaggcacacatatatgtctagattcattaacatatatatgaatgtgggcaatgctagaaagtcttataatatgaaatggaggaagtagtaactagtagtagtacatcacaaggcaatcgcatttatcctgagttcctgacaaagttacaagactaatcgaaggcggtattagaattccacagacagt

SEQ ID NO: 55801 - DNA, 19284 bp, Oryza sativa
  unsure (1)..(19284): unsure at all n locations
aggaggaggaggaggaggcagggatggaggaggagaaggccttggcgacctccggcggcgaggcccggagcgggaggcagcgagcggcggccatggcggagaggagaaggtgcgcgtgagcttcacgaataatagctcagattattatttattttatttatttttccactatataaatatataaataaagtgctacacgtacacagcaagaggcatccagcagtgtatagctaatgtccaatggttgttttgttctacactcttcttagtctgtgttcttttggtgttggtcgggaattaatccccgttcacggaaaacggagtgatcaattagcgtacgattattaagtattagctaaaaatatttagaatggattaatataaattttaaagtaacttttctatagactttttttaaaaaaaacgtaccatttagcaatctaggaagcctgcagacgaaaaatgagggaagtgaagtatgggaatcatcacaaacgaaataagcttgttactccatcttttttaaaatactagtaagtgtgcacgtggaatccacgttgctaataaaataaataaaacacataatataattgttcaagtgctaaataattttcagatttcattttttgtttcaagatcgattaacgatcagtgaggcggtcagaccctagcttcatataatcacacagaaccaaaatttgagggagtcccatctaccttttgttacagtaataacgttttcaaagagtaccacaccaaggaaattatttaacttgttgacgtagtgcctgtcttgcaagacacggattgttcctgtcaaaggaaataaaaaacattctcgagccaatccaccaattatattcatcatctcgaaaaacataaatatcacaatcatttacaagagagaatttttttgaaaacagcttttggtgagcttccatgcattttacaagaaggtggttgagagcatatgcattacacggtgtgaattattatcatttaggccccgtttgatttagattattaagctaattattattatggattatctactataaattaaatattttgagaataaacttaaaaaatagcttaaaataaatggactaaacaaaaatcaatttctagagctatccatattccacagtatgaactaaattctagatcactcaattcaatcagaagatacagtgacaaggtaatgacgtaatgttccaaaatagaactcatatgccatttgcaaacatctcgaccttctacatacaaatctaaagatccacttgtactaattcaagttcatttatcaagcatattaaacggatagcaaacgccaagctgcagtatgaaaatagcccgaattttaaatgatttcataagtaattaccaggggccactcaaagtctagttcgtcaccttgcaatattttaccaaccaaaaagcaaatttcaggaaatatttcacttgatgtagattatggtaagtaggagcaagaaaaactcaaaccgtgtaataggatcatgcccagcaaatccatcttcactgtttatagagccagtacacgcggattaaaaattaaagttcaacaaagttcaatggatttactctaggtctctagcaaacccctcttgatcatagccatgtgctggtgaggtgcttgtatgatgttcttgatgtcccacatggccatccagttggtgtttatcatttctagcacaaacttgatgtcctctattgaaacaaagtctaagttgataaaacaaaggacataaatctgtggatttctgatgggtattaagttggtaccctacttatagctttcagctctcataagagtgtgaaggtgaagaaatcaaaatagctacatagaacggactgaaatcactgtattttacatgggtgtaaagttggtacccttttgttgctttcagatctcataagctgatgttttactgtagaaaggaaccaaacaaaattttgtcagacatcagcgtaagaaattaagaagtaggtggcactaatagaaattaagagggctagctgtgcaaactatatcttactattatgccttgatttgacaatcctaattgattttactactatattccaaatggaattttttctaagaaaacacacatatatatcttgagagaaaagattttacttctcaagagaaacctgtactaatttactaaactcgaaattacttgtgctcttggatacattttcatgcaaaaatttacaggcacaatgtatgcaaaatagataaaatccctataatactaacctggatttgaagaatgctatgacactgataaaaggaaaataaaaacattgttgctccatgaatagaaatctccaacattcacaaaaatagcatgaaaaaaaattgagtgcaagaaaccgacttgcctgtaccttgacctggacagcatgtgcctcactcgcacgcatcaatgaaaccagatgagacaagtcttcagcaactgggttggaggggactgctacctcatgcgtgacctggttgtatcattgacgaccagctaagagacgggacatccaatggagatcactgccaacacaaactacagttcattatgtccttccataagcatggaaaatatgatccaaaatgatggcagaacatgcaaactggaattgcgggagcctcaatggatgaccatatgttcaaaagctttgcaaactggaattgcgggagcctcaatggatgaccatatgttcaaaagctttgcttaaatcgacgaagttcagtagaaatcttgttttctaccttcagaattacagtactacaaatgcaaaggttaagtagaatacactaagaaccattgaattgttaatttgaaagcagcaaacaatcaaccagaaatttggtcagtatgacatctataaattgtcaaattgtaaacaggagatgatgctagtgctagctaagcatttcatcaaacacattgcaagcatgaatatagaacatcaacctcacctgttgctggtgttgctggtgtccttatttgctagcatgaatgatgtccaacggccctagtcctgtgccctcgttccagcgcatccctgataacaacaacaatgaaaaattatacaggatgttgatgatgacagcagtggtggcacaggtagcggtcctaggggtcgtcggctctacctccagtcggcaccctctcctacgaccgcgccggcggcctgctcctccccggcacctctgttggcgctcgcctcttgcccagccaacctcgccgatgctgacgggccatgcgcagcgacctccagccctcctccaatggccccctctcctcctagcaagactctccgccacctcatatcccctttccggcgggcggcacccggatgtccggcccgcgcgccggcgcgcgcgaggagtcagcggggtagggggagcagaagtgcagaacccgcctctctttcctctccatcgcggcgcggcgcggcgcgagcagggaagcaggcagcggcgggtagggtgaggcggctccggcgggtgcgcgcgaggaggaggcgagcagctccggcgggaggcggcggcagcgggctggcgcgctctaggaggagtcgagcggctccggcgggagaaggcggcggcgcgctggagcacaaaagggagcgttccctttcttttttctttgaccgatccctaaccgctgtttagaccctcgcaaaaaaaaaaaccgctgtttagaagtgggagatcgctaattgtttctttttttcccctaaccgctgtttaccacgtgggaatcgctaattgcaggggttgatccaacttttgatataaaccgttagatgaacagatctaagggtcaggagagagaggtgttagatgaactggtgctttttatttttaaaatatatatataattccaaggacatccacaatgtgtcataagaatgaaccataagaccttatgactagccatatacattgtggatactagccataagacattaaatgctaaaaatagccataagcttatggttcaaccttaagaaataaaataatgagataaagcacacgtgcacactaaagagtatgataatagattatggtatggtgggacctactttaaagtagaatttgtttacatagatgtgggacccatcttaacatctattcttgctttaaacattgtggctatggacatagggtatggtgggacctaccttattttcaccaacaccttaagcattgctgatgctctaaggatgtaccatgatgtccagacatatctttaggactagattttctttgtagggctgtgatttgtggagaaggtgaattagggattttactgttgattcattggtcaatccgaaaggtatatttgagtataattcattggtcaatccgaaaggcatatttgagtataatgaagatagaagttactaatatacctctaaatacatagaactagccaaccatcttatattgttttatgagtggagactggccagccttgttttggaaaagttattactacactgtcttgctttatactgtcttgcttagggtatacaaaaccacatagtcatcacacggttaccggttatcacgcgcggtaaccttcccagtttttgaaaccaagataattctcacagtaaccacatggttatcgtgataaacgtcttatcgtagggtaacggtaactccacctaaaatggtttggtaaaccctggtcttgctagtactgcttgaacgatctatacatacacaccaaaacaacatgttgctagttgccaccactaaatttaatgaagtggaatttactgtttttccactttctacacctttaccatgttaaatatgggtgaaaaagaaaattctcgaaactcatggcttatagtcttagatcgaatcatatcgaacttggcttggttagctaaaacatgtacttataatgagctgaaccgattgagttaggttcatggttcaccaaaccattttgggtggggttatcatctcccctcggtaaggcggttaccacggttaccatgaaaaccgtacagttaccgtgagtattaccttggtttcaaaagtaagaagattaccgtacataataaccatgtgatgaccatgcgattttatgaaccctcgttaggcttttagctcgttgcctagcgagccaaaactcgtgtttagcttattcatgtagaatgtcattatatcattatatatatttagtgtttcttagctagctagtagttactaagataccttacaacaatttgtgtttgtaattagtgagtactattttactagttattatttattattatgttagcatatgatacatcggcaaatattgcaactatgtggcataagaacaattttcccatatactccctctatattttaatatatgacgccgttgactttttaataaacgtttgacctttcgtcttattcaaaagatttatgtaattataatttattttattatgacttgatttatcatcaaatgttctttaagcatgatataagtatttttatattggataaaaattttgaataagacgagtggtcnaacgttggtnnaanagnnagcggcgtcatacattaaaatacggagggagtactaatgtacaatctagctaagaagcatacaaactttcaaagcctgaatgtagatgcaaatcatgcaatgctgctaactttttctcatgcatatatataattaacatgtaatacacacagttaattacatatgtacatactgagccgagactagcaaagttacatacgtataagtagcatactaatggagcaattttacagttcttgagaagggtaacataaggtattactttttctactgtaaaattggtatctcttgatattagataccaagagatactaaatttacattaaatgtttggttactcatactaatatcaaagtaatgcaagctatagctaacatatagttgttcgatctgcgtcaattaattaatttattacaagtagtaattattattagcagaattggtagagatatccatgatcctccccagctcgtcccagctactgccgctgctgctcccgccatccctactgaagctcatcacctcgctccaccccgccgccgtcgacgacgacgacgacgccgtcccagcatggaagtcgagcatgaacggcgactgacgatgacgaatgtcagcgacgaggtgagactgagagtgagagtgagacctcgtcgtcgtctcggcgtccgacgagtgatcgatgacgtcgacgatgttggccgccgccgctgccatggaagcgctgccggcgtagtgctgcaggtggcgacgatggtggtggccatggccgtcatggactacctcgtggtagtagaattgctgctgctgatgatgatgaatgtgctgaagctcatggctaattcgcttgttcatggatgctgctgccgccgccgccctgcccttggtgtaggtcatgctcctcttgaagatccggcaaatcgtccatgtctcctgcatgccattgatcgagatgatgcatgaccagtactatccatgaattcaattcagaacaaattaaaggtgtatatatatataagagatcattctgacgatcgatgtagctaattaagctagctagctagtgacgcaatgatgtgcctgtctagccgattgcgttgtgtatcaaaaatcttttccttctaatatattgacgtgcaatcttttgcgtgttcacgaaaaaaacctgacatactgatgcgtcttggaggtgatcggagtcggagatggaggaggggagtcggaactcgtgcatcatccaatctgtcttggtgcctttaccggcgctgccgcggtagtagacgagagacttcttgaggccaatgcagtcgccggcaccggcggcggcggcggcggcggcgagtgaggaagagtagattggcttgtcgatgccggtggccttccagaagccggagccggtgacgcggttggggcggatgctgttcctgtacttcctccctcgaaggcagaagaaatagccgcactccttctccgccgccgccgccgtcgacaacgacgacgacgacgacgagccctgcagcgccaccgcgccatggctcacctctgcattcacaagcacaacattagaatttggttgatatgcatgcatgcatggctcgttgttcatcatttttatctgactttgctgatatatatcaattattctctcaaatctctgattgtgtgttaattgttcagtgtttaatttttattcacgatcgatcgatcagagaggattattcagagatacaaattgtaactgatagctagtatatactaccacttatgactgaatttccttttttttttcagttacagaaccaactaaatttaaatgacacataggcatgattttatgaatgtttcaattgcaggagataattagtcatgcatgacgattcgcctatactagtcatattattaaccttcaccaccaagtgtgacaaaaatttaacctctggtatcacaattaatatatcttgcatcatattcttataatcttcttgaaagtaagatgaactaattgatatgcacaaaggaagaacatgagatcagaaaagtaatacggtttcatgccctgaatcctgattttatcccctcttacttttcagtgcacatataatgatgcgtatacatgtgtggatatgttcaaatcaattaagaacataacttgcacgtacaccagtttttttcttaaaattaagaacaaaattgaagtaacctacttggaagatcccagggatcatgcttgtagatatcgatctccttgatgatgtcaatactgaaaggcttcttctccaccttccttgtcagataaaaccccacgagctcttgatccgtcggatgaaatcgaaaccctggaaacaccagatcatcatcttctgctaataaagctgctcctcctcctgggctaattggactgtcaatctccttaataatcctttccaacctcttctcctcctccatggcttaatcttgtagtagctagctagctagcttaattggacagagctataataacttgtttgatcctatatacagctagttatatatagtgtatgaggtttagtgttagctatacatagttgcttacatatggtgatggagaagtatggccatggctgctgtattaataaattaatgtgctatatttgaccatattagaacacatttgatgattaattatactagacaaagctatagcctgggataataataagatgctggaaatttttgtctgagcaagctgagtctaagtcaatcgagttgaaccctctctctccctatgggtctctgcagataaatcgtcgtacctctgatgacttgctcaactcaattatatgtcgaatcaggagatttttcttcagtgacgacgatactttatttcgatctcgccacagcaaattaaatacaggaaggattaatttatttcgaagtaaaattatcacattgttatatatactagtggtaggcctgaatatatatgtagcacgtggttttcagagttgtgggaggccgttgaacaccttaattagagtctcagtttattcagaggcaatgcacatatatgggaaattgacattctaccaagtcaaaggcagataatattgattgacttggtagaggtgtgctactcatttcttccaactgagacatgcaacccaaattactcccttagtgcaacttataagatgtcaatgcattttaagattcaactctcataatatttgaaaaacaattagtcaaatataaatttaatttatttgataaataaaaacaatgttattggattgatatttgaatgtactagctttttatagttatgatttaatttgttgctacgaacattatattatgtgagaaactgaaagtcaaatagtagttttgaagacatcatgtcaagtttaactatgtcttatattttagaatggatggagtacattttagcaaataaaagaataatttcttgatgtatgaagtgtttacaaaattattgattcaaataactctcaattcaatctgctaaagacaactcgaatttctcgcgttgtggaaattagcactaaaatttcgacacctcgtgatcctttatcaaatactgcaacaatgcatatcaaaataaaaacttaaattaaatgggcataagtgcttattataatcgaagaagcttctgattaggttggacagttaccatctttttgtagctagttgcacgactaactactagtaactacttagctagagccaagaatctcataccgttcataccaagcaactgtacagccataggatttagtcacagtgtagacagtgatgctgtggattaattagcaattcgaggatttataatacggagaacgaatcaatctttcaagatgtactaatgaaaaaggaatgacgaactttgaacatttccagcttttgaaaagtacttgagagtcgggttcatcatattcggcctgaagaaaggataaattcgagaaatatatttcagtcaacagctgtagatttgtaagacgaactgatgaaaagaatttttcaagggtgctcacaaaaggccactttaattaaagagttcgttcaaaaggaggatttgagggtttttcttggtggctgttggtgccttggtggagttaattttggttaaaatcatgtgtatggggccacaaattgaccctttcatgactctctaacctccagagaaaaaaatttacatggtaaatattttctctaaactgtttttttacagcttattcgttttatattttttttcataaactcctctatctaaaattaattatactgcatgtttttgtcctatgtaagtccaactttcaaatacaaatactctgtttctatgagccgtcaagcaatgggtaacctaacaaagaaatgaagaatcctagtcattttcatctgtcagattggacgaaatgttgctatcacaagctttgaacaatgggtaaactacagattttacagtaattttttctaggatcatgcaagaactttgtcaaaagccttgacgtaacggtacatgcgcggtagattcggcttgatatttttacctgtcactcagtaatttactggaaagcaaagccaatattttcatctttgttgggttctcatcctggaaggtgaaatcctgaccactggaccttttcttcttcctgtgatcaccaaagtcagcatgctctgctccttgccaaaacaaaaatggaaaagattcaaagcaaagagaagaagagttccaatcttctagacccagttgctagcaacagatccattgtagtaattttttaaaaaagtatttaaatattgggtttagaagactattgatgttcagagtttttacagtcaatggcaccggttggcttgccagggaagaaactcaattagcatatgattagttaagctttaactattatatacttcaaattttgatttatttgattttctttaaaaaaaaccttatatgtagaaagttttttttaaaaaaagatcacatcgtttattagtatgagaagcgtgtccgtgataatgtaagcctaaaacgacaaatttagaagactgaaagaaaatgatagttgagtgttgacctgccagattagtgggagtactgtagactgaaactttctcctggatgttttgtcagagaacttcagcattatcctcatagtttacttagaggcatcaaagaagtacaagtaaaaccacttggtgtgaaactgtccgatgcttccaaaaacacatttttgcaaattgcatcatccaccatgcttgctatcctccatgtagtaaaaaaaaaaacatgcatgtatgtagttttctgtcctgtagaagagtctaaggggatggccatgtattctctcatgaccccatcagctcggttgacatgtttgatatttccttggacacttgattatacattggtcagcaatcttccaccagattgacttaaggtacagtttgtcaaaactatgtttgtttacgggtgtaatttagtcaggcatgaaacaaggaatcccattgtttcatactaagagaaagtagacattgaaaccactgaaaaatgagatgattactgaatccaactctttagaaaaaaaaacctgcttaattagtactcccttcttcctaaaatactagtttaggaagtcacacattcacgtgactataaccattctattgttaatggtattctattattaatggtatagatgaaaccttatctatgatgttcagcaattgaagaatttgagtattagtatttgtgaaaaatagaaacgctaatcaataacagaaaattttaaacacggtattgtaagatgtacttgcaaggatgattttgtagacgatgatatagtagaaccctttgtgtcattgaaatgagggtatgcatgtgttatcttgggcaaaggcatggtttaatactgtcattgtcgttgttctttcttttctttttagttcctacaaatatgcatgagtgtacagtgtactgccctctggaaattctgcaacccaaaagtcacaaccatatcaaatactccctccgttagtacggctcactcagacgatttgttaatccttgatcttcatgataacaactgaagttaatttatttttaatgatgtaatttgtcgatgtatataatactgtacgacttagtattataaattgcattttaacttatcttttgttaaataaaacacattatataaaattaccttcttgatgagtgcttttttttttcttaaagcagctgatcactcctcctcttactgtcttacagcatatttctatctataagttacagctagaagatggttagcgatgacaatgtctacggatacacaggcgagcaggtgacgatcaggcagtagccaacgacggaagaatgaagcaactaccaggtggtgctgaggctttgaagaatgaagcctacaaatctccaaagtccaaacggccagactaaaatggatttacatctcgatgaggtctacgaatccagagtctccaatcgtccatccgagctatggttcaaaaagtcaacttttcagtctctattcaaagcgcccagtcgatgccaagcacatatgtattactcccttcgtcccagaatataagaagttttagggttggacatggttattaagaaaatatatagaagtgagtggtggagggttgtgattagttggaaagataatgttgatgtagaagttgttatattttaggataaatcgtgagggttaaaagttgttatattttaagacggatgaagtaacatatactaggccctagttcagcaagcctgagccatggtgtttatacaataggccatacaggcctaatggttgcatcaaaatagtacaagtacaacagaccaattacaattgagactcgagagagtatgcccaaagttaatggctctttgcaagaccttgttaccaactccctactttcgttttccgcaccacgtttttcaaacagctaaacggtgcgttttttaaaaaagtttctatacgaaagttgcttaaaaaatcatattgatccattttttaaaaaaaattacaaatacttaattaatcacgtgttaatgtatcgctccgttttccgtgttcactctttgggttgggaacatgttcctacgaacacaactagcaaagttaactatatgtgtattttttgttttgtgggcttattctcctatactggctatgttattttctttgtacatgagcacattttggttctttttgtctatatggattgtatctagttgatgtgtacaaatctagatcagaaaaagaatgtggctagctagttgtcctggatttatatgttcgttaatttgtacaacttgatgaagttctttacattaatacaaaagaatctgaacattgaagttatttagtttatattatgaaattttgtttaggtttctgcattaacatgatgccttgaggctgctcagctaaggcttgctcgtcggattgccaaacaatgcaagcacctaacatgtatatatatataggttgcaaaaatattttctagataaactcaattaacatccatatgatcaatctaagtaagttttcacacaggtagctaacagctgtatatccaatgagccaactaatccaaataagaaatttttagttccatcactatctatattcaagtagattgatgtattattagtttataaaggtccaagccaatactgggtatatgccgctaccttatacatcaaatgaatgaaaaatgagtgaaatgataataatggtggagattgtgctaatggtacagtagcagacgctgacatgtaagcccgaatccacgtatcagccattgctactgtgtcaacagtagcagagaatgcactagaggcaggccggcagatgattttccttgatggattggaattcagaaaataatcctttcacgggcatcgtcgtgtgggtgcaactcttccagtaggaaccagcgttcgacagataggccttttgcacaggctaatccgtctaggtctttatgttcataactgttccaagtgtgcaccgaattcgcagtactggacttgaaagtctcgaagcggcgagccatctcagcatggtcacgcttcaacttgtacgatacagcttcgtctgactcgacgtacgtcctcggcagtcacgcacttaccatcatctatatatcacaattcacagacaaatcaatcagttttacacttgcatacaaacaaatcaattagaagtattaaactttgagtaattttacggtccttgaggaggtaccattttttctattataaatttgatacctcttggtacctaggtactatgagatatcaaattttacactaaatttttggtacctcatagtatctcctcaaggaccgtagaattgctcattaaactttagttcctcagggtcgatcagggactaaaacatatcggatgtttggacactagttacaagtattaaatgtagactaatgataaaactcatttcatgaccctagactaattcgtaagatgaatctatttagtctaattaatccatgattagcctatatatgcgatgctatagtaaacatatgttaattatagattaattaggtttaaaaattttgtctcgcgaattagctcttatttatgcaattagttttgtaattagtctatgtttaatactctaaattagcgtcgaaatatgcaatgtgacagggactaattaaagtgatccaaacaccaccaatctatccgtatgctaaattgcatgtacagctgcatctttgattgtacgattggttattatggggtttaatataatgggattacctgggggctcgctgctgtagcggatggagaggcggtcggagacgtcagccgccgcagctaaacgggcggcgcggcatgcggccgcctcggctaagcgggcggcgcgagatgcggccgccgcgtcatggcgcgccaccgcggctcgggcggcgcgacatgcggcggccgacgccactagacacgacgccattgttaattagggcttactgtattttgtttctaccacatatgcatatatgtcgtcaaataagatcgatcgatcgatcgatggatgagagataggaaacaagtcaatacgactaatataaattatagagtaaaatacacggtcggtccttaaagttgagcgcgggtgtcacttagattcataatcttgtaaattacacatctagatccaccatcttgtttaagtgactcattgaggtccaaaagacctctgaccgggttgactggcttacgtggcggtccagcgtggcaacatatttgcattttgcccccctttttgattccccgtgtccgatccaatcccttctttgcgtggcgcacgcaggaacgcgtcgacggcaacgtgcgctagcacgcacacctgcggcacccacctgtctcaaccacgctgcgcccgctgacgtgcctcgtacccctctggcagccgctcgccggtgttgcgcagcgcccagagaaaccgcacaccgtcgtcgacgggaaggagaaagagcaggggaaggggaaggcccccgctctagccagccgtgggtgcacgcgacaagtggctgcggcagctgctcaagtcaagcttgccctgccgccccgctgccgccatggagctcgcacccgcccagctcgcgccgaactcgccgacgcctcccccacacacgcggccgcggtaggcgacccctccccccgggcgtggccggcgacacctcccccgcgcgcgccaagctcaccgacgcctctagcaccaacgaccagcgggaagggagaccgatggatctggccgtcagtgaggcgtgagcgccaccggcacgctagctacgaagacagtgacggcgctccgcaaactctcctctagttccctccgccgcctgccaactgctgccacattcgcccgtcgccgctccgctgctgctccgctcgcaccccgctgccgcgcttgccctccaccgttccgcccgccgcccattcgtcaagaaggatttgaggtccacgacggcacggcgtcctgatcttcgagctcgtccgccgctcgcttcgtcccctctaatactgtgtcgttggcaatcatgcgtcgcttcgtcgaggtccacgatagcggcgacggaggacactgatgttggcgaggcgaggccggagaacgtgacaagcgaggcggtgcagctgtgctgtgcgactaggcgccgcaacagctcagccatcggtatgacatggccggcgaaggggctgacgatgaggatgacgtgcggcggcggtgggcgatgtgacgacggaggcagctgagggatttgggggttctttttggtgcccagggctctactaaatgcaatgtagatggtcagcttcggtcaaaccgggtttggaccttaatgagtcacttaaacaagatggtgaacctagatgtgcaatttacaagattatggacctaagtgacacccgcgcacaattttaaggaccggccgtgtattttactctaaattatatctctatctctcccaacttctcttctactccctccaactaaaagtttaagccatagttcttatatcattgagaccactcaccacaggcggacaattttttttaattagatactaagtaaaatttggtacataaaggttctatgaaaaatttagtgtgcttcaaggtaatttcttaaatactgtaaaattcttaacatactttgcagtgatttcaggcctgttattactatctgcaaagtacgttgattactgaatccacttcttccatcttttcactagttgtaattggaaatcagcaatatgaagaacattgtttgtgtgcgctggtgcgtatgtacatgtgtgattgtgtggcgtagaccaaataatggtgaaataataaaaccagcttaagcagataatcacaggtaattaagacatgttcttcgtagttctgtcagcctttaaaaaggcaagcctgaagatcctttccttatgacactagctatcaggtgttatttatgaaagagatgattgactttcagagacatatattaaaaggagaagctgatgaaaaatgcaaagactaagtacataaatacatatattcctcgctttgaactggctcgtcaggcaaatatttgtgttttcatcaaatctaaggcaaggtcaaactccaaagtccctgcaaaaaaaaaaaaaaagctcaaactccaaagtgggacaaagttgctccatctctagcttcttttagaatggtcgtcaccataaaatcaagaacacccccagcagctggttcagagtcagttgctaagaaaaaaattcagattagtgtactacgtcaaagctactggagccagaatctgtatgaaggtccccgtttctcttgcaaatcaagaatccattgtcgtctagtccggttaggatatctggctttcacccagacgacccgggttcaaatcccggcaatggaacattaatttttgtacattttttctttgtctgctagttttgtttgtgagcagctcacaaaactaacttcaagatttaatttatggcttgttcactttgttgcttaccagattttcacaataccaatttttaataagctttggttttactaaaaaattttaacttggtgtgtttagtttgacatctttctaaatcttggtagtgctttttatcaggggtgaagctagcatcaaaataagggggtgtactaccattaaaaatctagaaattttcagtacaaaactgtgtattttagtgtttttaagtgagaattgaggaattctggggttaatgtgcaccccatacacaatatagcttcgccactgctttttataataagaaagttccaaaaccaccaaataatgttaaggttaaaatcagaataaagtgaacaagttctcatcagctgtgtttgttatgttgagttgggaactcattcccttcgcacgaaaaacggagcgatattttttttatgattaattaagtatttattattatttttaaatagattaatatgatttttaaagcaactttcatatagaatttttttaaaaaaacgcaccatttagcagtttaaaaacgtgcgctcggaacacgagagagaggagttgggaatccaggcggccaaacatatatagccgtgtaattaatttcctacgtaccactaaacagcttttttgaggtgaaatttatcgtcatttcatctactacatgtagaattttgcattgcttggagccttagcctagttaacttctcagcgaaaacgagaaagctctattagagcatgatcaattaagtattacagaagaaaactattattcaattaagcttgcatatgggctgcctccaggcccataggcccatgatctgtaactgggccgtaacttgcaaacctgcactagaatgggctttaattcttggttgtcaattaattcagtagttttgatattattaatttttattatttactagaaaaaatgcatgtgcgttgtaacgggtgaaggatattttattattgttacacagtttagttaagatgaaactcactatagaaatttgcttggatatatatttttctacaaaatcatgagctgcaattaagaatccgatcatttcaagttagcatgcgagttttttaaagagatatcttatacatatttctaaaagcgaacgaatttaaaacctgacttaaatacggatctatattttcaaaatcgaatgaatttaaaagccaactcatatacagatgatatataaaagtatcggtaaaaacatcttcaatttttataatggaagagatatacatctaaacgactgaatcttctcttgcctaagttgccttcgtgaaatttcttcaaactcgctttgaatcacgcctatatgcaccaattaacgccttgtaatcagtggatatttgcattgtgtccaatatatcaatcagtacgcgtatggcttgtggccgagtattgaacgctggctgaacgacttgactcttgtgctggactttgatctgttcgactcttttagtagcttaattattactagccctcaaaatattgtcttttgttcctagctcaaaaggcaaattaattaagtcgatctagatgtttgtgctgctatacacgagaatagatattgttgtttcactgcaagatgaacataacatttgcagatatttttatcctttccaactagatgtacacaattagtattaaaatttcacctgttattttcgcatagagagattaatggaaacgctatgcgttgtcggaaacgacgatcgagttaataagctgtggcttgtgttaggaacatgtcgcatctatgcttccaagaagcctctcatggctagttaaatagttagttaattactatcttaattaatttgatcatgtgcctctccattcatcggttcttacaaagtagtagtatatactactcctaaatccactcccaaaaaattccttcatcagcttctagtatactggacaactacttctctgaatacttgcagatgcagagagtctctgtctgcagctgttctatactccactgagctagtaacaactacttttgatctgttcaccaactagtagcattagtacagtttcttattcggatgctctctaatctctgcataataagtagcatattatactgcgagcatctaatcctaatcaccgtatttgttactc

SEQ ID NO: 55802 - DNA, 8863 bp, Oryza sativa
gaaattacacccctacctttcagcaaaatttcatccaacagagttgctgttgaccgttgacctttttgtgggtcaactcaatcaagaccagtcaaactaagcagaaagattcatagatcagtgaatgtagtgtatgaagttatagtggaaacttgaaagtatgcaatccaaatttgtcaaaagagcattgctactcatactatttttctttctttttttcgcatagctcttaccaacaaatctctcaaccgtttgatttaataattatatgggagttcaaagtaattctatatttactcacatcataccacatcaatgtttgtaatagatttataataaatcttttaggacctttgtagtaaaaaaaacaagtctaaaatcaagaaccaatacttttgggcttttggcgagtacaaaagtggaggtcttaatcaatcctcttaacaataataattaaatataaatatagggggtagagtgcaaaaaggactcaccttattagtcatcttccttagccttaagcgtaaagcaactcgtctcatcttcagagaagcaaacccaacaaaaaaaaaaaaagaattttcaggttttcttctcgctttcaccggagaaggagaaggagaggaaggtgttgatcgaatcctcctccaatcgcgcgcgattcgatccccgttgctggccgctcgctcgctcgatccctcatccgatctgaatcccccgatctgatggcggccaaccccggcaacaagatccgcaacgccaagctggtgaggaatcaaacgtctccctcaatttggtttcttgatttgtttttgtttccccctggatttagggctgatgatatttccccctaagatccctccttgttggtcgcgattagattgatgaactgattcccccttattatgatcgtaaaacaagaactcaatctttacttattggcatcatgtgctcatgttgttcatgtatcacgaattccgggtcttgggagtatgttggtatgcgtttactaacagtgttgattaaccaggttcttcttggagatgtgggcacgggcaagtcgagcctcgttctccggtttgtgaagggccagtttgttgagttccaggtgaatttcttttacacgtgaactactatgacctaagattgagcaggtttggtgtgttgggataggcttgattttgttggttcattcggatgcaggagtccaccatcggcgcggccttcttctcgcaaaccttggcggttaacgatgagacggtgaagttcgaaatctgggatactgcagggcaggagaggtatcatagcttggctccgatgtactatcggggtgcggctgccgcgatagttgtctacgacatcacaaatgcggttagtacaagactaagtgacttgcttgaattttaattaagttgtacatcttgatgatagtttctcaaagttttgatttaatgcaatcatgcctgcatatcactgaaaattataagtacggcaccacagccgcgattggtagaaattactaacagtctaataatataatttacgccattgaaaccagaattacgattagtaagtattggtaaaatcaccccttctctgtgattaacatatcgaaccaagtattcatgataatcgtacaccaactttgacattttaatccatcatcttttattgtcacagaagattcgaacttcctacatatagttttaggttatattgctcttctggtcttggttcaagtgtggccatgttttcccagatgatagactgatgagttggttctgccattaccaattagcaactcccatgtcctggcgttatggcacactgatagtagatcaactagttatcttcactgtttttgcaccttgtttgcatcttatgagcaagccctattcggagaagatactgtatctattgtgtgcccttacttgaacggaggaacccttcaattcacggtcttgcgatcttatgtattagcatattagcaacgcatctctttatatttttcttgcttcacatgcagcttttagtgtgtgttcttggtaaacatgatttcgatctgcattacaagtttttgggaagaaataaatatatcatagttgatagtttacaccgtgcacaaatttaagtctaacttcattcatactgttttatctgagtatgctcactgctcattttgtaaaagtggtgctaatagtggttctcatcattattttctgccttttaggcctctttcacacgtgcaaaaaaatgggttcaagaacttcaagcgcaaggtaatccatttctctttttgtaattttcacgtatgattagaacatctgtaaataagcagctatattgattttgtacaactgctggaccacctgtactgtacagttctcttataagtgaacttgcaatttcatagcactataagacatcgtgtctgtttttttaatagtccagctaatacaagttaacttctttttatacaggaaacccaaacacgataatggctcttgctggtaacaaggctgatatggtagaggcgaggcaggtgccagcagaagtatgtaattttgcttctcaaatccctttttttgtgattatatgtcaaagcactagtgcatttctgcatgaaactatcatgtcactgtgatttgatatttgtcactagcatctcataatggtgcttattttcctcattgcttcgagcaaaagtataatttggccttaccagcttcaaattactgtatttttctcctgtcacatttgacgatgaattatcagtatgttgtgatagtgaatagcacagaataactatgtctactttttgttgctcctgcttcattgaaaaaataactctgaattgaagtatttaacaaaaaaatatataataaaaagttgtgaaggcaagaaggttttctgttctgtggtggtcttttttgtttgctcattgcaacactgatctattaaataatagataccatcttttgtgtttgtggcactatcctgttcttgaaatgaatttcttttccattatgacagcctctgcggcttgctttgttgatgcttatcaaaagctctaatttgtatggtgcaggaggcaaagacctacgcacaagagaatggccttttcttcatggaaacatctgcgaaaacggcgatcaatgtgaacgatgtattccacgagatcggtgagtttagatcacaaatcatttccgcagtggatttctgtacgccgacagagctggttggttatttggtgtacaaaaatgtacacagcctgcttctgctaatttctaagcgaatttgcattcttaatctgatttcagcaaagagattgcttcaaggacagcaggctcaagacacaccggctggaatggttctcaaccagagaccagctgagaggatggtgagcagttcttcatgctgctcataattcaagtgtggagtatgtgacaactacataatgccatggcctgaaatccaggagaagtgtgtatgcatcagagatgcacacaaagcttgtaaagtggctgctgccatcccagctgctgtttcttattttgtcatgttcgttctgtaaatgtgaatactagggtgtcgctgcagaaattcagatgtattactacagtgtatgctcttgcttaagtatttctcgacactgaaacagagtaaagcaaagtctagtcagattcgttttgtttgcttcaattcagatcatgcagtgagcttgctttttacattctaattgtgctagtatgtgcaattcagaccacattcacccatttgtaccttttcgtcagaaaaatggaaaaatatgatcagattttgtagttacccttttacacaaggaatgtggtaaagatacacgcatcaactgaacaattgctgatgtagcttatccaattcaacatcaagaagttctgaaaccatcccaagcatgtgtggctcacaagaaaaacaagcatatacacgcttagggaattaacaaaaaataaataaaatcagtgatggcaactccttttgcttatgcaccaaaccaggaaaaaagggagtacaagaggaaaagctcatgaaggtatagaaccatctcacttttcctgtattgattttcaagaggggcatggaaacatattattccaaatgaaattcatcagtatgtgccattcttttttttcttaatgctatctatgttgttttcactggatgtaatcttcattgtagctgtcactgatcaccgaaacgaaccgctcgagccatggcagctggtgaaggtccttcatggtgtcaatgatatatgaatcggcgcagcggggcggcgactggcttggaggctcacccaggttgaaaccccctgagaggaacctctgaatgagagccagctgagctctctcctgctccgagtacccttcgatggcggttggcatgcagtcgaacgtgtcccatgcccatatctcggatgcttgggtggaatgcgctgccgaggcagcctcgatgctctcttcgtcccagaaaacacattggcatgtctgtataccattggtgtactcggcgccacaggagtagcagaactcgtgcccgcaccttcagaagtgacaaaccaacatttagcatatcgataagaatcaaaaggtgcattcatgaattagtaatccttgatgggagcgagcatttgcaatgcaatagctatctaggtgggcgagcaacacagagcacatctagttggatctgaatctacctagtgtgaaattactatgaagagtatgcccatataaacaaaaccctaatgcggactgtagaagaaaattctcttattgacaccagtaatgcaccttaggccccaactaagaattatatgaagttatctcttgtatgatatgataaattaaataactaatttgggaatccgggattctgaggccataataaggaacaccttggaatttgtactgaaaactaccaagttctttaattcagagtgtggtcagagacagagtgggccaacataatatagctagcttacagtctacaacatttctatctgtttggtaactttcaaatattacagattgtgggagaggcagaaatcagcgcactacttaaaagttgcactaagaaagcttcatcaaacataataaacattcgttcataacctgtgaaaatgtgaaatgattcttctctctcatttagaaattttaactactagcatgacaacagatctttactcttataataaacagtgtttaatgctttcaagtttcagttgaagcccaatgaaaccggccaaaaagagtgcttctctatgtagaattataaagcttagttctgtgtgtacttgtttatttttttaaaaaagaaattcctctttttagtctacgagattccataccagcaagtgtgccaaactgaaaaaaggaacataccagcaattcatatggaagcagccttgtgtgagttcaatcattcgtcggcatctctgacaacgcctccacctattgttttgtgctagccgatgcaaagacaggtctcctgcatctctttcatcaacaggcaagctctggtactcatcacagcccatcatgacatgccatggcactccacagttgatacagatatctctatggcattctgggcactcaacacaattgagatctgactgacttgatgtacttgctctagagaagtgctgactaagatctagtagaactgaacagtttggaaagggacaataaaatctttccatgtctgaggtgccagcttctgcaaaagctctctccagagaatcgtagcagctaactggaaggaatgacttacactcactagcagaaatatgatatttacaccttaactgtgggcatcttataggaaccttgttggtttgcagcttctcttgagtatatgaagtcaagcagctatagcaaaatgtatgagcacaacccactttgatcatctgagcgcctcgtttttcctcacagcaaattgaacaggtgccaacctcgtatggagatagatacatgatgcctatggcttctttggccaactgcagtggcctctcaagctcaaagctaggaagcaatattatatcaaagtcttccagcttttccaccagttcaagaattctgtgtcctaaagctaccaagagctggtcttctagaatttcagcttctgcgatctgtcagtgcaaaagaacaagaaatgacacatcatgtctaagtatgatataatacaggaaggcagtaagataactctattgaaataggtaattatgtaagaattctacagctttcggacaacataaattgaacaaactactgcatagaactgcaagtgatgaatacgatctatatactgcagctgcactgcagtagcagaatttggaatgtgcagctgtcataactgcacattccctaccttttcatcctttcgttcctctcagtttagttctgtttacaacagtcagctattaataggtagctgttaaaatctcaaataggaaagacggtttcttcattgactgattgttgaattgattagttcgactaacttggaaccaagcaagatggcatgaagtcaagtatagttatcgtggtgcggtccatttttttgtcattcggattaccagccaaacatgtggtatcctcaaaacatgaattacattattttggtagcgtatatcacaatgccaaactgcaacatacagtttagttaactaaaccttaagcgcccattaggtgatgcccaatagcagaaatatcagggtgattgaaagcgatactagcgattctgtgtaacattcataagggcaaaccatatattagagaaaatcggaaactcttgcctgaaagtacagcttctccgaattggtgaaagcaaagatcttccgtatcccattctgcaacgccaccaacaggccatccatcagcgccaagtgatcggccactagctcatccacatagaagtccagtttcttctgcacctgaagcataggcaccccaggtgacctctccatcaccaccccaatcccggacagcttcttcccctccgcctcggggctcgacacgcccttgaagaacagcctcaccgagctctcatcaagctctcccttggcgacgccggccgtgaatgactcctcggtgtcctcccactcatcctcatccccacagcagctcctgaagtcatcctcccctctcgaattgcaggcgaaactgccctccacgtcggctaacctctcctccattgctgaaatcccaatccaattggtgaaatccaatcaaatcaaatcaaatcaagacgacactctctgactcagttagaaagctgagcaatccccaatttgagcaatctccattcagctagatgggtcagcaagaagctgagcacactgacaggcaaccaaaaccaaaaaggtttccaccaaacgagcccttttgagctcgagactgcacctaatcccaactccaagaaggtgccttgttcctttttgccacaaccactatggtggtggtggtgatggtgccagtgacctatcgctccgacgaccccacagattcgtgggggggcctcggaatcgcacgagatttggctcagaaattggcggagaggatggccatgaagcaccagaaggagctccacatcgcgaattccagggccgcgagggcgaaattgaacggggcagcgaccaaattcacccaaatgttggagctttcgtcgattctcgaattattcctcatgcgagagagacgctcagtagtaattagcaattcagaccccgaggacagtgcaaatcaccgccgcgacgtgagctccaatcacctgcctgcaaggtgagaatttaccaacaattcagatcaaaatcagcaattgcgagaacgaaacgactgctcctgaaattgacaaaagaaaaaaaaatctagctcaaatgttggaaaggcccaagaaaaaaaaggaagaaaataccgaggcaacctgcctcgcaatcgaatctaacagcaaattctgcagaaaactcgtagaaacagatctagagaaggcgagcatttaggcccaaaagtagatattccagctcaagaaaaattactagaaaacagcaagagaaaactccgcccaacaagcacaaaaagaacccaacaaaattcgcagaaaaaaaaaaagatgaagaacaagaacacactccacacagaccgagatgcgcccaatcgaagcaagagcgagtgtgggtcagaaagagagaaaagcgggagcacctgggagtcacacgcatcacatcgaggagagatgaaaccgggcctccggggacaagaacccagagggaggaaagaaggaaggaattgagggcaagcaacaaatggagacaaagatgggagctttccggcacaccccggtgacggtgaggcgcctttccttgcggcagtggagagagaatttattctgaggaagaagaagaagaaaaagagagaggagtggcgttaaagcaaagacagaggagccctaattattccttctcgaccacgaggagcaggagcagcactgcaattgcaaactctcctcttctccttcttcttcctctccagatttgcactgctgtccctcaacaagcacaaatattgcacctttcaaacttagcactactacctctcttctaaaatgttcagttattttatcatggaacgtgttttaaaatgaagggtgtgtttagttcacgtcaagggcccctttgatttgaagaaaaaatataggaattttggaggatttcaatcctatagaaaaaattcctatgaagccctttgaaacaaaggattaaatcatatccaatcctttgaaattcctatggaatgcacaattctatagatattttggaggaaatttagcaaga

SEQ ID NO: 55803 - DNA, 11696 bp, Oryza sativa
aagtaggcttaaaagatactactagcttagaccaaacggtcaatacagtgaaaataatttaaattattgaatggattatcgatttagttgtagaaataaaattatatatattgagaaataaacttgacaaataacttgaaacaagcaaaaatgcataaattattttagaaaaatgtagttttagaagtgtgaaacaaataatttattttatatttcgatgaataagaaaaaaaaatatggcaccatcaatccttaaacaagtcattattactcgttcataacgtgtccaattgcctacgtttgcttgtgccatatcataagacgactccgcattttataaacgagtcaatgacatcgatgttgcgagtgtttataatgggttttattgctccttgaaaccatcaaggataagttaaccaaaaaaactttaaagttttattgttaggtgtatgtttgtttatactttaccctcgtcaaagaaacaaacatgtatctaccgtagagaacaaatcaatcaatgcattctagtagtgctaggtggtacttggattcagggactaaacctgtcatatcggatgaatttggagtattaaacatgaactatttactaattacataaataagagctaattcgcgtcacaattttttaagcctaattaatccatataattagcatatgtttactgtagcatcacataggctaatcatggattaattaggctcaatagatttgtctcgcaaattagtccagggttataaaatgagttttattaatagtctacgtttaatatttataattagtgtccaaacatccgatgtgatggagacttaaaaagttttaatcccttttaaacggggtcttaatcaagcatgtatttattactactccctaaagtagtggaaaattaatataccctccttttctaaatacagtaactaatcttaaattctgctctttggaattatgaccacaatctactcttaaatgttaggtaaagtgaacgaaatttcgttcttacatttactccatccattcctaattaattttttcctaatcatctttcacaatcaattttcagcatcatgagattaatgttttaaaattcattgtgtaatatttatataatgtactccctccatctacttttgatagtcatattccatcttggcacacagaccaaggataagtaattctacttatcatctatttaaacatgctaccaaggataatatgataggttgttgaattgaaatatgcctatcaaagataaatttttcagatttagaaatatgactatcaaaagtagatggagggagtatatttcacatgatattgaactataggaatttctaaaattttattattgttaaagatagatatgttaacttacgataaagctaaatcaacaagtaatatgaaatgggaagtatatgacatattacacttaaataacatataacattttttatggtttgtaaatacttaaaagaacaaatgatcaaaattttaaaggtggatagtgtgcctaacgttggttattttgtaaaaaggtgacgaacacactgacagccgccaagaagtaattcatccggttttataattttaaagttttgaataataacacgatctacaaaacgcatctttaactatgattttctcttgtaatgcatataataaataaatatttaattttgttacagtatttttaataataatctatttatattttttaagtgcattcaaacttgtaaatattttagaagatactaattgttaaagaaattttaatagtttgactccagctgaattaaggaatcggatggagtaattagcagaagagaggaggtgcggattgcaaaagaggcatggaagtggttggtcgattgattgatgtcgagtttaatggcggtcggggcccacactcacactcttcctgcatctgcatgcgaacggaacggaagaagaaatcctccgttccgtttggactcgccaagttggggcggtggagtgggcccacgctgtcggcgagagcagccaactcggaccagcgacgtggcaaccaccaccgtccagtgtcagcgtcagcaactgagcatattctaccaaaatcatcttcctcctctcatcaattattattatgcttattaaggatcaggaacgactacgtgcacaggattctaatctcctaatccgattgaaaacatgcagagattcttccctgcattctgaatttctgatgagagaatcaaggatatgagcatgaacgtgcggataacaaaaaaacaataacaatttttagaaacattaattctctctaatactccctctggttctatattaattgacgttttgggcaagcttgaggttaaacttttataactttgaccatcaataactttaaaaatatttagtttaaagaaactaaaaaaacatatatagatttgtcttttaaaacactataataaaagtaaacatgcattcatttattgtatatattataacagaaaaataaggtcaaaggtatatcttgtagagcgtgtcattatccaaagcgtcaattaaaatgaaaccggagggagtaactaatgtatgcatgtgtgtttccttgcaatcgtatctttttctccttttatttttccttttcctttttactgacgacagcacctgattcaagattctaatgctcgcatcttcaggcttttactaatttttttttcttttcatcagtcttttttgaactcgattcttttctcttttcttcaagagcaaaactcagctttaatctactttctgcctgggccgggattcacacactgattaggcaaggagggtaggcgatagattatactactgtatactgttgctgattcagctagttgtgttgtgtcattaataggaaattaaccacagcttgggagagctctagctaaagaactcttgttcatctactctcgcgtcgtcctcccctggggcggcacgggaggcgacgacccagccacccatctccctccccttcttcccctccgcctcgccgccgctcgagcggccaccggcaaagccggccggccgcaaggacggcggcggcggggcccctcaccgacctttcaccgggcaggcaggggagccgccaggcgggacggcggtgaccgccagatccaggccgctccggccggatctggcggcggggaggacggcggccacggcggcggggatggcgacggcgaaggcaggggcgcgcggcgctaggcggcggcggctgaaggcaacgggaatggcgatggcggcggggatggcgatggtagcggggaaggaaccggccgcgggcgcgaagatggtggtggtggtcccgtgtgagcttgtggtggcaacggcgcggtgctcctcggcggcggcggcggcagtgtcccccagatccgcgcctctcggccggatctggagggtggccggcggcaactggcggcggctgtgcggcgacgacggcggcggtgcggcgacggcagcggcggcggtgcggcgacggcagcagcggcggtgtggcgacggcagttggcgacggcgacggcggtcgcggtagttggcagttgcggtgttggctggcgatggcggcagtggcgcacatggcatggggcggcagccagccgcatgctggtgaagggtgacggcacagcggcaggttgcggatgcgggggctggagtcggtggcagcggcgacggcggccgtttgtggaggcggtggtgacatcagcggcgaggcgaggatggcgacggcgaggaagctgggcgttaggcagcagcggctgcggtggtggtgaccgtgtctgcggtcactggaggcatggcggcctcaaacggctagctgagggcgtgggaggcgactacatctggccggcgcggcatcgtttggtggaggggtcggagaccggcttggcgcagagaagcgcagccgatgacagcggaggccggctcggcgcgagaggcgcgagcgacggagatggaggccggcttggcgcgggaggcgcggccgatggagggagaccggattggcgcgaggcgcgtccggtggaggaggccggcttggcgcagagtggcgcggccggcggtggaggaggcgacctaggggtgagggagagctgccggtgggtgtagcgcggtcttcagcgctcgaagactggccggcgggggacgccggtgcaggggtcccacatgtcggcaaagcttgtgtggtggtggagcatcggtgcgtcaggcgtggtttcgcaagtggcgagcggtgggtgaaaacccagtccggccttggtcggaccgacaacgatggttatcccccctcctgagagcgttgtcgtgctgtctcacccctctggtgaccttgtctgtgtccctttgttagcctagtggcggtcggtcacgcttagcggcggccggtccggtgttagccttctcctgggcttgtgtgatggcgttgtcgccgtgtgggtggtggtttattttttcctttttcctggttacgaccctccagggttgtaaccttgtaattttttcctactctatcaatagaacttcgcaccgtctcgtgcgagtcgttcagaaaaaaaaaaaaaccacagcttgatacaataatccagggtaataattgcctgaactgacagttcattcatagagcgactaaaatacttgcatatatatatatatatggtatccccatattgatcctttgcaatcagctggctttcatgtgcctaggcacattggtttaaagaaaaaacatataaagaataactgagacgataagataatgcaacaggtggctaaggttagataatgcagcacgttctgcaagaattagcaacagtaatcttgcctgcctgccatctttcggcgtttagcccagtaatcagttttaggttttgagggtgtactcttctgcttggaccagtcagctagcagtgctgacctactactaataataagatacttgtactaattattaaaagatacagtacttactactaattggagtactggtagtatggaatatgtttagcacctgttcattacaacaagtactactgtactaatagctgttctgtcgtctaatggtaactgtacctatcatatagcaggtggcttggagcttagcaagggaacagtactagtgttagctgtattaatactacgactatcttacactggagagagaacagctagtgacacactaaccaatcaagctgtagtagttcagtagtactagtagcttggatcattttgccatgaagttagctagatgccaatcggctcagccattcattatatactcctacatctactaaaagattaattagagtggaacagataatctcagcattcttcaaggttagtatagtattaacagtgtcagagatatggcactgattagatcatactgtcgagatgattcaataatactgacctatagctctttgacactgtatacatgcatgttatgatcaatgtgtatgcagtaggttttgcaaaaccatacgattatcatgcgtttattattagtctccttagtttttaaaaccacaataaatcttacgataattatacgattaccccgataaccgtaacccattcaaaaactatttgatgaacgcacacgatgctttacgagagaaccttttcagatacagatccctgcttccactgcattgcattgttctgatgatcggtcagaaattcagaatgaatgactctgaagcagcattgcagttgagttgatggaactttacatggcagagcagggcagctaatgacaaggcatgtgaacggcactttgcagctttctgtctcccccttgattagcacagagatcagcaacctttggattttttttccctattaatttattgatatactcgagcctgacagccgggacattagtattagtaggagtatataatgagtatttaatctactcaaagcagggcatgtatatataagtagtaaaagaaaaagaaaagtgtactatatataggcaacagtaattacagtatgaaatttggagtaatacactaatactccctctaacccataatataagacgtgatcaaagttggcacggtctccaaaacaaatctttagcttacaatttctcatatactataaaatttgtagcaacaaaattatagccatatgaaagtaaatttaaatctccatctaatgatataatttttactcctttcattccaaaatataaggcacaaccacccttaacccaaaaaccaagaaataattattatcatcttgtagtttgaatcatcctaataaatataatgcatgcatccaataggattagataacatgagagtagaggatttaaaaaagtaataatttaatggagaagatgccatagttaattgcatgcttgcatgcatgccttatattatggaacatctaagaaaaatggttgtgtcttatattatggaatggagggagtaacaaataaaatttattttatattatactaagtgttggtcaaatgtttttgttttaaaggttgaatcttgaaatacgtgcacgccttatattatggaatagagggggtactcattaattacattacatggtgaaattggtttatcttcttgcatgtactccatacaacaatgaccaagagtattaattagtacaaccttgaaattaaactcgaacaagaccataaaaaggcccaggtttgactgcttggccctttcggatcacacaaggaggcccaccacgatctggcccatgtatattacgggctgcacgtaggtgacaatccccaagggcccctatttaacacgatttccgtttcatgggcctcacgacaggctgagactgcacagagaagcccactctcgcgtgcgcatttctcacgggcagcaccctttgggcctttggcatcccctgtgagcaagggtctattttaatgtaaaattattcccctcaatcccctccaatactttttaatccattctaaatcgaacaagacctaaatgtttcggcttcgttggttgggagctccggatttatggtctatgcttttcgactccaaatgatcgcatgtatttctcgtagtcttagaggatgtttggatgggactaaaaatttttagtctctttcacatcgtatgtttgacactaattagaagtattaaacgtaaactattgataaaatccatttcataaccatagactaattcgcgagatgatctattgagcctaatcaatccatgattagcctatgtgatgctatagtaaacatgtgctaattatagattaattaggcttaaaaaatttatcacgcgaattagctctcatttatgtaattaattttgtaagtagttttatgaatatatataatgatattagtgtcataaaatatgttgttttactcgggagggtatgtttcgggttttcattggtttttatcctgagttgaacatggaggagggcctgtaggaggcaagagcttgggccaaagaccggggaagctaaggagagatagggaaacccaactgctgccggtcggaacggacaagaaagaggtggggataagctatataagagataaggccgattcaattggaaaaacaatatactcacaatccaatctagccaattgaatcgttttttcaatattgctcatagttctagcctagttcatccatctttgtcgatttgcattgtaaatcgtctgccttcgccgcaagagtgcgaaatccatctatcccgtaaacctttcgttcacccacaagacgggtgtttatcgcttgttctatctaaatcagctccactagctggtttaatctatcaaaacctattttgatttagcttttgctagattggggtggttggcgactctataccaccataagacgtttagagtgtgctgattgtgattgtcttctcgccgaaaaagttaccaacatgatctaatctaaataatctgtaaatttaaaataatatttgtgttaaatctacaaaatatgataacactggatatcttattatatatcgtggtataactatatatctcttgatcacgtaatttattctatctgatctgtaactagctctggacaataacaacaaccagaattaattagcaatctcgaaagctactaattaaccttgactacatgcttcacctgcaaggtacagttatacctacattttacatgagcaaagagatgcacgcatattgcttgtttttgaaaattttaaaaatcttatagtattaatttgtatttattgtcttttgcaagtaagcaaagtgtttggccgagctataaatcttaaattgagatggaccaaacattaaaatatatggagaaaattaagtagagtggagctaaaaacaattacagaagcatagcggtgacaccctgcttcgtaactctgctctacatttattttacgaaaaattaagatctacttcctccgtttcacaatgtaaatcattctaacattttccacatttatattgatctatatctagattcattgacatcagtatgaatatgtgaaatgctagaatgacttatattgtgaaatgaaggaagtagaaaagttcttccggcatatatagatccaaatccgcagtggagaaaatggatcactcactgagacatatctgaaatgcattttccctccatttgcatcactaatttttaaagttgtttcataatataaggcttgcatgcaaacatgtcattaactagcacatctttttcattgaaatattattatttaaatcctccatcattaagatctctaattttattaggtgcatgtattctattaaaatattattatttaaatctttcatcataaagatctctaattttattgggtgcatgcattctatttatcagggcaatctaaactatgagaagataataattattttttggtctttgagttaatgatggatgtgccttatattattttggaatggagggagtaattcattagcagtattactaggagcactgctacacgtattatatttcttttacaaaactcttacaaacaattatttcaaccatttgatttaaatagatggaagttatagaaaatttagatgtcctcaccgcgtgacacatagtgttagtaagagtttagtgtgacaaaatttagtatgtatagacttttcttattagtagcttccccgtcatatacagccacatgccgtcggtccatttccaccaattaatggacgagtctgcgggtcgggcgcccgatcggtgtggagaaaaatcgggcgctgacgttagcatgacgtcaacacccgatttacttgcaaaactactttaaaatgattttttttctcaaattaattatccaaattataatccgattgcaccattaaattcgttgcaattaaatcttcaaaacaagaccacacatatatatatatatatatatatatatatatttcgatgaaaatttttttagcttattattgaattatttttaaatgttgcacgatgttccaccgggtatatcggaattgtttcactaagtagatcgaaaatgtttcactcgtttaaatcgtgttttgtttcaccttatataaaaacaatgtttcagcaaatagcgaaagaatgtttcagaatgtttcactcgtttaaatcgggtgttgtttcattaagtagatcgaaaatgtttcactcgtttaaatcgggtgttgtttcaccttatataaaaacaatgtttcagcaaataacgaaagaatgtttcagttcactgcaatatttgatccatacatagtaaaacattataagaacgctaggtgaaacatttttcagtggaacaaaaaataaaacgaattcccttaatatgggtttctaaaatatgtgggttttttgttgcaatggaatatttcagttcactgcaacgttagatctatacatagtgaaacattatgagtacactaggtaaaacattgttggtggaaaaaaaaaccaaattcccttaactaaaggtttctaaaatatacgagtgatttgttgcaatggagttgtgtgtgtggataagtggcaggtggacagggaacatgtggtgggggccaggtacgcacgtgatgggaggagggggaagctatcgactttttcccctccccgcgcgaccgagaaggagcattctcggcaatcaatccccaatttaatttgtgttgttgaacatttcctcctcgatatcctgtggacctgtactctcgtatcggaaccaaaacaattatggagtgataacacgcacgtgattgaattatttgcagtccgttaatgcgtgtttatccgaagaaaataagacatacagaaattttttaaaaaaagaagaaaatactatattgaaaccaagttaattaattaatcaattaatccgaatagctaaaaatatatcgggaataataattaattaactaatttacagaaacaagcgggacactcacgctctatatataccaagcccacgcgcgcggccgccacgtgccacggtaaaagctgagccgaccgccgccgccgccgccgccgccgccgccatcgacgacgacgacgcaagcttcccacagtggtagtgtactccggccacgtacgccatggccgtccccaggagatcagagatggtggccggcgataaaggcgccgtcgaaagctgcaggaaccaccaccacggagaatgcgccgtcgacctcgcctcgtcctgctgcacgtgtgcgccgcccgccacgacggcggcttcgtcgaggaagaagagaccgcgcgtcgtcgtcgccgatgagacgacgacgacgaacaccgtcgtcgacgacgacgatgaggatgacgacccgtcggccttgctgcggcggcgggcgaggtggaagcaggggctggaggcggtgaagacggccgtggcgtggcgtctggcggcgaaggacgacgagatcaggcgggcgcgccgggagatggcggagcgcctccggtgcgcgtgggcggtgtcgcgggcgtggcagagcatcgccgtggcgcgggagggggagaaggccgcgttgcagggcgagaacgccgcgctgcgcgtcgagctcgaccatgtgctccgggcgaagccgcggtggcaccacgacgacgacgacgccgagtcctgctgctacggtgacaacttcaccgacgacaccggcggcaaggaggaggacgagggcggcggcgacgcgagcacggcggcgaggtgcttcgggtgcggcgagagagcgtgctgctggcagtggcacctgtgcgccgcgtgcgcggcggtggcggcggcgtgggcgtgcccggcgtgcggctactccaacatggacatggacgacacatgcatggtgtaggaggagaattgaaggagatcgcatcacatatcatatacatagctagcttcaattcttcttcagttgtagtgctagatttggttattcaatttgtgaacacaaatcttgtcattcgtaatagtttggagtattgatggatttattcttaatttgttaatcgcaaccccttggatagtgatacatgtccctcttaattaatactccgtttcatattataaagagtaaatttcagaaaactactactatagtgataaaactatcagtttgctgcaacattagcgatctatttcagtttgctacaacaacagcgtgggaaattattacaaaactgcaa

SEQ ID NO: 55804 - DNA, 719 bp, Oryza sativa
aatagatcgctaatgtggcagcaaactgatagttttgtcactataattgtagttttctaaaatttactctattataaatgtttgggtagtgatatgcttgccacttaattaatacctcctatgtttcatattaatatttcctccgtttcatattataaatgttttggtagtgaaatacttgccacttaattaatacctccattgtttcatattataagttgttttaattattttatagtcaatcttatttaggtttaacgtaagtttataaaaatatttaacaacattgtcgacgggtgatacccgtagaccggatatagagggtattggggtacgttggtataaggatctacgtaatacgacatcaagcaaacaaaagacgaagattatactggttcaggccccttgacaggtaatagtcctaatccagttgatatgggattatatggtggaaaacacaggttacaaaggggacaatggaacttgtagtcgagtcggatccggcgagatcgtagtcgagttggttcgactagatcccgatgacttggctccttgcaggctccggcttcgtaggctgtatgagttgtgttggctctgagagtcgatgccttaggccctccctgaggggtcccttttatatcgcagatctggaggtttacaagtagaactcggagatatcagaccctgtacgatacattaacgactcaatcttgtccgag

SEQ ID NO: 55805 - DNA, 1423 bp, Oryza sativa
tcttttaacaacattgatcattacgatgattaaagtgcaaaaatatttcatactctgcaggcaattattggatttcatttttggattaaagacatgtacgaagattatcgttatctggcaagtgttctgatgccatcagaaacaattagaagctatcacgtcaagatattcaacaactgcacatggccctttattgatttgtttgtcttttcctctcacttgtagccagtatataacttcagtgtaacagaatgttatttttttagttgtaaactgtgatgtgagaaatagttggaaagatatctaaaaaagatagcaaattgcaaatttttggtgttgaatgagcactaatattggtttgattgtaccaatatatcagtatgtaattggatgattcattggccacaatttaggtttttttattagatgtttttttcattggaggcattataaaaaatgccacaaagcaaagatgaaggcattttgaataatgccacagatacctaaaatggcattctggaaactgccctagtaagctctaacggcattcttgaaaacgccaggctagacactttttaaggcgtttgtaaaaattgccctggattgcttttcccgtcgggagtaaatgtggcatttttcaaactgcctctaaagaccattcaaggcgtttttttgactattcaaggcattccaaatcgcctcctaaagtgtgtcatcctgtagtgggagggggaaggcgtgggacccacgattggataggcgatcctggctggccaaagttggccagcgtgaggccgagtttagccagccaagccatccggctggccagtctgttggagtacatttttggcctaaaattactaaaatttagcttggagagtgagataagtagactgttggagatgctcttagcaggttggctgacaaattagtgacagtggtttcactatagcttggtacgcctttaatggtgcggccacgtgacaatgtcctcgtcagctggcccgtacatacataaattgtgatccactgcatcatcatcgatcgcctctgtatttggaccgacgcaacgtcagactagcgtgataaaacaacactgttatatgaggttagcaccgttgtttttatctcgcgtggcaaagaccgggcttaatttgtcacatactcctattaggttgacatacacggctagaaaaagcatttttcctaacgtaggggtctcatttttgcagacggacataccccttagaaccaaacgaccgcctaaaaaatatatatcgggatgaatgtgccggtccgcctgcgaaaatctattttcgcaggcggaccggcacattcatcccgatatatattttttaggcggtcgtttggttctaaggggtatgtccgtctgcaaaaatgagacccctacgttaggaaaaat

SEQ ID NO: 55806 - DNA, 2377 bp, Oryza sativa
aaaaaaatatcctcgtgtttgcatgtaatatccaatgtcctcgaaccgattgacgccccgttgtgttgtatctggaaaaaccccttgtcttttagagaaatacaacgtgaagaagaaaaaattctgcttccacggataacgatgtaaacataaaaaccacaatggatttttcgaaaaacaaccgcatctacccccacccaaaccctatccctcgctgtctctcacctacacccaccacgccccacccgcgctccacgctgatgccggcgtggggttgcctccaccgccgtccatctttccaccattgtcgttgtccattctcctcccgttgctgccttcattgtccgtcttaccccccgataccggccacaacccccctcccgctactgtgtgccctttctccaccattgctgctctccccttaaccctagcagccgctcgacggaggccttagcagagggtggagggagagaagggagggaaggagggctcgatgcatggtggaagggctcagtggtagtcaatcctctcccctctactatgtctcctcctccgatgcaccaacacattgccttgtccaccgccgtccattcctcgtaagttagtaggttgacgaagagaggcgtagatttttatttagattgattatgaattcgtggaaaaaacgatggatctcaacgaaaaaaaaatgatgaggatgatacatgctttatcacacagattattatgcatgttattatgaactcatggttcaatattaattaattaatttcacgtaagactactagagttgataacatatataatatgcatgtcgttatatatggtttaatatttcacgtaagactataataatgcgatgggttagagtcgtgacaaaacaaacgtacgtcatcgttttactaaagatgaggtttgatatcgacctccaccaatcatagagcaggttaacttctccgagatatatatatattattattgcataatgatttttctccattggaaaactatctagcaatataggagcttgctagggcaaggaaagaataaagatccatgcgctagctaggagttgtaagacactccaagattcgtgcacacgtttgtttttcattttcacccacagaatttcaataatcttaagatgttgatagatgtacctgtagggaaaattaatacttcctccgtttcatattattagactttctagcattgctcacattcatatatatatatatatatgtgtgtgtgtgtgtgtggggggggggggggggcggcgcctagattcattaacatctatattaatatgggcaaaggtagaaagtcttaacctgaaagatgtagcatttcccatgcacggagaactgaaggatagcccatttggttatgttatttttggtggatcctgccccacctgggtttaattagtcctaagcttttcaagcgtgctcatatttacatctagttattctttcagtgttaggatatatagttagacgcacgtggtgacgttattaatattaagatacgttggttcagtttttatgaatgtgcttatatataggagcatgatttcaaatcatggacaattcgattgtatgaacacattataaaataatttaattctcacaatcaaaactacagttgtgatctttggcaccttgttggggggctatacgaatgtaggggcatgcatgctaataagtattagtgtggtactccctccgtttcgaaatgtttgacaccgttgactttttagcacatgtttgaccgttcgtcttattaaaaaacttttgtgaaatatgtaaaattatatggctacataaaaatataattaacaatgaattaaatgatagaaaaataattaataattacttaaattttttgaataagacgaacggtcaaacatgtgcttaaaaagtcaacggcgtcaaacatttcgaaacggagggagtaattagttgctgattaattgtactgcatgcacactgcacacaggtcagctatatatatgcttcatgcatgcatgatgcaacttatatgcaagcaaacattttccgttcgcgaggataattaatgcaaccaataatacaaatagtttcacgtcttagcatgctgaaaggactaattaatacagtaattaacaagtacgaatttcttatcattaagtggacaacttgtatctcatagaaattagaggttaattatgtgtgtagccaactttttcaagcaatattatgatgcgtttaaatcgtataggtgattatcgtaagagattcccacgcgttattgaaaatcatttctccaaatccagaccatgcatgatcgatcatagcaaaacaaaaaacaaataattaaactgattaatatatatttg

SEQ ID NO: 55807 - DNA, 1197 bp, Oryza sativa
accagtgttcactttaaacaacgacggttctgtccaccatccattgtgatcccaaggatagcttcccgccgttgaatcgtcatggttttctaaggatgtccaccttccctcctctcgggatgtggctccatcagcataaaattcatcatgcaatatcccattccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcctctcggccctacctcaacggttatcccattgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaatcatggttacaaggattttaagggtaaacaatcatcaaggcatggcataatcacaagtaggatgttcatcattgcatgcaattttatttgtaaacaaaacaatttcgccattaggatcaacatgttcaaggaatagtgatgacttgccttgctcaggataatccttattattgatatattcttgatcaacct

SEQ ID NO: 55808 - DNA, 8251 bp, Oryza sativa
catggttttgctggtcgcacccatggcagttaaggaccggttcgcgggatgccctggaagaacttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgcattgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtttcaccctagtgtaatcttttgaatttgtaagtttaggtggatggttgggcctgttgcaacgtgggatagcgttggacagtggatagttaatattaattaattattacaactgtttaaatctttcaacttctgtttataaatgctcgctttatgcaaatgaaccactctagctcttctgtgataattccctgcatcatacccctattccggtatgacttgctgagtacagtgggtagtactcagtcttgctctatttttcccaaccccagagtacgagtatgtgtcagatggaggtgtctctgaggagtaggcttcgtccgtgccgtcaaggatgcctgtggagtggtgttcccgctgcagttctagttaaggcttagctcctgttgcctttcttttcttctgctgcatttatgtaagacttttatgatgtttataagacgtggatctgaatgtcaacattgtcgtttgtgtaccccggccggtcctggacggggattttgatgcacattctgcttggaattctattcgggaatttctgggcgtgacaacagcattaaaagacacttagttgctcaaagctattttgtaagcacgatcctagagctatacgaggttattaatcaaggccgtgaacccacacgaacctgccttaacccaaggcctacgataattcagaccgaactggcaacccgaccctgggtcccagctcgtcccaagccaacccagaccaaccattctacattttagttgttaagcaggtattaagaattaaaacactaacttgggtacattgctcggcttgcccataaccgagggcgcggctattcgaataggttatactctgatcagaggtgtacatctttacccacaagacacatctttctcacgtgtaaccacgtgccacataccaccacggtatacggatggaagacgtgacatagtttccaacccatcctagccataaacaagagtaccgacccaaccccacctacggccggaacccccgggacaggtaggcaggactgagcccctagcagcaggacaccagccctgtaccatgacatctcgactaccgagccgcagctcgtgtagccttcatttgccctagagatgtccatcgacccccaacttcgtccatctccatccgtgtacttttgtttataaccagactgagccacaaactaagccttacccactagacatgtggaagtacggtagtgctttgcaacagaggcccgaagaccggtccttatatggccgaagtgctactatcaaaaccatgcaccccgagcccagcctaaaaccattttgagggttttgaatagagggggaggtgtgaatccaattccacaataattcaaccattccataatgtccaggtgatgagaatattcccaaagtctagagttgtaaaaccacctaatgttgcctaattaaccagcgaagcatctacctaaattcatactagtggtaccataaattgagtacccactagttggggttttgtttattctagggtgaacaaggtaataataacaataacaacaataataaggtcatacaaaggtaaatgggcatagctaaacaaaacagtgataacgcgggaatttaagtaaaacggtaatgtaataattttaaatcaaaataattttataaactgggattcaatatgttcaaggatgatgtgacttgccttgctcgctttcccaaacgtcggcttcaacctccacgaagagcggatctttcgaagctgcagcgtctacacgactaacagaaaaaaaaaagtcttttactctaataaactccatataacaagtaggaacaaagcacaaaaaagggtttttgacttcttaaggaaaaattagagacttgaacggtctaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccatgggagtggggctcacgcggcagcctcacggtccacggtggaccgggcgcacccgggctcgcaccggccggcgccgcgggccccacgcgtcagccgcacccgagggcgcgggcggctcacggccgggccccacgcggcagccactcggcgggcccgaaggcggccatgccggcgcggccggcgggaggcggcgcccgcgcccctatggtcgtcggcggcggccataggcacggcggagcggcggccgagagaggggagggagagggggaaacgaggcggcggtccatggctcaccccgaggcgacggcggcgacggaggaggcgcccggagtggaggaaggcggcggcgcggctcgggtcgacggggacggcggcgctccggcggtcggcgagctcgatgagggggtggacggggacggcgacggtgcggcgaagccgaaggaggcggcgccgaggcgggaggcggtccggggcgacgacggcggcggaccggagctcggcggcggcggcggagagagagagcgacggcgtgagctcgattccggcgaggagaaggcgcggcaaatggtggaaacgggcgaaggaagtgcggggagggtttaaatagggttggaagggggagagagcggccggggaggaaggaaaccggcgcgggaggtccggccgccatcaatggcgccggcgagatttgcgggggcaaatccgcccgtttgaacacgagagagagagggaaaaatggggggaaagggagaggggatcacggggagtatttctccccactttattgcacgcggggacggcgggatgctgcagatttggcggcggcggcagcgcttggcgcgggcggggcggcgggaggacggggatgacaggtgggccccacccgtcagcgagggtggcaggcgggcccgcccgtcagcggcgcgcgcgcggggagggaggccgaatgggccgccggggagaggagagagagagagagggggaagagggagatgggccgagccggcccaagggagggaagggggactttttagggtttttctttttataaaacctttttaactttgtttatttcttaataattattatttgtgctctgaaaattccactaaaatttatttacacattttaggcttttaggaaatatacaaaaatcctctaagccttgattgacttttaactttgcacattttaatttttgaaggctttcacaaggattttaattattctaggcataatttaaaggatatattttagagtcgttttgggacgtgacatccgcgctggcatgatgagaggggaggggaagcgcgcccggagatcggacggcgcacggcagccgacgagttccggcgagcagcggcgaatcggagggggatgcgggcactggaggccagagggggtcgaggcggttccatccaccggctcggaagatggggaggcagcgcgacggcggccagcgaagacagtcatgcggcggcgggatgggtggcacggcgcgggcacgtgagggaaggccggcagccaaggcggcggttcggggagggccacgggagctccaagagggcagaggcgagaggaatcgacggggaatggccgacaacggcgcgcggttgtgcgcggcggcggtggaagcagagcggcggcgacggaaggggatgggaggccggcggctagaggaaagaggcggggcggccaaaggagggggggttgaaggggtctccgggagaccgacagtggggaaaacgtcaagaggaaccgtcggcgacgcatggccgagcggcggcgcagttcgcacggcggctcgcgcagtagcgccaagcggcggtggcgggagcgacatggcgcgagaaaaagaggggcgctgaaggggagggaggagccggggagctcaccggcagccatgaaggcatcagcggcggtggcgaggatgggaacgcccgcgggacggcgcggcaccgagtgagcacggccggggaagaagagagagggaggcgtggcgcccggagctcctcgtcacacgtccacgcacgcaacggcccctccggtgctcggcgacggcgagagcggggcgaccagcaacaatggcgcagcaacgtggagagtgaagcgggagggattgaggggaggggttcggctttataggcggccaggaagtcggttagggagagggaaccgttggcggtcaagggagctcagctggtgttcacgggcggcagcggcggtttcgggggcagtgcgaaagcggtgtggatgcgttggtcggcaaaggcggtggattggacggtgaaaaattgggtcacgagcgcgggaggagcagcgcggcatggtcaaagtgtgggtggcaagctggcgactggcgtcagcggctctgcctccggagcgcaagggcatggataggagagagagagatcgagtccgagagggaaaaagggggaaaaatggaggaataggggaggcttatccatgccgttctgggaggaggagagagaggggaacgcgagcacggtctcccaggtttggacgcatgcggcgtggagcagtagagctggcgtgggaaagagagagcgaggaagaagaagagagcgagcactctctcccgagcgcggcgcacgcgcgacgcacgtgcgaggggaggagaaagagcggctgagggagagaggtgggctgagggagagaagtgggccgaggggaggaaatccggcccacaaggatccgagggaggcaaaatagactttttgccgaggagatcgattccgaagggattgagatttggaatttgaatttcgaacttgatatttggactcataggaatatggtggagtcaaggaagggagatcaaagtgaaaactcaatattttcgaattggttttgtatctggagacccgaagaattatttggggaggtttccgaagaaagaggaaaaaggaggaatcttggaggttgaagctcaaggctgggatatgtttggatttacatccttggagttgggacaggaattcaaaggttgttagatagacagacgaaccgatggataaacatgtagatagatagatagatggatggataggtagatagatagatagatagatagatagatagatagatagatagatagatagatgaacaggtagatagatcgatagacagggagggattcaaggtagggatttgatattctcggaatcgagagaaatattggcaaggaatttcaaggacgggattgaatatcgatgtttgactttgaaagatgaatcgggattgacattttagaggtgggggattttgatggcgacgggagggaacaacgatggatttaaactgagatccacggcacgacttagactcgctcacaaggaacggaatttttgaaattaggatttttctgaattagtttttaacgcctcacgaaaagcggagcgttacaagacccctacatagcaaatgtttgtagttaacaaagttattgatgatgtaaatttatatgcaaaataagttaggcagaaaagaatacatttctgcctccattgcagctatatcttctgggttgccattcttacatgtgtaccggtgatggcctaacagatggcagattgggcactcatgtttttttgatgatttcttctggctgctgcttcctccctcaagtgctgacttcatcctattcttatgcctacctccagctgtggacttaagcaagggagggtgcatgaagaagtcatgagtagctttgggccacatgctcttgtctggtatgctagggatggaaccctcatatgcggctctaaatctattgacagagaagtagtcatccacatggtcttctagcttttcaccagcaatggatgtaatgaaagctatggcatgcttgcatgggatgcctgagccctgccaaactctacaagaacaggttctatcttttaggctgaccacatacctaaacctagagccattgctgccttttgcacacagttctgccacaccttctggagaggctatgatcacttcaatatccaggttgtagctctcttccttaagcctttgcaagatgtgaggtagaatttttccattgaacttcttggctaccttctttctttggttccattttatcaaaattttctgccttatagtgtccaacaagtcatccaagtgctttcccttctttagcttgatccagttattgaatgattcagccagattgttagtcacataatccacctttgatgcagtcctgtattggctcctggtccacaacttcttgtgagtttcctgcaaatacttcattgcttctggtttagctgcagccattgcttgatagtgcttctcaaacatgtatgggctccatgaataagaagaagcccataaatgatcattaaataccttcccactgtacctcttcttaaaattctaaactaagtggtacatacattctctatgttcagcacgtggaaaaacatcactaacccccttcatgattgcctgcccacaatctgtgctaaatgttaggccatctggggtacctattacttccttcaatctctccataaaccagatccaattctcatttgtctctgactcaatcactccaacagctactggatacatccagttgtgcccatctactgcacaagctatgcacaactgtcccctaaacctgcctgtcaagaaagtgctatctactgcaagatatggtctacagcctctaagaaaaccatcaacacatgctctcagtgcaaagaatagtctacaaaatctgattttcttgtttatggtgtgatggtcaataacaagaaaggatccaggactagattcttctaactgagccttaagcctatacaggttattgaaactcttgtccagggcccataaatcttatccatggcaagatatttacctttgtacactctcttgtagggcaccacaattttatggtgctccttcaacctcctctgcagttctgttgggccaatatttccatcttccttcagccaatcaatgacctgactgcacacccagaattgagtgaccccaacacatattccttgcctcctagtgctctgacatttgtgaggtaaggggacttttttcacctgcaaactagagaagcaacacatcaatgtcatagttcaatgaaaattgtgagcaatcaaagaaaacaatgcactacatcaccttcacagtgtttccattctttccagttgaggcatgaagtctccacttgcagccatcactcctttgtgcgcatttcaccctatatctccctgtatcactcttctcaatgtcatagttgaactcatgtttgatagcatggctagctaaagcaatcttaaaagcatccatatcagaataaacagttcctactgtcataggagggtcattcttatcataaaaagcatcaggcatattttctggctccttgtctttaatttcatcatctatgtctttgtagacccccgatttttggaaatcggaaatcttctgtgtttattcgtaccaatccctggatcagtagttggtacacacatacatagttggatcacaacatatcacgaatgaatctaggctaaaagagttaaatacttacattagggccaggtaggccaacaactatcagagaacaacagcggaagacaaaataatataagggcccggttaacatgccacaggcagtcgactggggaacgagacctagaaccagaccgcactccgatcatcttgtgggatacgcaagcgtaccgacaagggcttctcttcaacactct

SEQ ID NO: 55809 - DNA, 2395 bp, Oryza sativa
tattttattaatggaggctttattttaattatgtacatatttcacttgtcaaaataaattataaaaggttaacaattacccatgctttgtatgttggaattgtttaggttaatcatattatggttacggattatcccatcacctaattttacaatgaataatccaagtttacagttgatctgtaattatacgaggacaggatgtataactagtatttatctaatattcatgtttgtcatatactccctctaaattaatatatgcaacaagcaaattaatacgataccatatatctataacgggatgtacaatatatgcgtgcataatatcttaatatattgaatcatttatttgaatagtttctatttactgcttggttaactaagggttgctcaccttgcctactatatgctattttatgggatatgtcgttgattaatttcatataggtgatttaatcacactagctctgttattatttgccataaacaagcttatgaccgatctatgtgtatctatattttacttacctaacaattataaggctaactctatttaaataactaataagtcgtgggttttaattatatttggacatagattagtaaatggcactaatattttcctgtacacccattaatttgaaggattgattataactaatttatttagttgctacagtgacaagacatgttaaagataattatgccactgtacaatatccattttcgatttatacatcctaaactattttgcgggtataaatattttgttagcataagtttttaatttaatctacccgagcattatatccatataatagggtagaaattttctatcgcgagctaagtatcggacgaaatcctggaaatattgtacgaattaatttagtctatgactaaatgattaaatataatacaagggaaaaatccgaatttctaccgtgaattgattatttatagggattacccaaaaataatctataataatctataataattcatcttatttgtttagtaattaactacatctaaattattaccgcgaattgatttcttatagaaattgccaagaataatccataatttatattaaattttgcaattctacgactataattaatccataattaaattctaattattttaaatcttctaaacttccctaatcttcctctaatttctatttatttttttttccttctttttctctcctcttttctttcttttcttttctttttctctctttttctctcttttctctcctttctttttcctttctttctctcctctctctctttttccctttcttctctttctttcctccctcccggcttcttcctcccttcctctctctctctcggctcaggctacccggggcggcgacagcggcggaacgagggaaggggcggcggcttaccgacgacggcggcggcgacggcggcgcaaggcgaggcgacgctcggcacggcacacagcgcggtgtggcggcaccgagggcggcagcgcggcggcacgagggcggcagcgcagtggcacgagagcggcggtgcggtggagagggaagaggggaggaggagggaaatggagtgggggaaagtggagagggggtggggtatttatagggaagagggggagaaggagaggggaaagggcggcggcttaatggcgacgcgacagcggcgcacggggctcgggacgacggcgacgcgcgggcggcgacgcgatggccgcgcgggacggcgcgcggcagcacggggctcggggcttcgaaggcgcggcagcgcgaggggcgacggctcgcggcgcacggcgatggcgacgcgacggcgacggcgtgcggcgcggcacgatggcgacggcgatggcggctcggggctcaaggtgatggaatggcgatggcgcgacgagacggcgacagcgcggcagcggcggcacggggcgcaaggtgacgcgacgggcggcagtggcgacgcgacagcgggcggcgcggcgcggggtgcgatgacgcgacaacaacggtgatggcgacgcggcagcgacggcgatggcgcggcgtggcacggggctcggcgcgcggcgatggcgacagggcgacgcagggctcgagatgacggcgacatgacggacgcaacgcgcggcgtggggcgcatggcagcggcggcgcgcggcgcgaggcagagacggcgacggcaggcggcagagagagggggaaagaggagggctgggttaggggaccacgtcgagcacctagagtgcaatgaacagtgccattttctatttaacccgattttagtttatttcccatataaatttaattctataatttctaaatcttgcataaatgaagtttactcaatatttgtgttattctaaccaatggattcaccctagat

SEQ ID NO: 55810 - DNA, 2242 bp, Oryza sativa
acctattatggcacccacctacattatttaaatattttaatatttgataaaataggttaataataactttttcttttatttgattttaatatcttgtgcataattatttgtaggattaaatatattcccgtaaatcatatctattgcttaaatgtagttcttttctttattttcttggtgatcatttacggtttggcaagcaatagcaatcataacaaccagcatgatgcaaaagtttaaaaagttcgaaattttcgtgattttcattgtcttgaattttcaggatgttacagtcttcctcagatgattcataatcagagtcagtctcattgcaatcatcatcaccagaactttcaccttccctttcttcagtcccaccttggttctgaggattagtaggaggagggggctggtttggacccatatcaatgtacaaaccttcatcatcaacacccacatgctcatacattggatttgggttacaaaggtattcagtttcatcacaatagggttcagtagattggtgttcagcaaattgattgagtgtgccacttgttgcttcaactaagcttggacatgcaatagaaggggtgaatgggggttgagcagggttcacagtgctttgcttagaacaatcccaatcgggaatcacagaaggctcactacttgggctatgatacgcaacagtcaacaaacatgttcttatagccctatgttttgcaaacatttcaaccaaatcttggtcattgcaaactaggatgtgagatttagtctcagtgcagaaaaagaacaaactgactttgtcaccgtatttatgaggatacttctcgaccaaatcagcaagcaggtccctgaattgagtgcggtctgcatccaccacttggttcaacgaaaaccaccgcgcacgacaatttcgagcaacaatccggatttctaagttgaagctactgtctgggtccatcctacagatgaacaagtagcacgcaatcattaaaccctaacacggatcggaagcgcttggcactaagcatcaatgcatcatgggaggcaattggggcgaaatcagcgaaatcaaaggggaaagcaaagggggaagtaaagagggaagcaaagaactcactcgtctaggaaccaatccgagcggtcgtcggcgccgttccacaccatggctgctcctcccccttcctctggacgcattgtcttcccccttcctctcgatgcacggtcaaatccacgctcccatgcttctccaagcccccggatctgccgccgctagggtttccccgccacggagagaggggaattgagtgggaggaagagagagagagagcggacttcaccgcatcggtcaacggtaacccttatgccagcgactgaaagggcaagatggacaattttcctacccgggcccatatgtcggagctgtcaaacggctcaaccctaacagaatagcgacggaagggtgtgtagggcgcgataaagttcgacgatggcattctgggaggctcaaactttttagtggcacagatgcaggggccatcttttttaatggcacacaggtaaaaccctctgttggaatgggcctaactctcaagaaagaaataaaaagaaataaaaacgcccgtagtggggaggggaaagcaaacaagccctagttccgccgatggagaggagcgccggcgaggaggttggccgtggcgtcgcttgcgattagggtggaggcgccggacagcaggagggtggaggcgccggacagcaggagggtggcgttccgatgggtacaatctgttgtctccgatgccggccaggagggcggcgttccgatgggtgggaggaggggcggtggtgaactggtgacgccggcgtcggccagaagggtggcgttccaacagaagatatcctagctgttccaggaagctcgcgagcactgcttctctcgcttctctctgatttcgagaagtatatgtcactcatctctacttctagttatctctatcgacatctgtacatcttctagttaccgaaatctgcacagattcaacaattttactctagacaatatatagagtaagaatggggaaatggtgtacctatctctatctgcactggttcatctcattaactaggatatatagaataagaatggggcgatgatgtttttacccaacttaatttggtgctcaatcatgattatgtcctcctttttcttactttgtgattttggccctgttttttttttttt

SEQ ID NO: 55811 - DNA, 10918 bp, Oryza sativa
cagacttatgataattacaaagtatatgcaatggttatttcagcgaaagacaatctttactaccatctctggtgccactgggcgacgttccgatgggtatgaggaggggcagtggtggcgctggcgctgaccaggagggcggcgttccgatgggtgggagtaggggcagtggcgatgccggcactaacaaggagcacggcgttccgatgggtgggaggaggggcagtggtggtgccggcgctgaccaggagggcggcattccgatgggtgggaggagtggcggtagtggtgccggcttcggcttggattgggtgtgggactggcgtaatcccaacaggtagaaaattcttccatcaacactgaaatgattattgttggtaccagtgaccaagcctgaaatgatatgattgattgcgcaggtctgtgccgccaccaccaacagaagatatcccagctgtcccaggaagctcaggagtactacctctctctaatctccagaggtatatatgtcactcatttctacttctagttatctctatcgacatatgtacatcttctagttaccactatctacgcagattcatctaatcaacaattttactctaacaatatatagagtaagaatggggcgatgttgtacctatctctatttgcacaggttcatctaatgaactaggttatatagaataagaatggggcgatgatgtttttacccaacataatttggtgctcaatcatgattatgtcctcctttttcttactttgtgattttgtccctgttttttttcaaatcgaagctaccttttgcccctagttcagacttatgttaattacgaagtactatatgaaatgtttattatcggtaccaacgacctgacctgaaatgattgattgcagcaaaagacaatatttagtatcatctctgatgctgctatcatctctgcctctctctgatctccagaggtatatatgtcactcatctctacttctagttatctctatcaacatctgtacatcttctagttaccactatctgcacagattcatctaataaactatcgtcctaacactatcgtagggtaagaacactaacaccctaacaagaataggagtccaatttcttttttttctttttgtaatttacactccctcgttgtatggtgtttagacaacaaatacatgcaatgcgcaccaagttatcaagttttaaaaataaggaaaaggattagttaattaattatgtgtatagttatttttcttttgtgcacacctatagtttcattggtgtgtatacttatagctttgcatttggttagtctaacattttaaaattctgttcaaattaggcattctgagaaattatctgatacacatggatcagataaggaagatgaagtggtggattcttcagacgatgattgtgatccatattttaactatttggttgatagctttatgactgcaactaaagctcaaccaaaacagttgtatggcaatattgatcttgttgcagctgcacaacgtcagtctaatgagtatgcaagtagtgctttggattactataacaaggatgaaaacaataaggtaaaattttgttccccttgattgatttgagatgatggttcgcgtacgtggatgcttaaattaaatctctgtctaattaaaattatatgtttacactatattaatacttggtccttagattatacactaatgtgatattgtaaccttatagtgattttaaatggtggtgtcacatatacggatgcttaattagatgagtggttttaaacttctagctaactaagatgctatattgcactatatcatcctcggacctcaatatatactctaggttataatagcattgtattgatactaggttgttgatgtgtgagagagaaaaagagattttctcgataaaaaaggttttaagaggagattttgatatatttgtttaatatatatgtcatgtagctaaaatcatcctatttatatgcaaaattataccagtttgcccaccttaggagaccatatcctaaagttagatgtctggtttcaaattttgtggtgctagatggacttccactttaggtgggtatattgactgtttccctttttaacatttgtactaaaatgtcttgctcgtttcacaagtatttgattcattttttgttatttgcaatgtgttagattcaatacagcttaatcaaagccttaaaaagcagtacaattagagagaagggtgagaaatatggacatgtcaacttcatagcatctttagattcaaaggaagagctatttttcgccgaagtttgttgggatcccaagaactatgatatggtgccgacctgcattgtatctcttgaggagaaaaggagaattggttagtatggaatcactggttaaagttctttgaaccatgtaattattatgttcctaatcctaattctgttaataacagggggacgctcctttattaatgacgagtatgtggtgtgtctggatctccaaaatccgcctatagatggcaagcactgctatggatgtagcgaagagattaagcacccagaagatggatctacgtttaaggccgggcatgtagccgccaccggtttttatgattctttcatgtagctgccatcagttactattctttcttccgagtttgtataaaagctcaactaatctacccttaacagctgtttttactgttctatttattttgcatcttgtctacactagcagacttattttgtggctatgaatggatgaatatgctgcgttatgtatacagagttgaggtgaaagctttgaatggattacgatattataaatcatacaatatcatattactaaaaaaagatccatcccgttcattatgaaagaaacaaaaattttccatgggacatggactatggtgaaaatctgacaaaaaatcacgtgataatgttgggtttagttcacactaaaattgaaaatttgattgaaattggaacgatgtgatggaaaagttgaaagtttatgtgtgtagaaaagttttgatgggatgaaaaagttagaaatttaaagaaaaactttggaactaaacacggccatcatcatggtttcatgcgtttgatttctggaagtctgaactcattaagaacgcggttatttatattaggataaagcaccagagatttgttagccctgtcgctcgagttcatccgcgtatgcttagccgcgtgctgtcgcgtgtcgccatcgctgcgccatcggagaaggaaacaaacactgattaaattaaattaaacactgagaaaattcctccccaacttcttctcgcaaaccacctcttttatatacctcccaattcacaactctgaacatcacaaattcatttcacaagttcagagctccctgaacctgaaatctgttcgaaacagaggccctctcaaaattctcaatctgccaccgcatcaacgaggtggggcccagcctccgtgacgtcacgacactgacttggtgggcccacctatcaggcctgtccacgttgaccacatcgcgtcacaccgtccacgacttttttttttcccctgattccctcgcagccagggcaccactccttctagaggaaaaggatcgattttttttcttccccaatttcttcctggtgctcacctcctcctcccccgggatcttccagaagcttccagaactgaccttggtaaagaatctttctctctctggctttcttggtggaggcttggtttctctgttggtttctcctggtgtgattggaggttggcgtttgcaggtgcgggcgagatccaaggaggagggtttcctgccatggtgaaggataccgcgtactacgacaccctgggggtcagcgtggacgcctcccccgccgagatcaagaaggcctattacctcaaggtgaattcctttttgcgcctttgatttcttcatctttttttttcttgattgattgatttcgtgtgtcgtcatcaatgtagaattgcagatagctattggcctattgagctaatcttcgtgtgccaaattgatttttttttaatctctcttccaggcgaagcaggtgcatccggacaagaatcctgggaaccccgatgcggcgcagaaatttcaggtagttttttttttctttttctcccgtgccttctgttgatatctgtgattctgtgctagtaatttgatttgttggatttgattgtggaatgaaaagtaagactacgtgttcacaaaaacatgttttttctttatgaattggaatagtttactgcaagtgtcaaagctatgctatagctagaagaatgtgaataggctggagtttgcttgatttttaccaagtgatatcagatttttgcaatgcagcgcctgtgttacttgttaagaggcatagttttatcgtcggagatgccatgattttcagtatgagcatcttctgggtgttaagaggcagagttttatcgacagagatgccagtatgttttttgagcggaatgtttggttgtttggtgtatatacattgaagctattgtgttgattgtctattcggcatcaaatgcctgcttaaattatttccctctatgaattattgaattaaatagcttgatgttaacaggaactcggagaggcataccaagttttaagcgatccttcaaaaagggaggcttatgataagcatggaaaggaggggcttcctcagtaagtcacgaattttttttatgtctggtaaacaatgggtgttcttctcaaaagataaaagggtggcaactaaaaaactgtttaatctttaatctgaacaagtgtgctgagaatatagagcgggccaatttggtaaattaattgcacagtgcaacaagaaaattggagtgtattcaaatgacctgtcaatttctatgggttgatacttggtagatcactatttccttagctataaaagcacatctgtttaaaggaaaaggagacttctctaggcacgttatgaaattcaaacagtcagttatggaacacaatattttcagttaagatgatatttatagttcaatagaaactaaagaaattatgcgttgtgctgtaccctttaagttggcgtcttacacattttacacggcatttcagggataacatggtggatcctgctgctgtctttgggatgctttttggaagtgactattttgaagattatgttggacagcttgcactggcatccatagcatcagtggaagtcgaggaaaacttaaacagtcaagaagcaagagggaaggttcaagagaaaattaaagtatgttactctcgaagttccctactgttttgcttaaatagtttcattaaagttagcattccacttaggctctaggatgctgagacacaaattaaaactaaagcttcctgtgtgacaggagttacaaaaagaaagagaacagaagcttattcagagcctaaaagatcgacttcaaccatttgtggatgagagaaaggatgaatttgttaactgggcaaatggggaagctcagcggttatcccatgcaggtacatcatgtgattgtgtactactttgtttttatttgagagggctatatgctttctgcagtcacttttactttgtttgataaatcagttgctttcaccagcagattggcaaattggatatgattacatccacatagacatagattttgtggggtcttaattttaaaacaaattgtatagaactcatcgttgcacgttccctaattcactttattcatacgagtattttaccattggcttatcaaatgaatatttttcagcttttggcgaggctatgctcaccactattggctatatttatgtgcgacaagcagcgagagaacttggaaagagtaagttgtatatgggtgtaccattcatagctgagtgggtcagagacaagggccactgcattaaatcacaggttaatgccgcctcaggtacaccccgagacactgttttgtttctggtgcaatatacgattcaagtactccttgataattagctcctgttgcaggcgctatcgctctgatgcagctacaagaagggatgaaaaagatggaggaaagtgacaataaggaggaccagattatgaagagtttcgaggagaaaaaagatgccatgcttagttacctatggaaaattaatgtggttgatattgagtcaacacttacacatgtttgccaagcagtaagtttttgcgtatccttgttagtggaagaaggcttgcatagtaacaattatgcactgtgcacgtcaaagaagaaagaactaaaaacatatgagttacttttgtgtaatcttctaccttacaggttttgaaagacgccagtgtcccaaaagatgttctgaagttacgagcaagagcattgaaaaagcttgggacgatattccaggtaagcttatgttaacgccttctgcctgtttcaaccaagtactcatggaaaaaccacatcagatctgcaaatgtcctttgtcttatactcttatgcatggccatggatggacgattggccaatatgcttactctctatgtaaccgtgcatcaaaccaaacagccaaaaacgaaccattgttgattcactgtttcaatattattgatcatcagttgaagttttgcgcatgaaccatcatagatgatcagttatgcataaaagacctctaatcaactagttccaatatataagttatgcatatgtgagtcttacctcatatatatcgtactaaaacaatagaagcagtggattaatccagatttcatacttgtagtgtctttcctgttgcagtatctttgcgtgcagctcatgtgttcttgttttgtagcatcttatctcgagtgagtttgatagcagtgcataggtgacagagcacacgatgattatattcacatgggttgtttttcaatgtaaaaatcagggtgcgaagtctctgtaccatcgtgaaaacagcctacaggtggaaaccagcccacggcagggagcagcaacatcgaactgaagactgcaaaagtacaaaaaggaaaaaaaaaagtacacctgacagacgcaatttctggttttttggaggtgtcgtctctcgtgtccgtttattcatttttgtaagattttagacgacgcgtatcgttctggataaaatttgctgtttgatttggtctccgttttctttgtaaaaatggtgatgctgtcgtgagctctgaacacgaagattttgttggtgctctgcaacctgcatattactagcttgggctatctcgttgtaagatttgcacccttttgttttgtctttcaagctggatgatctcgtgtgtgatgatgccgccatggcacctggcagtgtcatccatctggccacgagaccacgtgtggcatcgtgaataagctaaacaccatatttaaatttttatatacatgtttctagtgatctaaaaacaaaagctgaaaaataaattttgaagaaaacactaaaatcaacttcaagttcaaggctgaaaatttaaattttacttagctgataaatataagtataagtaaaaagacggggcctcacgacggagcatgagctgacctcacggtgccaagctcatgctctcgcggtgccaagttgtcgcgcactttagtgcttgccagtaagctaaacctcacctccgtacccaaagtatatatccaccaccattttcttgtggctcctgatcacaaagacaaaccataataaccatatataatcacaaaacacaaatagtgtagtcgtattaattagacagcacatgagcggagcccctcccctggctggctttgatcatactaaatattaatcagctgcctttccgctcacttggctggcttaattgctcacatgttgcccgcaaaagtaggcccgatcggcgcggcttaactccaccgctcgctcgctcgctcgcgttcgcagtcgcacgcacgctcgcctcgcctcctctcgcgttgtgtttgtgtgtcgcgcgcgacgctcgctcggttcgtttcgcctcgacacgcgatttgatgcgcgcgcggtaggattcgccggcttttcatccgcgtgcacaccgttcacgttggtttttttctcgcgcggagatcgactgcactcaacgcagcaacactgtggcgggcgcccggggggggggggggtggcgtgatttccgtgtactttgatcccttcgtttcaaaactggagtatgatgaaactagacatgtcttacgtgctgattcttaatccaaggatgagtccaatcttattctggagtattttagaatggttacgtactggtacctctttattcaacgtttggccatccatcttatttaaaatagattagtaaaaaaattagtacatataaatcattattcatattttatcatctaataacaataaaaataataatcatatttttttaaataagacggacgatcaaaagttggacataaaaaataaaaaagtgtcgtctttctaatacggagggactagttttgtcaccatcatcgtcttcgatactgtgtcctggtatgtacgcgttggcccgtctgccgaaagagacctatattttgcaaagaggattccacgagaagccaatgccgcaatggagcccttcatcataaatgaggccatgaacggtcacggacgcatggatgtaattaattaattaattaattaattaattaattaattttagttgcacgctaccataattgggtcctgtttggttccatgggctaatgtttagccctcaccttttagcctcaaattagcccttaagaatccaaacatgtggactaattttgagctaatatgaattagcctctctcaaaacattagcccctccaaggggtgctaatggggctaattttgtatggggaccatcaacaagtagctctctctcctctctttctactctctctctaccttttagccttgaattagcccatggatccaaacataccactctaggctaatgtttagcctactaattcatgactaaacattagctctcaaaattagccctgggctaatctttcaaacagggccctggtagtttcacaaggaaacgctaaattgcaagattagcctagctagcattagcatggcattgcattggcaatttggcatggacagttttaatcttcctttctttagctgggccacacgtagtactactatttttcaagatggtataagcaaatatatatatgctatgctagcttcctctctccgttttcgtgaaacacaaatcaagggaaaaaaggctaaaagcgtgacagcaacctgtgctgcgagctaaggttttgatgatgtagtaattgattagttcatcacacggcggaggaggacaaaaaatcaacaaaaaagtacatgtgctttctcagtgacgtgcagaaattagtagcacaaagcatgatggaggagacgactatttttctctcaaaaaaaataatattattattatagtgcacaatgttctcgtgtgtatagtagtaatgtctcttattctaaccaaccagaaaaacagtatacattttctcaaaaaaaaaaagaaaaaagaaacagtgtgagtagagtccgggctagagaaaattaacatgtagtagtagtaataataataataacaatcctaatcttccaatggttctttatcctgtacgtgtagaatatactgtagtgtggtaaaaaaaaggagtggtaaaaattaattgatcagaagtattccaagttgaagtcgaattgagccaagctctgctcatggcatggtagcgagaacttgtgctccagcgtggcgtcgtcttccacctgatactcgccgccatagccactgtgctgctgctccatgtcggcgaagggctctgccttggcggcggcgtcggcgccggccgaggcggcccagttgagcacctcgctgtcgagcacattgctcacctcggcgcaggtccagttgctgctgttgctggagctctcgccgtagcccaggttctccgacacgtcgagcacgctgctgtagtcggcgacgaacccggcgccgtcgtcggggtgggagccgtacagcgccgccgccatgttcgccgcgccgaggtcgaagccggcgccgaagtcggtcaccgggaacgggtcgaacaccgactgcttggcgttcgcggcgaggccgtcggcggcggcggcggcggcggcggcgccgtggggcttgtgatcctcatccacctgggtgaccgccgactccgaggacgtcgccgccgcggcggcggcggcgatgggcttgtgcgtggccgggtcgaggccgcgttgccggagcttcttcttgaggcagctgttccagaagttcttgatctcgttgtccgtcctccccggcaagtgcgacgcgatctgcgaccacctgcaccacaccattattccccctcaaatcctttatccctccgaccaacctccatggctgccgccattgcaagaaagcaagcaagctccgaaacggcaatgcagaatccaagacatgaaaccgacctgttcccgaggatctcgtgcagcgcgacgatgaggtcctcctcctgctgcgagaagctcccgcgcttcaggtctggcctgaggtagttgatccaccgcagcctgcagctcttgccgcatcgctgcaaccctgcacgacccaaaaaaccaaaattagcccaatcaagctcgccaaatcggcaatggcgatcgatcgatcgatcgaacagttggtgtctcatttgaattgcgtgcgttcttgcttgcctgcgagcttggggacggagctccagcagccgacgccatgtcggatgatgtgattgtacagcttatcgtcttcctcgggagaccaaagccccttcctcagcttcgcctgcacgccgccgcacgacgacagccgtcccattcctccccctcc

SEQ ID NO: 55812 - DNA, 18952 bp, Oryza sativa
  unsure (1)..(18952): unsure at all n locations
gatcagagagagaggcagagaggtttagtttccattttctttttctttttttgcttgcctaagattgatttctgctttgggcagcaatataatatactaatccagctagtacagttaagagagagactaaacactggttaatggcaagtgtaactgtaagccatcaatgagctcgatcggggacctgtgcagagaatcgcgatgtggtacggagaaaaatcgcgtcagatcatcgcgttttacttgtccaacttgatcaccccctgaaaacgcccgtcgtgacatgatcgaactgactgggaatcactgtgtttactactactgatgacagtaatcagctcacggccactcgctgatcttgagagagataattaatttaattaattgattaatcaaattaaagtcactaatctcactgatcgtttgatggatgtggcggagcgcaggtgctgtattagttgatggaagaaaagcggacacacggtaacgatcggattacagtggcgaagaatgaaaaatggagggaaaattggaattttagacgattttgctttttatgtttctctagcatttcattttttgtttaaatcagtgttctaattatgttttttttcctagcatgatccctttgatttaggcgttgggttacgtgagcatgacaactctataacaagctttgtgatcatgttcatctttttggtacggtcttaagtaatcaaggcggatgccctcttatatatacgtacctttatatctccagcttgccacaaatagttttttttagaaacaaaatagttatatattttaaaaaatatataaatacggagtatactggcatctgataaaaataaatctaaactctatctacaaagtaagaggcagagaaggcaaataccgtagtaaatagttcatgtaacaatctgtagattttttttatctgaatgtgtaggcttaatttaaacttcagaatttttttaggaaatttaagccttgaatcttagtagatagaacatatacttcctccgtttcacaatgtaagtcattctaacatttcccacattcatattgatgctaatggatctagataaatatatatgtctagattcattagcatcaatatgaatgtggaaaatgctataatgacttacattgtgaaacggagggagtatatgatactggcatcatcgcttttcatactattttattttttaaaggagggcaaaaacctttttttttgtgacttttacatagggtaaacttttttatatcttatttacttaaaaacatatcgggagtaatcgtattctctaatgttaaacttgatacccgagatatcaaatctatgaccgtaaaatttctcttatacatatggtttaagaaaacgaggaaaatatcctcttaacacgtgaaaacactctccccatctctacttaaaacagaaatatcaaatatggtacaaccacaaaagtagcccgacctatgtagtgtatcaccgatcacctcaagcaacataagtttacacatccctgttgaaattttcttttaacataaaatttagtaccgttgatttccgtggccgtgccttgccctgccgaccttggtgtgcccatcgggctgtctcgtccgcgcgtcaatacaaatacgccacatttttccatcctcggacgcggtcaagtagcaattaaccccgctgatcgctgtctcgccgcgtcaccccccctcctttcccgccgacaggtggagccaccctgccatgccaagccatattttataacgtttgcgttaaatatgtgtaaaatgtattataaattaaaacttaaagatgataatagatatagtgtgtctggtatttacgatccttaatccagccagctgatcgagtatcgtaaatacacagacgcactataattacgctaaatcaaaagtaagcttttcgtaatcggtatctcaggatgtagatctcggctaaacctgcctaacctataacgtgtctcttatggtgttctttcgtgtttagttaccgtcggttttataacaactttcgagaaggacgagcgctcacttgctcgtgtgcgcgcacgcgcgcttagattagatagtacgtcgcgcgcctggacactgctccaggctgcgtaggcgatcgttttctgtttgcgtcgtggaggcacgcggcgacgacggcgacggatttaacgtcttgcctgctcacaccacagctgatcaaatctccagtagtaatcagcagtggaaatgatcgatatgacgcgcgatttgggagatcgaccagaaaccaatgggcgatcgagctgtgtctgaattctgatcagctgttcattctctgagcattacccttgctgtcttttataatctgtcgtaccgacagagaaaaaatatccctggcttattgccgtgttcagagaaggaattaattcaaacacatgtcgatggaattgtatgtaaattcaggctttggcgcacgtcctcgcgattgtccaggagtatgttccaaaatatattacttttaatcttaggtagattgaagtattaaaaaagttgatagaaataattggaaaaatactatcattgattgagaaaaagaaatgggtgagttaattaaatggagaatggttgttgagagaaagggatagatagaatagtttcagtcggggacaagctaaatgtgttagaaatagttatattttagaacgtaaaaagtactactgtaacaaatgatgagaaagtaaaatgaagaaaaagatgtgatgagaaagcaacgtgcgtacctgctgtcctgctgtaaattgcaatcatttttgggggatcagaaaaaggaaaacatcgatcgtcgacagcagcgtgtccacagatacggcgttcagttttttcaacccccttttgatttttcaaaggcccagttgttcgttttgttcttgttcgtcggtagcttatgtggcacagcaccaaattctgaccttaccacgatgatgccgtgtaaatcgtgttactcttgttccctttttttttaacaaaaaggtaaaccgtgttaaaaaaaacaaataaggggggtgtttagatcgaggggtgtaaagttttggcgtgtcacatcagatattatatagggtgttgcattgggtgttcgggcattaataaaaaaactaattatagaatccgtcagtaaaccacgagatgaatttattaagactaattaatttatcattagcgaatgtttactatagcaccacattgtcaaatcgtgaagcaattaggcttaaaagattcgtctcacaaattagtctcaattaatctatgcaattagttattttttagccatatttaatacttcatgcagatgttcaaccgttcgatgtgacatggtgtacaatttttgggtgggatccaaacaccctctaatattactcgatcgtagtatagtatatatagcatcgtttgatttttgtcgtgtaacctgctgtcacaaggttgtctgcagacgaaatcaagaaacaaaagcgatagaagcctgagagttactgaagaaaaagggtgagaattacacaatgtttactttggattcagagcaaaagggatgggaggacagaaggacagcaaattgggcagagagggaccagagatagtagcagggaagaataaagaacaaaggcaccatgatccttgtacttgaagggaaaaggagattttgtatacagatgttgcacgaggctgtgatcatcatcagataactcgacaagaggagtagatggatagaacaaaagaaagcaaacagacaagaaggaaaaaaaaaaaggtacaaggagtcgcctgtacggcatggtatatgtgtctgtagcttcaaatgtgatcgattctccaatcatccagcttctgatcgacggcgccaccagaaagtgttctgcacaaatcaaagtccaaaacatcacgttttgatgaagcattttcaactaggaatctcgaaatgcaattcatttgtttctttctttatttttatttttatttttcattcaggggaaagagcagagtaacacgccattgctgctttgcaatgcccacatgttgatcgagatctgcaattatcagcagccgtaccacacgctgtctccccacaatttctctctctcagcaaccgtttcaacacagggtcaaccgcgcaataatcagaacctgtgttcatcttttgaatttcgagtaaattgatgcacgagttgcacggccctgataatgcatctaggtgtagctagagctatgatgacttgaattgcaatgttgcattgttacagttggatttctgttgttagctccgatccacggccggctggttggtgagatgaggaggacggacactgtcactctgtcagtctgttacagtgatcatcatcagatgtaccacttaccttctacctctactagagagtgtcgacaggaagtaggagtactaattaagaacacgttctaaagagttaattgagcttaagtacttatttttcattagcattcttttttaattgctaaattgtatgtttcgtacgaaatctttttatatagaaagtacatttaaaaatgcaaataagtctatttttaaaagaaagttaataattaatagtaattaatcatatgctaaacatgtttctcaattagcgtgtacctattcagtcaaaactatactccgaaaagaaagtgccctaattaagggtctgtttgtcacagctcaaactccaactccaccttttcagcactagtgcacaatcaaacaattttagctccacgttaaaaaaattagtgtagcgaaataaagtgctctcacaaaataagtacttgtttggtttgctactatgtcaaaatattgcaataccaaaccataggcaaattttggtactaccaaatattttgacaacttatgcgtcatcttattggcatattttgatagcaaatcaaacactagtcaaactactattcaaaatacatggtagggcacattttggcatcaaaccaaaatggctctaaactagtagaaggatgaagttggatttaggttactttataactctatttcagaactaacttaaattcacgaattaggatactcccaaattggccatatttgtacgtatgtacgtagcttgcgggataacggcaaatgatagcgtctactcgctagcactacaccgagagcgagtgagagatcgatcgagtaggtgatggatgacttgcaaatgctacaaccacaagccaaggttggaagagagaggaaaacggaagccgtgcggctagctagcgtgagttggggaaagctagctaaaccaatttctagcctggctcgcccgcgtactcgcgcccgcgcgcgcgcgttcggtggcgtgtcgccgtcgcgcccgcgcgcgcgctgcatgcggacgatgcgtccatccatccatccatgcaaccggcgcgcgcgcgcggcgacggcgctggcatcatgccgccatcggcgagggtcgccgtcgtcgcttcgatcgaggctggtccaagaatcgatcgatcgaacggcagaagagaatgcaggagtagctagctagctaagctgatgacaactgtagctgctgcatgagctacgcggatgtgagtgatcagctttgttcgttgcctctacttcccagcttgcctctcgtttttcgcgcgcacgtttttcaatctgctaaatattgtattttttataaaaagcttatatacgaaagttgcttaaaaaattatattgatatattttttaaaaaaaactaatactttctctgtttcataatgtaagtcattctagcattttttacatccatattgatattaatgaatctagatagatatatatgtctaaattcattagcatcaatatgaatgtgaaaaatgctaaaataacttatattgtgaaacgaaggaagtacttaattaattatgcgctaatggaccgcttcgttttcgtgtgcgggacatgggttccaacccaggctgccgagtccagtgtagctggatggtgaggcggcaggctacgtaggcgtacgcgcaccgccggttcggtggcctggccgcgcaagccgcggcgagccttgcgtttacgcgatcgtcgatcgtcgtgtacaatgtacctagatcgagctagccctgcgtatgttcgtgcgagcatgagactgacagtcatgtgatcgatcgatctcaatcctcaggggaaatgatcaggggttcgatcgattcgtgttaaatttcggactcgtcaggcgacgctgataggatcagttggtactattggtgactagctacctggtcctctctctttttctaagaaaaatgattttatgtttgagaagataattattgagagagatcgcgatttgtggtgttaattatggtacatatatattgagcattctaccttcaccaagggaaaaacattaaaaaaattgtcggataaacactgtaacactaaggtaataagaatgtaatagaaatatattgagtttcagactcatcagacgctgataggattagtttggtcttattggtgactagctacttggtcctctcctctctttttttttttacaaaaaaaagtgattttatgattcttacatattgagagatataatttctggtgttaattatggtacaccttgagcattgaagcatctacagaaaaagcattgtaacactaataaaaaataatagaaaaatcggtactatccctcctgtcaataatatttgatgttaggatagggagtatctttcagtgcgactgtaaaaaatatattaaaaaaatatctcctgtatttttcgttttgtccttcttttaaggaaagtcgtttcggccctttgacagtgcagtttgctcaatctcagacactgcagcaagcaacaaaattcaggataatcgacaactcgcgatatgcatccatgagtgaagtgaacagaggcattaacaaacacctctcagctgcaagcattttgttgtcaaataaggacagagagccagttacccatcacacatacgtactatcagggacaaaattaagctcgtaggttgtagggttgtatcttgtcctgttcttttggcaaagtttcaagctacttcaccaaggtaggagcgatttcattttccaatcaaagcttcaaattcagagcggttacaaaaacaaaaacagtggccattttcaaaccaaccaaaaaggcacgaggagactgggactggtgctgcagaaaaggtatcgtaaactaatcatctcgtccgaattcataagttgtcggttactgatcgattggtgcttctactcattcacaaaatgcatcactcctcacacatgcatctcgagtgtgctcgacctaattttcagatgtagactgaacatgatttcagaattcagtgctctagcttagctccaatactcccaacagtaataccagtaggagttaagtagtactcacatgttgggtttttcaatcagttcataaacccatcaaattaagatgtcatggaaaaaaatttcagacgtacgtcagtcgttaatttctagtcccatcacaataccagtataatctgttgactaataaggctgtgtgtgtatatgtaccttttgttctctccatttctttaagaaaactccatgcagtttggtactggctaccacagtgtggtacattcagtattgcagacaacaagtggacgaagaacacgagaccagggtatattataagcttataattaccagtgtgactaatacaaggtcgtaggtcgtgtatatgcagagaattatattgcagattccataacacgtagagtggccaatcgattagcttctacaagtgcatgtccctattgatggacaaaaagatccagccaagaatcttacatgagacctgatcttgacttgcctcctctagaaaggaaagggaaagtgaaaagcagctaagagagaaagaaaagaaaagaaagcacaggaaagaagcatgcatcatgctggctcctctttgaagttatgcaaacccaaagctagctagctaaactaaacacaaaaggaaattttatataaaaaaaacattagcatgtagtagtgttaattattacatatcggattcagaatcatataaaactataaattggagtagccacatgttgattgtttagtcattgcgacgtcgccagaggagaggaggttggtgtgtgcagtgctatgccgttaccatcacaacagatagcgtgatgtgcacttgccttgcatgagtaacctgcatgattaagctgttcggtacaatggccggagagctagtagacagtggtgtttattgatttaattatattcaagccatgcatgcaaaccaaactgtgcactaattaagcaccccctcacctaatttaggctgctcttttttcttagtagggctaccactgtttcctctgtcatcaatcctttctcttgcttgtttatttacagcaaactgattagaaaattgattggactggttaaggtaggtaatcatagtagctagtgaattatctgatgtcacaagaaagtttgggaacaaaatgaacactgtagttaacattgtgcctagctagctttgcttgttttcttctgcttttaggcatgcatattgtgttttgggtgctgatcataaagctttctcttgccctgttagcaagatcagtttttttattcaacaaccattgagtaatctagaaagggaatcaattagtgtgtgatgagcttaccgactaataattcagttgattgattttccaacagctgaatacaggtgctgactgaagtttcacagaatcttcttattacccatcttgattcctgtactcaaaatgattttgtgaaactgaacattcagaatatttgtactattgtactgtactgaatttgacattgagcctctagttcattacaagtacagcttaggtgtaagatggtaccataatgtgaatcgcaagcaaccactattggaggatcctgcatatctttatctgctggttaagcaacgatatatattggttgaactgagctcaacatcagcagtataagaaatcaatcagcaaacgaagtttttattaaaaaaaagaataatagcaaaaaggttctgaacattgtggcttctgacaacctttgctactctgctccatcatcttcatgtgttgaagcttttttttcttgtttgttttaaaactactagaagctttacatttcttgcattgcatatatagggcatatatactcacttgtttccttcaaaaaaagtccatacactttgtgagttgtccctctctcttggtcactgatctttaatttctcaagtgatatttttgttggtgatcagaagatgccacctctaatccaagtttccatcatgcatgtcacaaagtaaaggcacaatggcaattaagccatcgcaaccaccttagataatcttatcaaataatcaatcctatctcgtccacacacatagccaagtaatattctagcactgtaaggtgcaaggaaatcttgcatgacatagttgcttcccatgaaatctttctctgacattgaccttaaacattttcttatcattcatggcaacctctgtgcatgcatgactactctgtcaaattaattccccttatcaaagccgttgctgtcctctgcttagtactcctactacaactgacaaccagcaaggtctgtactagatgactcagctacactgaattaagtgccaaaaacatcactgcgtagcagttgcatgttacatcagatacatgagtagggatgatagattgacgaactgatcaacacagcaaatcaagcccttgtttcaagcagccaagcatgcataccaaatgataatgatattatctccatggaagatgaaactgcaaccgcatatatatatatatatatatatatgcagattactatcatgcaaattggcatgcttgcagaataatctgcagcaagatatactagcaaattgtgcatggacagggatagatgttccctgcttgcaattgcaaagtcgctggcggcagcacacaagaaagctaaagagagaagaaaatgttcagagagaaaatttcggaataacgaccacgactgccaccaccaccatgcgtcgttttctctgcatgggatcgatggacgacgtcaatggcgggaagcttcttcccgcccttttgacatacgtggcaccggtccatgggccccacgtggcattttcgggaggtttgaccagcgaattcgagtgtcggccccaacaacgagcgtcgtctgcatagctgcagagagcctgcaacctcgtgagtgaaaaggcagtgcaacacgcatagaaattatgtgtgctgctttgctttgctttgctttggctttgcatgcgatcgatcgtgctcgtcagctgtaacgctaatcgacaattgcacagtgacgcattgttcatggatataatcccatgtctgcatgtgaaaaatcccatgaatatatcacatgtaagattgttcataagggacaaggtgtcggattcggagcatgtacgcactaaacagcacgggaattaagatcgatcagttcgatgaatcaaactgtttctgccggaataatccagcggccggagaacagcaaagtgaatgggaagtttggacttattttttttaccgggggcttgtgcattgtgattgatctctatccgtcttaaattgggtggtgttcttggtgatcaagaatgcatgcatgcgttcctgtgctagctgctccgatcgatcgatcaatcaatcaaatctggatggacgtggtgaggaaaatgatgaacaccgtaccgaactgatcccaaccagtggtaaacggtagtaacgcagcggcattggttgcaaatcgtggtcggggccgtgcatccaattgacttaagggggcacgtaattgtatgattagctttgctgattcgtgacctctgaaaaagattactccttcctatacgtgaggtaatttcgacgcctgaatctgtgtaggatacattcacagagagagagagagatcgatcgatgagcaggataaattttgcggtgttgttcactgcagactgacttggtcccgtgtctacgcaccattgaaatatgggggctagatattcacaacatggagctcacgatgatcgcgctccgtgctagatggctctgggctcagcgggcctcccaatccttgtcctggtaggagccagtggcggatctaggatttatgtgatgggtattcggaattctaaaatagcagatatatcgataccgattgacgcattgactgtacgatacatcattttgatgcataatctttactacgaactatgcacatatataataaaatatatagaaacatttacaatttcctataatcagcatcaaacaattttctattgatctaagtatgagtgaagagtaccaaagaattcggaatttttggagattgtatagcataggtggacagctttatgtagcaaagatattctgatttattgctaatgaaggaaaacactcataaaaccacgaagaaactagtagctagcaaagaaatataacttatttccgtaggacaattgatatcaattagacaacaacatgtagagaaaaacaactgagtgggcaatatatagatgtatatacaatttgcaaagataactattccctctgtttcataatgtaagactttctagcattgtccacattcatatagatgttaacgaatctagacataaagtcttacattatgaaacggaggaagtgggcattaaagtaattgcttattaattgccacaaccaaaatgtaaacaagaaaatcaaattagcatgaatatattacaaaagaaagggagggactaggaagactattgatcttgttgggctgaggagagctagaaaagggtggaattgaattgttagggtataaatatcacaaatctagatagactatggtggtacatatatattatggtcaatatatattaggtttgtgtccaaaattcatgggtattcaactgaatacccatgaattacgtgggatccgcccctggtaggagcttcaaatcccatgttctaggcaatagcgcgagtttgttgccgcttccatgacttgtgttcttggtgatagcaaatatattctcttctaggaggagagatggctacagggttcgagtcttcgctcttgggcacccaaactctatagtcgcaacccgacgcgtgtccaccggaagctctcggtcgctgatgcgttggtcaacaaccaatggatccgtgaccttcgtggctccttgggcatccattcaatactgtaatacctgcagatttggtcgatattgcggtcaacaattctttccgagggccaacctgattcattcatctagaggtgggagtgggacagcttggggtcgtactccacccgctcggcctaccttgccctcttcttgagaagtgtttcgttccggcacctacctatctggcgctctttcaccccacctcggttgctctatttcctgtggttggtcacttattggcgctattggacggttgaccgcttggagaagcgtggcctgccgcacccaacctgttttgtcttctgtgaccaaaaggatgaaacaatagatcacattctaattgggtgacccgagtccctacatttgtggtagaccgtcctcccaagtctcggcctccctcattgcttctcctctaacgttgtttccttccatgagtggcactgctcctgccgactcaaagttcagagggagcgtcgccgtaggtttgacatggtcatgacccttggcacgtgaggaaccactgcgtgtccaacaagtgttcccggccttggtccgatgtggttgtaggcatggagcaagagaccgccctttggcgtcttgcccatcccttgacgccaacgctctcttcttagcgtgccaggtcgtttggtcgttcaattgtaaacatgagaataggcttaagtccctttgtttgtttataatcaatgatttatctttgtgcatgtgtgtgacgaagactgcagtggagtagagaaaagatgcgtgcgtttgtatcgatcgctttcgtttttgggtcgccgtcgttttctcgccggtccggctagctcgacgtcgatgacttgaattgcaggagaagaagaggacaccggcgatgcatatgtcatgtctacctccctttcgatcggggggtctacacgtacgtacggggtggcggacgggcacctgtacagccgccacggcacagttgtgtgtgcccgactacctgccgcgacgtgcaccggtgctcgccggggaaggggggcagctaggccggccgcgcacgaggatttgacggcggcgcgtcgtgcgggaccggggggtggcccggcaaaatgtgttgggcctttctgatctgcgcagcgtgaacggcctatgggtatggggtcgtagtaactgaagagtccaggagaaaccgtggccatgggccggggctgtacaggtgaaggcgtgtagcaggagtgggaaaaggtgcacttgaggtccctcacttcgtcgtcaagtttcaaaatcgcccttgaaccaaaatagtactaaaaatcttaaacctccagcttgtaaaacaggaataaatttggtgctcctgctcctgcagtataggttgtcgtggtcatgggcagggtttacgatttcgacgaaatcgaaatttcgacgtttcgatgagactcgaaagtagaaaccgtctgagatttcaagaagtttcatccaaattcaaatttaaattgataaaaaagaaaaaaatcaaataaaatattataaatactatgatattcatagaatctattgggatataaatttttgaaaaaaatgatgtattatgtgtatttactgaaacttacattagaaaagaaaagaataaagaattaaaaaaggaaaacacttacatgggccaaaaccgaccgaaattaaaaaaggaaaacacttaatgattgaaattttgatgatttcaatcagaatttcaccaaaaccaaccggctttcgagaacttgtcggtaaacttatggaatttgtatttaaattttgatttatgaaatttgttcaaaaattaccggttttccaccggatttcgcgaaatcttgaattccgtcggtgcctgaaacggaaggggctgtcggaatcgtaaaccctggtcatggctcccatggcccctgcgcttggccagcacaagcgtggtgactgccggaagcaaaggcgtagccatcttccgtccccatgaggaagacggactggaggtgcacagttgcgagctccggggcatagttgacaacgccctgcagatccttcacctacacgatgcagcttcatcagctgcgggaagggctatgccgtcatcggtggtgtcgatggtgtggtgccaagccacagctggacgggtgcggttccctgcgtcggtgatggggcctgaagcaactatgttgctctgacggcggcggtacgtgaaagggaagatgattcgacgtggcgcgcatctcattttataactcattagacgatgattctagcctacttcacgcggtggccatcttttgccaccaccaccatcgatctcacggcagacgctcttgcgcgccgctcggtgcgaccgtccatgcggagaagaatgcagctagcaccgtcggtgtatcgatcggctgcatcttaacgtctgtgcagacgtatcaaccgatcgagattgggtaacgtacctcgcgcctaccgtgttgcagcaatcgctggccttcgatggctacggtcatggtctcgatcgacgacgggatctagggaaagataagagatgatggaaagtagagggccacttacatgtgggacccacttattttttttaattttcttttttctaactaggatgccatgtcagcaaaaccacctatccatatacctcatcagtcaaaactgggagcaaaattgccttgggaccgaatgtgacccgattttgtaagattagggatgcgttatatttggtatttcagcctaggaacgattttgaaattcaacgacaacatgaagggcccaagtgaacttttttccgcaggagtaaggctactaggccaacaaggcctagttttatgagagaacacacagagagtttggaaaaaagttcactttaggcccctcattgtcgtcaagttttaaaatcatccagaataccaaatataacgcattcctaatcttaaaaaatatcacattaggcagccacgtcaaaacagaaccataattaatatgggtcccacgctaactcacaaccacgtcagccaaaaacaggagtaatattgtcttggtacttaatgtgatctagttttataagattataccttgtatttcggtttagagacgattttaaatctcgacgataagataagggacctcaagcgaactttttctctagagggttacaggcttacatccagttttcaacgacgtggtgcacaatcaggtaaattttgaattttgatgatttggcactatattcgttgtcaaattgatttcattgacatttgtagagatgatacgcgggactatgagtcaataaaagtgagccatgaattaaataatcgaacccacttttatagagggttaaatgaccaaatctctctcgcaaatcaacagtattcaagttgcgtgccgcaggtaaaaaactgtggtgcttatgacgacagaaaagttttatgctgcacgcgcaatagcgtgatggaagaagacacgtcaaaattgtgcgttgcaatttggctgcgttctatgccccaggttggagagattttcagcgcacctaatacgaaataacttattaacatatgaataattaaatattactccctccatcctaaaatcaaaatataagtatttttattgttcagattcataactaaaaatacttatattttagctaaaaatatttatattttagcttgtaatagctaaaagttattacattttagaacggatgtagtaatatttataaattaaaaaatgtacttatttgattttttaaagaaaaattatatagaaaattttgtaaaagacatataatttaacagttcgaaaaagtgctaacaaacaaacgaggaagaactgaaagtaactctacgaaaaacatgagtaaattaaacagtacaaatgtggcacattgacagctggaataaacaacggagcacattgattcatcgccacacgtatctaaaaaaacttgtaaaacctccagtgcctcacctactctgcagtctgcactaatgatacccagccgcctgatagtgcgtcatcaggttttggcactggacggccatgaacgtctttagctatgacctcattcattcctcaatcaaacattttccgtccactctctttcacctaaaactgtacaagtcatgggtcctctttaaatgaatttttacaagttgcagcatttcttaaaatttctaactccatcgaacactatagcttctcacccaatttctaataatatacttacatcccaccgaaatcctttatatggatatttttatctatgtaattatatggatgaaatcctatatattctcagacggaggtattaatctagaaaatatgatattgatttttgataagttttattggtttttatataaacataagcatatttattcatattatttttaatccatatgattttaaataatatagatcgggactgacatgcttaaaccatcaactcccatcttaacaaaaaaaaaagaaagaggcatcactaaggcctggtttagttcccaacttttttcttaaaactttcaacttttccattacatcaaaactttcctacacacacaaacttcgaacttttccgtcacatcgtttcaatttcaaacaaacttctagttttagcgtgaactaggccctgtttagttcaaaagttttttttccaaacttccaactttccatcacatcaaacctttcatacacacataacttttctatcacatcgtaccaatttcaaccaaactttcaaacttcagtgtgaacaaaacacaaacacacccttgagaatgggctggcatctgggatgatagtactgtgcaggaggccaacacccagcagttgaggagtaggccatgaccatgaggaccacgagactgacagctacagtacccatcaacgtgacggaaactataaaaatttccgtttgatactgaattttgtagcaaaaaaacgcagatctggatccatacgaatactaatggcatcgtcgttttggctcgtctcctcccccgcgactataaaaacgggagctttgctgctgcgccggccgccccaccacctccggtccatctcggccgccgccgctgtcgctgtcgcgatcgcgatccccgcctagatagacttccccaagaacccgccgccgccgctgcaggggtggcgtggcatcgcgggagaccagctcgagccttcagcctcttttgcgccgccgccgccgccgccggtcgatccgtgttcttggctcaggcggcgtcaatggcggcggcgaatgggagcgcctgcggcggagcggcgtggacaaggagaaggaggagttcaagcagatctacggggtgctcaaggaggagctgctcagggacccgccttcgagttcaccgactcgtcgcggcagtggatcgatcgcgtaatgcttttctccccctctcctttttcatcttgtgttgctgaccgcatgtgtttctcctcccggatcgtttcttccggattttcagtagggtttagatcgggtaaatgattggtggaactgcaattaatttagtcgcagcacgtgtaggggttcgcttgtaaattctggatcctcagttattagcattgagtgattaggcctttttgggaggtttaatcttggttaaataactagtagtgttatgttggagtgaatcagcaagtgcagtaaaggttggctcaaaattcccttttgttaaatgagctgctccaattctgtctccatgtcaaaaggagaaaaaataataatgctcacatttggaaggcaaaaatgtgatattttgggttaagtgaattcttggggtgataaagcgtatgattattaaaccttggcctactgcttaaccatagatggatcatggatggtcggcttagtcgcctactgctttctccatttgctactttttttattatatataatgtaaagcttcacaatagattgggtgtacgacagatgatcttatcagttaaattgtcactgttgggaactgctcaatttaacttgtttattttctttgaagcagatgttggactacaatgtacctggaggtgagatggatttgacttgattagtctataacatatgagtaaaaagtaaaaacacactaaatctccaacctattgtctttgatatggtagggaagtgcaatcgtggtctctctgtggtcgatagctataagctgttgaagggcaccaatgttctaagtcaggaagacatgtttctcgcgagcactcttggttggtgcgttgaatgggtaatgctttaacctcaactttccgaataatgggtgcaaatcaactaaaattgctcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncc

SEQ ID NO: 55813 - DNA, 743 bp, Oryza sativa
tatgcattgatttaatttgatttgtgcatgtggtgaattcctctatgcaatcgaagggactaaatcagattcatacgtacattgattatcattgtttatgacgcagtgaagtcctcattatcaatcaagtagaggtcctcattatgactaacaagtggtatcttcttgcctttaatttctttcaaaaaaaaaaaagaaaaagacaaacaagtggtatgcgcactagatacaatgaccatattccctccggttccattttaattgacgttttggacaatgaaaattgtgatctatctaatggcactattaattagcctaaataggatcttttatttggtcttttgtttaggttttcattgtttgtgcctagttgcggttgcggattttcgtcgatcagggatttctcgaagattcgtgaagatcaagaccctgagcaaggcaagccacctttgaacatcttgagcctataattgaacttaattatattacttgcaaaatattatgcattgataggattgcacataatatgtttgccccgtctgcgaggcatattagtgggcatacctaacttgttgcatttgatccttccgttgttaaattgttatgtcatgtttccttgtaaccacctggtcgcgcctcagtattcttgcactcggtgcgagtatcgacggtcgccgtcaaacttaaaaatggtaaacatcttgggtaaaacttggttacaaaacgatgggaaaacagacgcc

SEQ ID NO: 55814 - DNA, 1205 bp, Oryza sativa
tcaaaagctaatctttcagctcaccttcgtcagagatcagagtgaggcataacacaagtacacagcatatgtaccttctgctcttgcgagccacaagaaataaaccaagaattcacggtcgaaaatccgagctgaaaacgaagctgaaaccacagcacaattcagagagtgatcaccaatgatcggtgaaatgcagtgctaaacggcaaaaaggatggaacagatcgtccaaagtggcactctgctggcattggtgtcacttgtccgtacacacggttcatactactttcagagctcgtgtccatcactttcttatctgctcatccctaccgatctcgcagatcaaaccggacgcacaatggccgatctctcgtatccctgtccgatccatcactcgtcaactgcaaagttttcgcgttcatgcctgcacatctgcttttggtcaaatggcaaactgagttcttgtgcacttggataagaccagttgaaacgagttcttctttcagagcggttgacctgctacagagctggagccggtgtaacgaaaaggggcccttcaacttttggcatgattgtaacaggcgcaatagtggattaaacaagtggaatgcccaatggaattgcactgggactggaaggaatttttctacaagaaaatacttcgatgcaatcattggttgatgagccttgatgtcctgtaccgtaagagcaggtacaatagcaaggctattagccagctataaacatattttaataagataaaagatgagatattttaatgagataaaagatgagagagaagagtagcgggctacagatctgtagccagctgtaggaaggactccaagacgcaatgtgtatatgacatgtgagatcatatgttaatagtgtagtaagcaactattgtatgaattggctattagatcggctatagataaattggagctagtagtgggctatactattaaacttgctctaagaaacaagaaactgtaatgaaaggttgacctgtagtggtgagagtattgctggatttttcacattttggtgcttttaaaaaacttatttcgcaaatagacccctgaaaaaacttatcccagaaatggtcctttttggggcgccagagcgggacggcgccagcctctctggcgtcgtcctcctgccaccgtggcgcacgcgaaccgacgtggcaggaggagggcgcc

SEQ ID NO: 55815 - DNA, 18817 bp, Oryza sativa
  unsure (1)..(18817): unsure at all n locations
ccacaaaaaaaatttaaactcgaactaccacttagtctgaaaatatctagcataccacttaatctactttgcaccttcactaaaattagaccataactcttttaataaaaccctttgatcagcatgttaaacataatgcactctaccactatatgaaattacttaatctaattcaaaatataaccacatgaaatgacatatataagttaaacagtacatagagatgcaattttttatttttattttatttttttgatattttttttatacttaggagaacataggaaccaaccgtataaaaaataaactcaaacggacaaaatatgtgacatgtagaattttccaaaactctaccgaaacggacaaaatatgtcatctattaaaataggcgtaactttctcatacggactcggaatcaggcaagtaatatatgcacggacatctacagaaaaagttacatccgattctccctgcttcgccgggttcggcgatattaaaacctccaaattccgcttgcaagattgtattttcgaggagagaagtttttcggtagagctttggaaaattccacatgttatatatttcgtccgtttgagtttattttttatatggttggttcctgtgagttcctaagtgtgaaaaaaatatcaaaaaataaaataaaaataaaaaagttgcacatctctctcctctgcactagttcggagagagaggagaggagaggagaggaaaaattctacatgtcacatattacgttcatttgagttcaatttttctatggttggtttttgtgtgtccctaagcgtgaaaaaaatatcaaacaaataaaacaagaataaaaaatttcggggggtggcgccagccactctgacgcactccccctagccacctcagcatcgccccgccacgtcggcagggggacggcgtcaaagaggctggcaccatcctgttgaacgacggcgccagccactctggcgcccaaaaaggaccatttttagaagaagtttttcttggggtctatttacgaaataatttttttaaaaggaccaaaatgtgaaaaatccaggagagtattgccatccttgctgtttgacttcggcgaagcaaaggcaggtttttttggatcccaaaatgttcagttttcatgggcacgagccgtctgaacaacgccgctagcttttttcacaccgtgagatctgacgcgcttgcagctctgcaaaggcttcgagcagctgccgctgccagcaccggcgctagctgcatcctactcatcgtataatctgtgtgctatatactcactgatcatgcaagcctgaatcagaatcaggatatcccgatcagcgtctttgtcttgtaaaagagaaaaaaaaacatatatagattttcagttcccggcacgacatgatccgtgaacagtagctacatagccgcggctgtatttttttttcctctcttgggaacaaacggtgtgccatggcatggtggtttgtagaatccaccgaaaacggtagaattttcggcaatctgtatcgtgaacgacggcaaaattaaaggggttggattcttgcttttgcttggctcggcggtgaagtggagtggagtgagagggaatcaaccgaccgcggcgaaaaggggagggaccgggccaccgatcgacgcaaggcaggcggcggcaagggaggacaagcacgcgcgctggtgatctcacgctggacaagcaagcaaacgcatctgactcctcacacgcgacgacgagccgtccaccccatccatccgcttggccgccccgcgccgcaaagcgccgcgctctcgctcgcaccactttcggtcggcgcgcaggcgcagggcatgggccaagccnnggggcccccccccccccccccccccacacacacacacacacgctcgctcgctcgctcgaagcgccacttgtcccggccctgcgctcgacgtggccagcgacaccgagccagcgcgagtacacgtcgacgacgtcgtcgtctgtccctgtccggccccgcctcggcgtcgtcggctcgtcgcagcggaattcctgcctgcgtgcgcgcgccgtggcgtgttagtgcactaccaaggctgtgtttaattcacgccgaagttggaagtttggttgaaagttggaacgatatgattgaaagtttacgtgtgtaggacaggttaatatgatggaaaaagttagcgcatgtctagattcgtagtactagtaaatgtctcatccaatcctagattattatattatgggacggagggagtaggcaaagactgtatttagattcaaaattttttcttcaaacttctaacttttccgtcacatcaaatgtttgcacaatgcatagagcattaaatgtggaaaaaaaccaattacactgtttgcatgtaaatcggagacgaatcttttaagcctaattacgtcataatttgacaatgtgatgctacaataaacatttgctaatgacgaattaattatgcttaataaattcgtctcgcagtttacatgcagaatctgtaatttattttgttattagtttacgtttaatacatcaaatgtgtgtccgtatactttaaaaaaaatttggcacacgaactaaacacagccaaaaattgatcacaatccaaataatatcaaagtgactatttgaaactaccatattttgacatggcacaaattggcactaaggttatgtacaatggtttttgttagcggtctctctttattgtcatgcaagaatatttggtgacgtgaaaaagagaggaagaaggaaagagaaagatggttgctacgcatgacaacggcgtagagtcgagtcttaatatttattaggaaatttttttgttgcgttgagtctaataaaggaaagatgactagtaagaaagtattttggtatattaatggttagagaccgtattgtcctaactattgtaacgtgatagcctctaattaacgtagtccatatcgatctctatttttgtacttgccctaatccaaacatgctctgcgttacgttggtgcagtgaacatgcatgccgcggctggtggatggatagcttgtgcatcgtgcataaactgcatatgcagcgaacgggtgcgggaatatgcatgtgtgcgcgcggcgcacatgccgccgaggagaagcaggggaatttattactcatccgatgatcaggagttaaaaatatgaatattatactactactccggtcgaggagccgccgacgtgagaagctttttacgggtgaatttaatgaacgtactgtagtattgaatactggtaactgtcacagtactccttcacaaccgtgtccttgattctggaacaagacacggagtacgtatatctagctgatgtatctcggtgcgtttacctttttttgtggaaacgaatttcatcttccaagtctttgcaaaaaaacggtttctagatacgaacaagctgttggaatttggatggaggttggaagaaacctggtgttggtggcgctagaccataaaaaaaacaatcctgtggtggactcgcaacaggccacagtgtcaagccacccaccgtggcccccccgaagagcatcctgcatccaacacccacagcgccgcgcctttcaggtgcacccgctgacttcgaccatcaaaattcgtttatacccgtaggtctccgcttcccatcccaaatcaccaattgcatttcaccaaaaaaaaaacctgtattcgaacgaacgacccaggactttgacaagtaaattcccagtgacctaaaaaaacgccaaagaaaatttcagaacacttgaaccagtagcgagacggaggaggaggtgagattgacgcggagggagacggacggaagaagccgcgcgttcccacggcacaacggagtcgacgctcgtccatccatccatccacaccgcgagcaaccgcgtgcgcgaaaaaatcccccttgcttcccacgctttcttttccttcttccgtattttcccataatccccctcactttttacacacgccaaaacgaatttcccccatgttccaaacttccaaagcttcccaaataaatccacaagcacaagtctcccctgccctatatttctccccctctccctatatataactctcacccgccacaaaacaggtaaacaactcgccacaagttagctcaagctcgagacaaagagggaaccaacagaaaccaccacggcggcggcggcgcgacacatcaccggagagatggcggtggcggtggcggcggcggcggcggtgagcaggcaatggacgagggtgcggacgctggggcgcggggcgtccggggcggaggtgttcctggcggcggacgacgcgtcgggggagctgttcgccgtcaagtccgtgggcgcggcgggcgcggcggcgctgaggcgggagcagggggtgatggccgggctgagctcgccgcacgtcgtcccctgcatcggcggacgcgtggggcgcgacgggtcgtaccagatgttcctcgagttcgcccccggcgggtcgctcgccgacgtggcggcgaggtgcggcgggcggatggaggagtgcgccgtcggggagtacgcggtggacgtggccagggggctcgcgtacctccacgggatggggctggtgcacggggacgtcaaggcgaggaatgtcgtgatcggcggcgacggccgggcgaagctcgcggacttcgggtgcgcgaggtgggcggattcgggccggccgatcggcggcacgccggcgttcatggcgcccgaggtcgcgcgcggggaggagcagagcccagccgccgacgtctgggcgctcggctgcacggtcatcgagatggccaccggccgcgcgccgtggagcgacatggacgacgtgctcgcggcggtgcaccggattggctacacggaggccgtccccgaggtccccggttggctgtccgccgacgcgaaggacttcttggccaggtgcttgcaacggcgccccattgaccggagcacggcggcgcagctgctagaacacccgttcgtcgcctccgccgccggcgacggcaagccggaggccgcgaagtccaaatgggtgtcccccaagagcaccctggacgccgcattgtgggagtccgacaccgacgaggaggaagacgacgagctgtcgcagagcacggccgagaggatcggttcactggcctgcgccgcctcgtcgctgccggattgggactccgacgacggctggatcgatgtgatctccacccctaccgaagaatcctgcgagaccaccacctcgccggccgacgaggagacgacgactgacctcaacggcgacatcagaaccgcagaattcgagcttccccacattgacgtggacagcggcaatggcaacaccacccacaatgtgggagaagccaatgctcagcacattatttccccttcgaatttagttttcgatcaagtactatgtaaaacaccattttgtaacaaacacattgcaattgaattcataccatgttttctcctcacaaatgtttttctccccctttcgctgctctgttcatacgctcctcacccttagtctctgccctcctcctatcgcgccacgtgtccgcgaatttaccggccaaaattaactgcggtgaccaatacgtgcgggagtgaaactgcgcggcagcttgcttgctctgcaagtgcaacactgcgcccgcgtagtaggaatgagaaatcgatcagcttcagcagttcagcttccccaccacggcacatacacacgcccgaagcttcgcttccgacgcgaaagggatcgagtcgagtcgacacggaaagcgcatcgcagcagcgcagcgtcagggcggacgcagaaagggggccgcgcgcgcgcgcggtcaatagccttcggcctctcgtggcgccgcggcagcacagacagcagcatatgggcccgtgtccattcagcaaaggcgagagagagcgagccgacggtgaaaggcgcacaaggggaagaaccgaagaaaaggagttaacaaaaggtgcccattttacaagtaagcgtcgcgtcctactactgcgagcgagcgtgcgtgcgtgcgtcgttgcggttgcttccaccggtggggatccggcatgggaacgggatatgctactactgccaacttcggtgtgacggtgtcacggtccgattcgtgattcgtccccccgttgtttttttcctctctctctctacgtgcaattcaccgcggcgcggactcctcctcgatcccgtcgtgcgcttctggatggcgtacgtgtcgggtgcgggatgaggcggagtcggtgttccggtgggtttaacggttgacgcccatatgcttttagcttttccgatgtttgcaagactgcgaaaaggctccgtgtagattttattattagtcgacgcgatgacacgacgcgtacgggacgccgccgcccgttttatcacaaaagcgagcgatttgagcggaagtcctatgcccgtcatttttggcgggtagaagtagaacagtgatcgattggattagcatgagagcatggatgaacattacacatgctcatcgtgcctggaccgccgtcagcaattgaaatcaacgatgcaacactctccctctggttttttaatttgtagtgatgttgacttttgcatttatatttaaccaaacattttattaaaaaaattatatgtaaaataaaaaaataatgcttaaaatttttttagtgataaaataaatcacaacaaaacaaatatatgataattatgtaatttttgatatgatgaatggttaaacatatttctaaagtaaatgttaccgtgcattaaaaatcaaggagagtacttcttacgacttacaagtaattacagataagattgttaaatcgcagattctaaatcaaattaacataaggtgtcatggtgcttaccagctgatgattatatagtactcccaggcgatacatttaactacagagaggtagttgcatatcagacgtttgatagattgcccctctcgttaattaaccacccgcaatgcaaacgtaagagccagcgtcatccacgcataacgcatacgtcgatcgaaatcgcccggtttggatttggtcggcgtctccgcaagcgcgtcaacacaatcccggtcgccaccgcgagccgtacaaccctgaaagctgtggacgccatcacgccatcgagctgggcgcctgggccacagtgccacttcccccgcaccggcaccgcggcgccacgacggagtacgtacgtgcgtgtggagtccacgcgcagccgagcgcgcggcgcggcgtggcgttgcgcatctcaccgccaccaccaccgcgcctcctcgccgtgcgtgctcatcatctcgttctcatccggttgccgagacggacgagatgccgagccgccaacccgagcagcgcagtgcgatgcgaggcgcggcccgggctttcggttgctgatttatttattatttttttcgtttttcttttcctccgggagggtgtgcgggtgccgctttctggacgctttgtgcttttctgttgctttcgccgccattctcctccctttcaagcaacggggccgcccgatcgatcgatcgatcgagtgaaggaatcttaaaggtccggagagatcttccggaccatcggatgtgcatatcgatcgctgtcctggctgcgcaattaaaaccagctcatggaattggcgtaataatgactgattagagagagagagagagctcttttacgcggaggggttatctcacatgacatgacaggatcatcaccacagatattttattgttccaggctgtagccaaaatcttcttgggagccaagcaaaaccaagtactactactagtactagacctgtagtggtagtgcatctgatagaatattcccttagcttaaacatgattggggcaaatgacagttgtgatttatactatctcttgtgcaagatgagttaggtatgcggcaaaacggtggtgacaattgttgggcacgcacagtcggactgggatgggtttggttggcagccggttggcactagttagttaagcttgcttggtgtgtagttatctgaacaaacccaagtcaaaaattacgttgtaatattctaacttgaccggtaattgatcgagctagatacaaatatccaaaccccaaattgatgtcccaatacaggccttccaatcattagaccccatgataccaccgaactaattaaccaaaataatcaccagctcagcctaattaagttcggtggcgtcaaaatatggcagccaacatagatcagcaatataatagtggtactactagtagtatactcacgcgacgagccaaagccaaacggccaatcatgaggcggcgaaccgggccgcgccatgtgtgcgcggtcgatcgcttgtgcaacccaccaaaaccgcgcgtttttcatctggaatttttttgccgtttctccgtaggatttgccgtttgtccccaccgtctcgctctcgcgtgcgcgatcgttaggccaccggcgcgcgcggtgccggcgtgccaactggataggcattggctacgtgtatcgcaccgtctcgtttcgtctcgtctcagccagccagatggtcattattgctctccgttgcagctgttcgggcagaaaccaaccgatcgagcgagattttgctaaggacttgactcggctgggctgacttcacactggcgaccctggctggctggctggctcccattgtttaattagccgggggaatttgattactcgctggtcaaaaatcaaattcgttattgtttttaaaacgagagaccatcgatcgtaggtcagaggagatacaccgacaaagacacaaagtgtttaggacatgtgctactacttctcagaagcactcctataaactattcttactgtgtgtactgtgttggtcaatgatcttatgcgttctctttgaagcccacagcttcgcgtttctgatcttccagtcgtactacctcctacctcgcgtgcttccggcatgataattgcaggatgttgctattcatttcttgcaatgcctaatattttccacgaggatgatgcgaaggacaaatgtgaattatactagtctactactatggcctgtttagatttaaaatattttctttaaactttaaatttttccgtcacatcaaatgttttaacacatacatagagtattaaatgtagacgaaaaaaaatcaattgcacagtttatatgtaaatcatgagacgaatcttttgaacctaattacgtcatgatttgacaatgtgattctacggtaaacatttgctaatgacggattaattagccttaatagattcgtctcgcagtttacagacggaatctataatttattttactattagtttatgtttaatattttaaatatgggtccatatactttaaaaaaattggcacaccaccaaaacacacggtatatgagaaaggaaaacagtgagcagcaacaaacaatcgctgcagcttcttcacacttgtcaggaccccagcaagaagatccgtgaactgatgaacctaccaacctgcactttgcccgcgtacaggcacaggtgccacgttcaagaagagagagagagagagagacagagagagagagagttagatgggaaccgaaggaacgtgagccagatggcagaaatgcagccaagtgatcggtccagaaaacaaaagagatatagctggggcggtagcgaggttggatcaactacgctggtgcatacttgcataatctgagaaaattgacaagagttgtataccatttgatggaagcagatccgaaaagcaactcaattttagtgggtaatgcaatgaacatgattttatcattttaagtttgttcacttcgctaccatttttaactctatcaattttgacattactaaattttagtaaggcaacaaatcaaacacatttttgccattgctaccatgccaaaattagaaaacccagaagctcttactctcaaaacctcaatcaatatttggtaagactttaaactaaacgttgataccaaaatttagtaacaccaaaacgtgctaaatattagtaacattgaaaataacaataaaatgaacaaagcatttacttcgttgttaaaagcattgggtaggataaattaagcactgttatttcaagattttaaattcaaccattaatagagtagtatcatttgacagtcccacctcgaataaaatcacacaatcccgtcaattcaattgaaggattaaatttctcattttatgtaaaaggattaacttagagcatcgaaactcatatgattattgaggatttggggcgtctccacgtatacacattatggccaatgaaattgtaaatttctaatacaccacatatacacattatgacctacatgttagctctatactttcatgtttcgtatacttgccaagaaatttatgactaggtgtcaatattttttcgcacctccacgtaacttcatgatccttataccaaaattaggtatgtttggctgcactacttcagctgtgacatagcaatattgcacactactttgtgtcactacaagcagttgtgtggctgtgtggtagcggctgcaaaacgtgcatccgaacacacctatcaaggtgaaaataaataaataaaaatcttatatagaattctttaactaaattgattgtttataacattccaaagaggagataacttttgcgatactatatttgccttttagatagtctccacgcagtatatctatcttcaagcaaaactgcatgcaatttctctgtacacaagggtatatacttcttcacccaatcaccaaaactgcatggatccttccactttcaactggcatttcccggctcattcttctccttctagagtacaccgccagtccgcaaccctcacacccaacatttttttaaaaaattacacagttccatgtttgtttattttttctaatgaaatcaatttcatatttcgagtttcgactatcatttccttgctgattcttcgtatattctccagtacacagccaccgttgcatagttgcacccaacatccgatttttttgttagttgctgtcatgctaatccaattgccaaacccagatacccaagatttgtgtagtagtagtaacatctgtccatagtaaagagccccgatccgtcaatgcaagcaacacgtttcccccaatccaccagagtttttgggcgaaaaaaccccaaaccgacacgccgaatccctcctcgtgctgcaattctccctcgttttccacttgcctcgcgcgcaaatcccacgttccgttccacccaaagccaccaccacgtggcccccccgcgatcaggatggccccacacgccagtgtctctaccccgcacgaggcttcgctcacgtgcttttcccgcgcccatgcgtccggcgcgccacaactcgcgccgaactcgcgtataagtagcgcgcgctcggctgcggccatggccaggcaaaaaacaaaaaaaaattccgagacatacatagccagaggaggaaatcaatcgatagtgggcatggatgcggcggggatgatcatcggcggcggcgggcggcggaggctgacgagggtgaggacgctcgggcgcggggcgtcgggggccgtggtgtcgctgttcgcggcgggggacgacgagctgctcgccgtgaagtcggcggcggggccggcgggggcggcgcagctgcggcgggaggcgggcatcctcgcctcgctctgctcgccgcacgtgctcccctgcttcgggttcggcgccgtcgccggcggggagtacgggctgcttctcgagttcgcccccggtgggtcgctcgccgacgaggttgcgaggaatgggggccgcctcgaggaggacgatgtccgggcttacgcggcggatgtcgcgagcgggctcgcgtacctccatggggtgggcatggtgcatggggatgtgaaggggaggaacgtggtgatcggcgccaacgggcgcgccaagctcgcggacttcgggtgcgcgaggcgcgccgactcggctgggccgatcggcggcacgccggcgttcatggcgccggaggtggcgcgcggggaggagcaggggccggcggccgacgtctgggcgctgggctgcaccgtcatcgagatggccaccggccgcgccccctggagcggcgtggacgacgtggtcgccgccgtgcgcctgatcgggttcaccgacgccgtgccggagccccccgagtggctgtcgccggaggcgaacgacttcctggacaagtgcctcaggcgccgcgccggcgagcggtggacagccgcgcagctgctggagcatccgttcttggcgctcgccggatgccgcgccgtggccgccgaggagacgaagcccaagtgggtctctcccaagagcacgctggatgccgcattttgggagtcggacgccgacgacgaggacgacgacatgccggagagctgggccgagaggatcatggcgctggccgtcccctgctctgccgtgccggattgggaatcagacgatggctggatcgacgtcatgagcagccaatccgaacttcccatcgcggcggctgaaacgccggccgagcagacgcgcagcgaagtttctgaatcgccggtggcttcgccggctttggagacgacgagctacgcgagtgcttgggatgaaagatcggaagctgtaatggatgctgacgtggacgatgacgatgatgagctcgtgcacaatgtacgaactgttgatacctttgtggatgaacagctccgccaagatatttatttagattttactactagtgacccaattgtacttcatgttgatgtttctgatgaaagaaaagtaaaattattgcctccaattcctgactgcctctgttcctccccttctctttcttttttcgattttattcactcaaatctgataacactacaaactcaaactacaaatctgaaacttcaaacctccaaaaatgtgaaatcgagggcagcggcatcagcattaattcttcagaacgatggaacgtagacctaaacctctgaattttcagaaccagtgataaccatttcagttactgctggaactgagacgtgttcgttggaactcatgaaaatgacagcctctgtagccgtgacccccctttatgacaactcaccacaaaaccaattcgttcaaccacatctcctcatctactacccgtatacacaacaatctcaaactcaaagcaacagcaacaaaagctgcataatcccattccaatggcaacctttttcatccaattgccgccaaatgtggcaaccaactgaactcaatctagacatgaatccaattcaccgtctctgcagcaacatcactgtctcctcctgctgctgccgtcggtacaagtggcggcggcggcggccgaggagaagtgcttctgctgcaatgctgttgctccggcgacgatgtggtggtagtgtgcacgtttgctggcaggttggtggtggctgcaggaaagctggggagatgaagatgatgcagatcaggggtgacacttggccaaaatctctggattacctcaccccggacaggtgtacactggatggatagatagatttccctagctgcctaccgtcttggagtggagtgtttgctcttgtttctagatccctacaattgtttgtggagtacttgaactaccacaacattttttttacttggcaccaaattaatcatatatatttctctatgatcttgtgcatgaattactacagaattagtagtttagtactagtggtacagttcttaagaacaccacttgactagctaaaattttcagctgcaataattttcagctgtaatggtagaacatgtgttcatacatgtactggtcaaacttttttttttatgttccattacataattattacagagtgcctctcaagaaaaataagggcatcactgcatctacacttctactacatctgagagtagtagtagattcagtaattcggttgccagctcaacatctgataaaaactgtcaaaagcatcgccatgtgtcattgtcacttataccttgatgctatgaacaaccttgtagttgtagtactacttggcatgaactttctccatgtttcttgaagagcaagggagataggagttatagtagtggccatgccagctgcataattctagagagatatccaggtgtacaagttgccagtatgccacagagcccagaggcaggaacacctaactaaactgtattcgctgggttacctccatgatccattttaaagtcagcatcctgctgcagaaaaagaaaatggataatgagatcttctatttgacgaaaactatcaccctaaatttgacttctagaagttagttgagtttccacaattaatttatctgaataagttctggactggtggaagtctgcatgccaaagactccagttttcagagagagttctgaagacaacaattcgaattccaggtctctcgagagaagattcaggcttctcgaacaactagatgttttggcacgaagctgcgtggtgcgtcagcgcttaattcgattgcacgcagggcaggcttcgtcgttgacgacggctgtgacgcactgcagctaccacctgcaggtcaggtgtatcatcatcttcttcttcttcctttcagaattttccaagtcagcccctcccgtttcagaactttccaagtcattcttggaaggtaacaatagcagtagcagtattattctctggtggaggcttcagaaattcagacaaagccgcctcctccgatccacgcagtggtgcaccagcggtaataaaatgatgaactgaattgactcatactcgcaagtggataaaggaaaaaaaaacaaaaaacaaagaacatatttcgacaaacgcaattccaagtcagcacaacttgcacagaagtgagatctttctatagtctatttaaactgtacagcactactgttcagcaaagtacatatgaacatatccaaagaaccaaacggagtcaagctactagaaagattatattaatgttgtaagctcgtgcttaatagtaatagaccatggatctgtgccatgttctcgtctacggaagctcgaaactttttacacgatagcaaattagcaagtggaagctgcaggcgagcttcagttagcagttggtgagcgcaggggaaagctcaaaaaacggcgacccgagtgagtcaaatgccaagtgcggggctgcgtgccgttttggtggccggcgacggaggcaacacgggctcgtcgactcggcgaagcgccctcgcgcgagctcacatttagttctcattggcattgaccggagacattcagcctcatcgtttggctgataaagatgagaaagcgaaaccgctgataaagatgaaaaagtgaaacagtatatttacaaatggaaagtattttgtgtatattcacaatttgatcagctaggcttaggcaaaaatagaagatttgacgttctgatcttaaagctgcttcctttgtggacttgttttctttgctttatctctagcttgtttggctatgccagcagcactagtcctccttttattttgaactgtgttgcttcttgtaaagctggaaaccccagcattctgtactctctgttatgctttatgaaaagctgggcgtctgccttttctctaaaagtattttgtgaatgagacttttatatatgtgttcttaacgaattaaaagcaaaagctgaaaatgaactatgatgaaaaaaaataattccaaaatctactctaaatttaaggttgaaaatttaatttttggctgataagtaaagatgaggcttttgtacgagttgacgataactcttagaatattcctgatcatagcttccagatcatttttttaaaaagagtaacagatgtgccataaaacaaacaagatttctcttggattaaaacttacgtcagcctgatgtcaaaatggcccattaagtttcagttcgcgtttcctccagcactggatcacagagaaattattgaaggaaaatgtgcaaaccaaggttctgaaatataaacatgcgggcaatagtggttcagattatggagcaatgtgcgtggttctcttctcacctccagtttctcagggagggctgaaagtttaagcctgtgaaaatccaattgtaagctctgctgcggaaatggtactgctccaatagcaatagccaacattggtggtgtttgaatcttctcaagatgaagatgaagataaagattaagtgtttcacgcaaaatgaggtggtaataacgtgcgattaattaagttttaattattacaaacttgaaaaatggattaatctaatattttagaacaactttcatatataaagttttcacacaaaacacactgtttagcagtttgaaaagcgtgccacgagtatccaaaagtttatctaacttttgtgcaacagagtcacctgatatacacacagtccatgagattatagcagctgcagcttccagtcgtctgaactttggctctccaaacaatttagattctcacccaacttttgataatctgtagctaacaatctagaaaattaattagaaaacaaaggctgagaaaccaagcttttcttctggattcctaaaagttgattgccaaacaattgatttttaaaatcttaaacttttcaaacagggtctatgctagctctatatagattatggtgctccatcagcatcttcttagaaacactgaatgttctgtgtgcacgtgcaaacaaaacaaaaaccgtgtaagagcaacccattgttgttgattcataaaaggaggattggttctcggaagatcatcacaataaagcaatgtgatggcttagtcaatctcaaaatatataccggttcaatctattggaggtacatgtgcttatagggcacatcatacatgcatgaaccatgctggtttaaaatttaatgattttcagttggagtaaactgtcatgggattacctagatatttgttgataatatttctctcagaaaattgtgagatgtaaatataggacaatcacattgcaattacattgtaacctgcaactgcaatatagcttggatgtaacttttaaaaatcccatcataaaacgctatttctgcaatggcgtaggttggggaccaaatcccctcatccgtgcctgtgctatgtgatttttttccttctctgcttgcacaaatcttgaagagttcaaaccaaattatatgaaagtacatgcaaattacaacataattatactatttatatttgacaaattttaaggaaaaagttgtcggcgaatgtatagcaaaacaatacttcctttgtcccaaaatattgaacctatgatgagatttgattcatcttaggacaacgaatcaggatatactagattgtagttgtactccctccgtttcatattataagttgttttacttttttattagtcattttttatggctaagtttatagaaaaaattagcaacatttataataccaaattagtttcattaaatttaacattgaatatattttgataatatatttattttgtatagaaaatattaagtttgattattaaaaagtcaaacaacttataatataaaataaaagggagtaatattttaggatggagatgtcctaaagtatccagagtttcggactgttgtcagccatccatgatcaatccaaaggcaaaaagaaatggagaaggctatacgtcctagcattttcttactaaattcttactgatgtgtcatgctacaatcgaatcgtgaattggagaagtaatataagagaaaaaatagtttaaactttgctcgaataaacttaaaccaacctaattattgtttttctagtatggatgcatggcttccgatgcatgtagtgggctgcacctggtgcgtctgcatgcgtgggggatgcaggtcgtctgcagtacggtaggaaatctcaattgatgcgtgggtggaagctaaaatcggacgcccgatccgcagtcacttccaaaaaaaaaatagtacgtgtattaatgctcgaaagaaatctagcgccctgttggtgttggagttggagatgaacccaaccaacggtcacactcacacgccctcctctcctccatccatccatccatgcgtgaatgcatgatgcgtctcccgcgtccggcgccgctgaaccctcctctcctctctctcttccctcctgctggattgctttggtttctttcatttgttggctacgacttccttctgctcctcttttttcgtcgtcctcctctcaacgggaatccggtgatgcgcaatcatcgatcggcgacctcaccgccggcgaccggacacgggaacccacgcggccttcctccgccggagtatcctcctctcctaggcgccgccggctcggatcgttctcttctttgttggtaaggaacagtacgctgcccctcatgtccatcccatctgcagtagattcagcatttacatttcgttttgtgtatctgtggcgacgtgttcttggtgaaaaatatgtatcgttcaaatttcaagcaacccaacgaaatacatatcataagtttgaaatttttcacattaaaaaaacaaaaaaaatcccaaaacaggacgagcattttatccagcactaataatatgaagcaaaccggccgctacttgtcatttgatatcgagattgtgaaggttgtgtacatatacatcgcttgcagtgtttttcgttttgttgctgtctgaaatgctcttctagcaaacgggatgaaggatctctgtctcc

SEQ ID NO: 55816 - DNA, 4970 bp, Oryza sativa
tgctgtttagatgacacctgatgataatgtgagcttctacacaatgctttcctgtttcatttccctctattttgcctcaacacaaatttgtccgctaaagatttttttagtgttgatcctggctatttttcacattctctgagatctgaaggcccttattactttaaaagaaaggcagcaagcttatcaagtatagccggaagggaaaacccaagattcgtgagttcagactttctagtgtaagttcatatgtatgttcgtttgcaatcaatgtcagctctttgctacaggatgaaagtaacgatatttttttttatcgcaggacgaaaatacattagtttggtactcccacaacaaggaaaagtgcctcagactgtcttctgtgtctaaagttatacctggacagagaactgtaagttgaattgccaccggacagttaactgttggtggttaatttgctggtaaacatgaagcaagaaaaatatatgttgttggtgatactccaagagtaaactgtttcattttaaacatgcagcaagaaaaatatatcttgttggtgatactccgagagtaaattgtttcattttaatgaatttttacattttttttcgagccaaagaacttttacgttttaagttgtgatcttatggattttcaatttttaacaggctgtttttaggaggtttttacgccctgagaaggattacctatcattttcccttatatacaagaacggccaacgttcccttgatctggtaaaatataaattctttgtactcgttttcattaactggggttaaatgattttacccctaggtgctatagtttatggaacacaataattttcttacaggtttgcaaggatcaagctgaagtagaagtgtggttttcgacacttgagtcactgattacttcatgccgtctaaattttctgaatgatggtcaaactgatagagtatcattttctgaagtgagttattctcctttccccatttacattattttaatttatattaaagtcgagtacaaacaaaaattcaccttcattttctacaacaatttataatccaatccttgtacaaatgtggccatcccttttaaggatttgattggactgttggaggtttcagcttccttgagattccgatgagctaataaaaatataggatgcacaaaaaccatatttgagcatacaaaatcattattgttaaacaattatagagaattaatatacctagtaaatcacttctgtcattatgacaccgactaattctgtaatagttgtttgacttagctagaatatcatcaccttactgttcttgtttaacaaatgtttcttttttcaggacgtaacaatctatcaagatagcacttcctatgatacaacgctagatatcgcctcaagtattacacgtagttttaactcagctggttatagcacaccgaattcattgaattctattagagcagatgttggatcagaccgcgtaaatatgctaagagcaagtacaggagacaatagccgagttagtatttccagtgcccctagttcttccagtcaaagttctggactagatgacatcgaatccctcggcgatgtttatgtatggggtgaggtgtggactgaggtgctaccctctgaaggatcctccaactatttgtgcagcaaaacagattttttaattccaaaacctctagaatcagatgttgttttggatgttcagcaaatagcatgtggctctaggcacattggccttactactcggcaaggagaagtattcacttggggtgaagaacttggtggacggctaggccatggtactgatactgatatctgtcgtcccaaacttgtcgaatccttggcagtgtccaatgtggaatacattgcgtgtggggagtttcatacttgtgttgtaactgcatctggtgatctgtatgattggggtgatggatcatacaatgctggattacttgggcacggaactggagttagccattggcttccgaaaagagtttcagggcctctagaagggcttcaggtactctctgttgcatgtggctcatggcattcagcactgaccatgtcaagtggaaaacttttcacatttggtgatggcacatttggttctcttggtcatggagaccgtgaaagcgttgcatatccaaaggaggtagaagctttgagtggattcagagcaatgaaagttgcatgtggagtatggcattctgcagcaattgtggaaatcagtggtcaggcaagcacaaatgcaatgtcaagaaagctgtttacatggggagatggagataagaatcgcttgggccatggcgataaagaagcgaagctagttccaacatgtgttcaagcactcgttgaccataatttccatcaggtggcctgtggacatagcatgactgttgctcttgccacatctggccatgttttcacaatgggtagctctaacaatggccagcttgggaatccaaaagctgatggtaaacaaccatgtatggtgcaagataagttgggtaatgagttggttgaagagatctcatgtggctctaaccatgtagcagccttgacttcaagaagtgaagtatatacatggggcatgggagccaatggaaggttgggacatggtagtgttgaagacaaaaagaagccaactcttgttgacgcattgaaagatcgtcatgttaagagcatttcatgtggttcaaatttcactacatgcatttgcatacataagtgggtttcaggtgcagatcagtctgtttgctctggatgcaggcagccatttggtttcacaagaaagaggcacaattgctacaactgtggacttgtccattgtcatgcatgcagttctaggaaagtgctcaaggctgctttggcaccaactcctggcaagccacaccgtgtatgtgattcatgtttcatgaaactgaaagccgcggataccggcgttatcagttcatataacaaaaggaatgtcatcaccaggcgatccattgatatcaaagataagttagagagaccagaaataaggccttccagacttgcaacgacatcaccagcagagccagtcaagtatcaagaaacaaaaaatgttagaaatgagacaaaaccagccgatcctatgtccatgatgaaagcatcacaagttcctgccatgttgcagttcaaagatatggcttttgcaggaacatttggtacagttccaactaccgtaaaatctatgacaatgggaggtcaaatgcaaatgggcatgccaatgttttcaccatcgccaccgtcaaagaagccaagtccacctccagcgaccgcaagtcctctgatcggtaaagtggacaatgatggcttgaagaagactaacgagttgctgaatcaagacatttccaagttgcaatctcaggtatgaaagaacactctagattgttctatttcttcaatgtgattagctgaatttgttaaaaccattttttatgttgacaggttaataagttgaaacagaaatgtgaaactcaagatgagcaactacagaaagcagaaagaaaagctaaacaggctgcctctatggcttcagaagaatctgctaggcgcaatactgtcttggattttgttaagcatcttgacagtgaggtacattaaactactattactgtgcaactcttcatctattattatactttccatgatagtgtacgtatttgttctactgtatagtttggagtatagtagctctattgtgttccatttatattactgacacgtttctatagctcaatcaaaatacaataaagggcgcacgatataaaatcatgtttatcatgttatcctagtgtcttgtatgatcataattgcttcaaagttcatgtttatttatcattattagaggatatactcatgatatcacaaccctccattcttcagctcaaggttattgcagacagggtgcccggtgatgttgctgacaacttaaaaactttgcaaagccagtcggagagatttcttgcaggacaaagtagtaatctagtggagattactggccttactggacatgatatcggacaccataggtcaagtagcacgggtagcctgccagtgtctcaagatggcagttctggaaatgctagtggctcttccattgccatggctagtgactctccatgtcaccgtatcatggaaaacaacttgaaggctccaggtgacttcgcaccaaagtatggtactcatggagaagtgcagttgattgagcagtttgagccaggagtgtatgtgacgcttatccagctgagggatggcaccaaagtattcaagcgtgtcaggttcaggtattccatcctcaaatccttcttggatgtaaaatatatcttccaacttgattaatctatcaatagtccatctttcaaaaaacaacacttgcaccatccacacttttgaaggaaaaacttcgaagcttttgtttacaattgaagtgtgttcagttcaagatgtgcactgaaagcatagttctttctatgtttttgtttgaagcaacaactccaggtgatcatttatttatggttcattcttctacaatcttttttttttgtttagcaagaggaggtttgctgagcagcaggctgaggaatggtggagggaaaaccaagagagagtgttcaagaaatacaaccatccaactaactaggttccaaagaaatagcagtgaaagcaacaacccatgtgaaattacttgtcatttttagaatgagctactgggtaagaatcttgtttttctcttatgcttagtaaatttcttttcttttttaagataatggaagtataacttctggcctctagaccaattagcaatgcacacaaccatatttgtggatgaactttggtggatagagtcagatactaatgcctccacaaccacacggatggtgcctactgaattgctgatatacatcttgaagagtattgatgattg

SEQ ID NO: 55817 - DNA, 1650 bp, Oryza sativa
tgctgcctctttgccggctaccaccatcattgtcggttgccacctgttcgccgatgccgcccatccccggccactgcctgctgaccgccgctcattcttggctgcgccgcccttcgctggtcgtctctcgtcttcgcgtgcttgcttgttcgcgtgtcacttcttttttggtcggattctttttgaccgatcagatccgagtgaaaaaaaagttaaaaatttactttgggtcatgttttattgcaaaagtttcagtttggaccataatttgtccaatcattttattttggactagataactttatctttgttgcacaagtgaccaccccaagccacatctttagcacttcaatgacttcgagcaaattgttaatgacatgtcgacgaattttcatacctatatgcatgtcatacctttatcgagggagacactagacatgattagaaaatagagttagggtggtctattatgcaacaaaggtaaagttatctggtctaatgtgaaaagattaggtataggatggtccaagtaatattttggcaataaaacatggcccgaagtgcaattcactaaaaaaacgagcgactctcgtagttgcggtaatgcggtgcggtcttctccactgctgactcgtggtcttcttcttgaccgaggcttgttacttaaaaaaaaagaaaggaaaagatagaaagaaagacatttcctgcctctgcttgctgccactttatttttgcgctttctccgtcacccattgatctttgatgatgtcttctttgtcaagcacaatttcagtttctcattgcccggatatttttgatggtgtcaactacaatcactgggttcagcatatgcgtcatcacatgcatgataagaaacttcacatgagggggaacagtagtgcggtgtcgatctactcatgggtgaacactcaaacatatgatagtaaacttctccaggtagatgaacacctgacatcaatcatctggaaaactagttgacaccccgtgctttactgaggaatatgtggatgaatgcatgttatacattatagaaatgttagatgtgtatgtttaaataatgtgaaaatgatgtggagataatgagttgacattgcttacatattgagttctaaaaatacaataaaattttaaatgatatgtcatgtttgcatgatatttaaaatactctagataataattgctagtgggtgatgatctggtatacttgcatatgatttaaaatactctagataataattgctagtggatgatgatgtgatacacttgcatgttgagttttagaagttagtggacattaattttattataagataggattccctgtcaaaaaaaatcatatggaaaaattcagattcaggtactgaaaaggatttggaaagacactcccccttatttgcttggcctgattagtgggcgcttatccaacctcgctggcattccttccttctctggatgggttgggcctaattaattattttagccaattaatgtgtgtacatgctcggaaattcgaacataaatcagaactccgtatatgcttataggtcaagattgcgtcccatataaacaaacaaggccaaactctttttctttatttctttcttgttagatcgttccagatgcacagtc

SEQ ID NO: 55818 - DNA, 1498 bp, Oryza sativa
ttgtcaatgaagcattacaacaatgatgagaaaaacattacaataatgatcactatgctattatcgttaatttgtcaatggtagaaacattcatattcatatccgtgtatgagtcagttcttaagttcgttcgcttttgaaaatgcagatccatatttgagtcggttttaagttcgcttttggaaatacagaatgagtcgtataaaaaatctctttaaaaaactcgcatgctaacttgagatgatcgaactcctaattacatctcatgattttgtagagaaacataaatccaatcgaattctcatagtgaattttaccttaactaaaatgtataataataataagattaaaataagcttcacccgttgcaacgcacggacattttttctagtcattctagtaaataataaaagttaatagaaagagagaatagagagagacatattatatcatatatggtataggtaaaaccgactcgtattcttcctttttatctttagttttctacacttaacggtcgtactcgtattcttaagagtattgttttgtggtgaggagtcggagttgaagtcgtatttggatcgaacgttcagtcccttatattgagttgagttattattattcacgaatagctaagcaatgtctcttgtcaggccggccgtatcaaaattcgaaaccacaggaacttcacctagaaagcgagagcgagaggatgcggccttcgttgtcttcacctctagtaacgacggggtaaaacacaaatacgccattgtttttttttacaagttgtaacaaaacaaataaattaaactcaaattgtgcccatctgtgtttttcggatgactagcaacaaggtcttctttgtaactccggcccatcaaagcttgtaaaattacacatggatgggcctgaattgaggcccataaaaacgaggcctggccaacgtaagtccgtaaccaaacccgactccggacaggagggcagcggcgagggtgtcgttccgatgggggaggagcggccacaagcgtggctttgacaggagggcataattccccatcgttaatttatagcgatcccattactgggaagatagtggaacttcctcccttcccctatcgtcgttcgtaagaaaaaaaatcttatctgaattctccatttcatcattatcactaccaagcctgaaatgattgattgattgtggtagaaaacccgccaaagtcaaagtagatacccgaggtgtccctaaggccaatgtcaaagtaagctactacctctatcttaaaataagtataaccgtgggtatttgtgtccaacgttcgaccgtctatcttatttgaaaaaaatagtcacatataaattattgttcatattttatcatttagtaatcatgaaaatactaatcatgaaaaatattcaaataagacgaacgatcaaacgttaaacatgatcaatgtaaaattgtaattattttgggacggatggagtacacaatactact

SEQ ID NO: 55819 - DNA, 4475 bp, Oryza sativa
aatccatgataatgatattggataggctcaaagcctaggctaagcctgaaactgaaacaaagttgcaaatcaaattcaatgtttacatgatctaaaacaaaacaaaacaaaacaaaggagtaccttgccagcaccaagttcactcttttaggtcttagcaaaaagtcaagtgagctgccacatgtatatacaaagtagtaaaattagtggcaaatcaatggcaatgttgagaaaactatttggaccttgaaacatttgaaacccaacatgttagaaatacttgcataattttctagtggtattcgttgtcctggattggcaaaaaaaatcattaggatcaaattatagatagttgaagcctcttttatcgatttgtgctctcatcatttggcaagtgtcaactgaactgtaagtaattaagcaatgttagaacttctccattgtgaatccaccaataaatcaaatatatttttcataaatctcaatatcccatcatctcgtattctcattcaatagacaaataccttctcttgccgtatatgcatgcatattctcattcaatacacttctcctgccgccatatatgcatgcataatctcattcaatagacttctcctgccatatatgcatgtatgtgattatccattaatctttgctatggtctcttgctgtatatgcatgtatgtgatggtgttgtgacagtagtagactaatagcttctctttactgtctagttgtgctattaattcataacactgtttgttatattaattgtgtgattttatgatgcttagatcctttgtttgatcattctgtattagtatcacccccttagtaattattcatgttcatcacggttataaaaagatggtgtttgcattactatggacactgttacacttaccaacttgattaataaaaacacttatttttcatcaccccgccatatttagatttattctccacctctatcacatcgaatgaatatcttcatgtcttcaccacctcttgatacacatacactaccactcatattgctagcaacaggagtgcaataattttcttttacacttctataatttctctggtatgtatgcttaaactacttgtatgcctaacttattcagattctttttaaatataggtatcatgagagcgagtctgatgcagaagaagacaatgatgtgtacttcaattatttggtaaacaagttcatcaatgttgctacaaatgtagtccaaccaaatcaatcggatgatgatagtgatggtgacttcgaggaggctcttcagcgtatttctaatgaatatgcagagagctctctgaaaaattataacaatgatgagaagaacaaaatatagtttagcttgtgttttttaggtaaaatgtgttcacttttttatttatgtttaatatttaaaaataattaaaacatatgcatcgataatttaaaatatttacatctttttttaccattcaatattcatatatgtggaattataaaaaaaaagttagaattgagtatataatctagacgagagcaaattatccacctacctaatgatttataataggactatgtttatattgtgctgcttttctagtatataatctgttgtttagtacttcctccatttcatattataagactttttagcattgtccatattcatatatgtgtgcctagattcattaatatctaaatgaatgtggacaatgctagaaagtcttataacctgaaacggatgtaatatttttttaactacttaagcccacatcaaaattatctattttgtttttttgtttgcaatatatcagattaaatacagtttaatcaaagctataatatttttcgctgaagtgtattgggactgtaacacatatgatatgataccacattgcatggtttgtctggaggggaaaaataatactggttagttctgaaaccttgagtccatagtatcttatagtgtgtatattttaattttattatagtattatattgctaacgaccacaacgtgacatctggtaatacaacaaagagattttcctccctaggaaggtagtgcaacaaaaggacaaatatatatagtataaagcacatatgtactaagaacatgcaggtgtgagaacaaagtcggtgttagtccaccctcaattttagataaaaatgccttacttttggatggagggagtattgtttgaatagaatacatagacatagattgacataaatttaataactatgtgtagcattttttttaaatgataaacatatttctcttatagagattattgtcgaaatacaactgcatcacatcgaagggcgtggttcactcagtgagttaatgaaataataaaagaaatatattaattggtaaaattttgttgggatcccccattacatggccctatgggcctatttatagtcttagtacgggctcataccctctagggtttagttagtacatgggaatttacatggatacccttatgatagggatattagtgtgggtacatagtgtcttttgtattcatgggctcttaggcggtctcgttgggccggcccattaatgatggccgaacctacgggccacaaggcctcccaggcctatggtcgaaggccccttctacccaggcgaaggcctcttgcttcgccttatggccttcgcccttagcggtgacttggccaagtggtgggcttgggggcggacccttcgttcttcgtcgttcggcttcgcccaaaacgcttcgccctggggttgtgagcctaggggcgaacccttcgatcttcatcgttcggcttcgccctatgactttgccccgggcacaccctctggacttagtcagtgtctagcggatttggtggtttcggcaggtccggtcgaaggcccttgtgacatacctccaacagagatctagaatatataacatgtgacaaatatattgaactaccataatatattttctaaatatactccttaataaataaataaataaatgttatttttcttttattattatatctcgtgaaacaaagtcataaatataaatacataatagtcttatataacaaacttatactttgccgttgcttgtagttcattagaccaagccaccataagatggggtcgtggcccatggttatgctgggcctaggcccacctaatgatcgaggtctcacataatggtgggccacaacccaccatatgcttgtttcttgttgtttatgatgtaataattaagcaggaatggtctcattagttcaacgtgctagaaatcacaaattatgtcatgtcggatccatgttgtcaagttgtcctgcgatgacaccggagcaggtggttctattgttttagtttgcctaatgatggttcagtgcgtcactaattcgtgacgacggaaaatcgttagagccatttgttggtatttttttttaagttgcacatggtaatttcagacggggcttctgcaacgacagtgtcatttcatcacaagattgtcaaagaatatggtttgtgacgagctttcgctatttattgatgaaagtgactcatcaagtaaggctagaccattgtagtgacttctagtaatatactccacgtctacaaattttcatatttctttcatgccaaaagacaaaatgtacctttttttagcaatttaacaatcaactaacgaagaagagattaaacccaaaattcaaagacacataaaggagtgtacaaaactcaaacacctagaaggtatactaacattttaggggcgtagaagtaattttctcttagcgaatataggagtaccaagaaacaatctaagtcaaattattagtatagtacgtgggtagtccctagcgtcgattgtttcttcaatctctattattataaaaactgaagatgttttttctggtactttagtatgttattcgtgtatgagtcagttcttaagttcgatcacttttgaaaatacaaatccgtatttattatataatgacttagaattttcatgtaaaacgatggatgaatgaaaaaaaattgcgaatatacctatttttttaataatttacgtttatataactacatgggatggatttaaaaaatacacccgtcctgcgggatgagaatgcgcgaccgctacggtcccgcaactccaaaacacgggacggtcggtcccgcgggacggtcacgccgcaccacgacggtcccgcagcttcaaaacatggaccgtcacggtcccacagctccaaaacacgccaccgcaatagacagcaaattaacattgtttgatctttaatccaattagatgtatgcattatatttattagggtgatctaaacgaaggggtaatattttttttattagattagtggttgttgtgccttatattttaggatacagggaatatctgaactcaacgcagataagatgatgagaagatgcatgattccaaggtgaagtccatttacaacgatttt

SEQ ID NO: 55820 - DNA, 3105 bp, Oryza sativa
  unsure (1)..(3105): unsure at all n locations
tacaggcttaatttacagcagccaggaccctccagcacaagacgatgcatcgtctggattctgaatgaccagccaacaacacctcaaggtccaccttgtaactcacataccgataccgtggtgttattgttggattctcaatttgccatatgcacacttttaattttacactccaaactagctgcattcattcatattcgtggtgattaattgatccaaatatacacgaacagctctgtgtatggagaattaactcgtcgttgagctgctagaagcagaatttctttttctgcaaaggcatatataaaagaacagaattagatggctctgctgctcttatctcaatagcaagaaaaagagtgtaagaaagctgtaacgtacacgaaacttgatcatatcttgcttgtcaatgtacgcaagcagctcgtcctgccgcatcagggcttcatagagagcctgctcatgaaaattgaagtacttcatcaccttctttttataaggtagtaatatttttacatatacctaaaccaatatagtttatgccaagctgccaattcactcagaatgaagctgaaaaaggtaccatcttgagcaaaacaagcctaccttctttgtagagattaactcggcttctaatgcatccacacggcggacggctgcattcagcaattcctccttttcaaatggcatctcggatggcttcgtttcgagcgcctgcaccttctcctccaactcgcctagtcgtcttaccatagatgagaggacatccttttcagtataagacggagcaggagacggtggccggaattcttccttgtactctgcttcttgaggatactccacataggagtgatcatggtcagtggattggcttgagaatcttttagccatcctgcttgggacagagcgaaccatagcaaaaaggctcacgatcaagacagtcagccatgtgataacttgtgtccagaggccatcaaatgtgataggcaaacttctcgagggtgatgaacctggcgtgaatcatgtgaaagttcaggttcaggttcagcaaaaagaaaagttcagcgaataattattcaacagtttagcgaatatttctcaatcggttcattcagtataacaataaaaatggtcaacaacgatttgagtattaatttcaactttgaacgagattatggataagagaaacaaccaaattaagaatgtaaaagagctgaggaagaaattgccatactagctctaggactgccccatccatcatccacaaccttgtcaacaacaggaatgctttcttcaataatggaaggggaagcagatgtaaatccatgtgctgccaattttgactgaaatagcaaaatgagattacctattagcaatagctacatagtcagaaatgctgcatcattacaagaatgctgcagtaacccaaagatccttccatggttccttggattaaggatagcctacttacagaagcttgtataacaatgtaatggtgtaatgtaatgaaatataaaaatccacatgttattcacaaaaaaaatgtttcaatttgatggtcaatgattttttagtccatgtggtgctattattcaatttttagtcagtgtagattatgcagttatgctgacaaatatcatatttgcacttctcctattttataaggtaaactgcaatatgatcacagtgatacagcatggcaacttgcctcctcatgaacaggggtcaaaaggggatttgttatcaggttccttgatgccataggtgacgcgccatcttccacttcagacccagactccgctgagccatcacttccttttctctgcattggcatgacaacataacaataaatttcaatagaatagtttgaacacaatgctcctaanaatctccacattaaccatgcttgtagacttactgttgggtattgtggcccagcataacgaattatttttccatcagtgcttgatatggtcacaatttgcctcccataatttgcttcgccattcaggaccctctggacaagccaaattcaaaatccatcatgttagatatatcaacaccaacgcaaagatagtgtgcatgtaataatacaccagcaagcatctattatttttctccctctttctattttcctttcagtaagcggtggactggtgatttggtttcaagatataacctttattatgttaggatccttccaaggacctttatctgattttttgcaacctccaaatgcctcgcacttgcattttccaccaaaaaactctggcaattcactgaatacatggagcggacagaaattaggatggaggatggcatgaacatgaaacatatatggacaagattgtagatactgacttctcatcaattatttcaagtaacttattttggtacttgcttcctagaaccttcaagagaaaaaaaaaatagaacatgaaagtcgttaactactaactatataacggtcaaaaatcttgattaagtatataacagattactcaataatcctacaataaaaaaaatatataattgacttacatgaatctttgaagcagttttaggatctaggaaagattttacagtgctccataacatcttgaagccttggccggcattaataatatacatgcggcgcaacgtctgtgagaggtttcaggatgcattaggcaattcagtgttgggacaacaagcaaaaggcatgcactatgccactactttggaaaataaggtacatgggggaatcacctacctctgggtagttgtcattgtcgatcttctgcagtcgtgtgattagatcccttgcagcttttgagaagttctttaaacccttgatattcatataatacaagtcaatcacagagtcataactatgtgctcagtgttaagagaaacatttggttatgaatacacataccacgccttgcacgtccagaatagtagtagatgaatctatgggcctttttgcagcaatcgagcaggcaggaaatctcatttggaagcatctctcaaactccttcacatgatatttcacatatcgctctatagtagttacttgcattagcttattcgcatcaacttttcctattaactctatgtagatag

SEQ ID NO: 55821 - DNA, 5105 bp, Oryza sativa
agagaaaggataaacaagtgtcatgatagaatggcatatttatattagatatgtttcttcaacgcaaccttttacctctatattgtcagccccaaattcctttctccatttaagcatatctgaccacatactctttgctttctcaacatcaaatttccgtgctttgaggaacctatatgtgaaggagataaaatgaaaatttcacacgaccagccaatcattttcttcagggtagcctcttaatgatttgctgctccaaagattgccactctagattttttccactcgatatctagctagcatgggggccttaggacccacaagacagacatcaagttgcaaatctagaattcacctcaatgaaatggcatatcctggatttcccaactataggtgatttatagtgaagccacatttccgggaaggaggcaaaacagatacacacagcctaaggccaaaagtaaaatatgagagaagccaagcttgtacctaagcattgtgtgataatcatcatgctgttgcggcaacaggtcctcatcaactaaacattgtcgaaatgcatcaacagcttgaagatcttgaacatcccttatgtcctcaatggaaccccgaggttcatttttctttttgcttcttctcctcagggaatgcctgaatttgttcccggcattaatcgcctttttcttgaaagaaccaattttagtcttcttctctccttcggagttgtctgcgtcagatctgatctctttcttttcatcattatgcgtaaaaccttcaaaacctgcaccagcaatagcatctcatgttatgacggtatgaactttttttcttaccggcaactgataggtggcttagccgcttagggagaatgacaaataatagagctttacagggaactaaacctagaacgtaaaattaacttagtttcagaaccaacagtaatgtgagtataggtgttcatttgaagattaagaagataaactttataaaaagaggacccatttgatcaattaatccagtgcctttgtgcaaggcaataccaacagcacatgaattattaaatggaatttaatgctttatacatgtgacatcaacatcaaaatgtgctgattctttgtgttggtttgtagctttcctttttgtggttattcttgaatgcataattagcttgaagcatcagcttccccgtaatttttttttttttgaaaaaacttgaagcataagctattatgccctctagtgagaccaacaaaaggaaaaaaaaatcgaagatgagcaagaaacttaaaaaacggagagtgaatggacttctgcatgatttttttttacaaacattcgattttgataggtaaccggtggtgttaactgaaaggggaaatccccaaatcctataaacagtgcaatcgcatactctcacgaactcttttgccatatcctccattaagaattgatccaagaattcaaatatgaatatatttgaatcgtacaataccacatacacaggtaatcacaagataacccactaatttaagcccaataaatcgattcatcctggtcttaaatgcaaagaaatactctatttcctagtaattcgtactcacatggcctggcaaatcgatcgagtggtcctgacatcccctcctccgattccaaaatcaatcgcccgagcaaaagctccaacctaaaaatccacaagaactatcatgccaagaaagggaaaaaggaactaatccatcatctccgaacgataaaattgcatggcaaaatacttttttaaaattgtttttttcctcaacgaagatatttgggaaaccgataagtattcaaacaaactatttggataatatctcgaatttcatttacctcggattttgggcgatgattttggaccaaaaagagagggaagctcctgctgctgccgctatgggctttaatggtgggaagctctcgcgagggagacgagacgagacgaaaaggattctatcactctcggtgcatggacccggtccatagactcgaagcggttgacctgtgccgcgcgcacgtgctgggttcatggacccggtgcacgggtccatcgatagccgcccctgggtacgattgcctgggcccaccttgcgtgcgttaccagccgtcgattcgagcgattatagtagcttttatgggagaaacggacggctgtgatgggttctggttcatggaccgtgtccagggagatgtgttggtttatgtgacgcgtggaggggtttggctggccaggtcagactttggttggttagaggagttgggcaactcctcctccactccttttttatgctaagacaaaaattgatggatcaacaagattattagttggaggaaatgtctaagcacaactgattggataaaataactttattttattattgtttggtactcatggtttaaagctgcttaaatgcttagagatgtacttgctcagagatgttcaatcttcaacacacttacgatttctttctaagaatgttgaagggatgtcttttcgtctaaattttttagcttaaatgtttaaaattataaaaatgtgaactaaggctacgttgttaccaggagttaccaactccccctttctttttccgcgcgcacgtttttcaaactattaaacagtgtatcttttgcaaaaaaaatttctatacaaaagttgtttaaaaaaattatattgatctatttttaacaaatagctaatacttaattaatcacatgctaatgaacagctccgttttccgtgcgcagcagctgtgttgggaatgtggagtaatgagcgcagcctaattctgctggatatatatagtactagtttaccctaatttagtggccctcctcctcatgaacaaaacaaagtgtgtttgattgactatgttagtcacctaggatagatacttggttggcagtttgttcatagattgtttcaccctggtaattttgtcatgcatcaaaccaggcacaacagtcttgaaccctaaatggacacaagctggaccattccattaaattttaccagctaaaacccctgttataataccaggagctaattcttgttgagctgaacactacttaattagcactgtaaatgctactcaaccagaaggtacactaattagtagcctctgattcttctatccagaaaagaacaagaagctagggtccaagaatctattcaagcactcacagggtctcacactatccttgaaaaaataaatttatgtttgcaacttttgcatcaattaacacagtgacaaaacaaaatgggcaggcaggccaatgaagtgggcatcatcatcaaggacactttttgtccgtgtctatcccttgatttgttgttacattgatatactttgtctatgtttattagcttatgcttagttgttacactgattgcaatcatatccgtgaactgcggttaagctttttggatttcatcacaaggggaacagggtcgttaggccaaaaaaaaaaaattaaagcgagtctctggtgttagatgatcaaaaagtccaaagcacacgagtatagaaagaaacatatgctttattagataggagagtgtttcgtgagttcaatgaccaagcaagacatatatatgccttgtgatatatcacctaatctggcagacttatgtatgtgtttaaaaactttagaataataataatataaaacgtggaaaaggggtggaaacatagggaaatattagataatgaaatatcaaactctcatataaaatatcttgagtagtctcattgtttttttcctaatgatggagacataaacgacaaaactaatgttccaatcttcttcaatgtgatgtacatatggcaattttatttgctctatcacatccaaccagtcaacctgtttgatccacgcaatggtacaataatggaggaaatatgctacaatgacaagtcatctcttgatagcataatagaatatattcacacgtctgtcattaaccagccaaatccattgctaattgtcattaacaaagtgacacataattatataaacacgatggattccacactatcattttcaaatgtaaaagaataatccgctgtctgtcttatggcccattgcaaatacacaagcaagaagaccaggaatttttcaatgatgggtaggcaatactcaccgactcacacctgcatttgttcgccataaatatttgtagtgggattacatacatactccacttcgaaaatggaactagtataagaaaatggcctcatcagagaacagtataatttcttattaaacattctgtttactcttgattcagttaggttgtccctgttcgagcagttgctgaatctttctttgctgaagtgcaaatgtaaatgcctgatactgacaggagtgacatgggtactgcttctgaccttgcaatctcagggatgggagtgggtcagcaaaaaagccctgtaactgaggacagatgactattcccctggttcactttaatcaggtgaatgataattcagacatgtggtagtatagattgatgcttggcaaagcttgcaccatgtgttgaactttgccattgaaaatgctactactattcaccattcagcaacagtctcgtcgtttacatgccccatcatggcctgtgctattttcattctaaaataaacaaacttagggcctgtttagattgtagccaaaataaaccaaaaatttggtaagatgataatattgtcaaaattttggcaggatttcttatgcattgaccaaatttgacaacaaactaaatgtaaatattttttttgacaactttactaaaaaatgatatatttgaaaatggcattaaagtgaacatacacttaatatacgacataacatatcctatctcctgttcaaattcgtatctaggatgtattatatttcgtattagatttgtttattttgaagaaagtgagtatgaacatgcaacagtccatggacagatgtgcagcgatctttatctgatgatgtgagttctctgcattcaggcgttgatccctgaatatgcatatgcatcagaagcttgatcgaccacctacagaattataaccataataacggaagcaaat

SEQ ID NO: 55822 - DNA, 1618 bp, Oryza sativa
aaaactggagttccgattgttttcttaatgaaagtaaaaactaacgtaaaacacgaggaagtcgaatactagtagatatatagtgaaactaacacaaatatacggtagctagttaacaaccgactcgtatcgtattcttcattatctttaatttcatgtacttataattacttatgtcgtatatatacccgtttagtcgtatatatatagggaaaactattttaattcctcgagggaatgtttcctcgtttgctaaaaaaccatcttaacggttatgaaaaattctagaaaaatttgacaacattcatacaacatatatatacaactccacaaaatcttaaatccaaactcaactcacacgtcgagatataaaaaagacaaattcagcgtatgaatagtaatgtactgtttatatctaaatttgtcttttttttctcgatgtgtagattgaatttgaacacaaattttggtggactagtatgtatcattatactctacattgtcgatttttttaaagaaattttcataactatttgcatcgaatttggaagaaaaaggtatacgaggggatatccctcgagggattagaatccactcccgtatatatagttttatgtgttgagttactagtgtatttatttatttatttattcacgaatagctgatctctcttgtgaggccggtatgcacaagccgtcgtcgtcgtcgtcatcacctacagaaaaggatgcggccgtcgccgacttcacctgcggtaaccacgagcacacggtaaaaaaaaaacagcgacgctatttcctttcttcttttgttcttgtcgcggtggcgcgcgccggccagcaggagggttggcgttggggtgggggcggtgtttggctccgacaccggcggcgaggaatgcggcggccggcgttccgatgggaaccgagagtggagaggttgagaggggaaggggcaaaccagccctagttccgcgcccccgatggagaggagggtggcgttccggtggggcggagaggcgctgttggctccggcggcggcggcggcgttccgatcggtggggacgacgacgatggattgtgggggtaatcccaatcgaattactggtactagaaaattattccatcgaccgtggtactggccctgttcttgcgacccctgctgatatctcaggagcagcgaccgatatatcccacaaagatcaggattcaggaagactgccttcctctcatctccacaggtatccaaagcatacctctgtcccctcttctcttgccatcagatgaactaggataagaagagtagattaataagagggatagtgatttgattggtctaatagggaaaacaaagagtatgatttcttctcctccttgcaatttacactccctgcgtgatatggtgcttagaccaaaaatgcatgcatctcgcactcagtcatcctaattcaattaatcaagaggttttcaaaaataaataaagttaatgatttctttatatttgtggcaatgtatgttcctcccgatcacagttggtctttttggctcagagatttgtgccctggtaatgcactcgtgcagaattggttggcattgaaccattagtgctcctctgtgtt

SEQ ID NO: 55823 - DNA, 19012 bp, Oryza sativa
ttttgcattggaaaaattagactgtcttttgccttattttgtgtcaaatgttacctagaatgttttgcgagtaatgatgttgctgggggctaattctccttatctttcttttttgcacctctagagtgaatatagttttactaagtatggattattacaacttttgcatttgtttttatatctaacgctttaaacttttgtttaaatcaggcaatctgagagctgggcaacacatggatcagacaaagaaaaggaagatgaagaagtggtgcaggctaaaaatgaagaagtggattccttcatcgctgcagcagaaaaaacaggtccaccacagcagaatatcgactgcacagcagctgcacgacgtcaggctaataactatgcaaaagttgctttggagcactacaacaaggatgaaaacaacaaggtaaagttctgctaatgctttttttaagttctgcaatacgcattatataatccctatactggttttagatggtgtatacatgcttttcatttaactttatactgaaatgtcttaattgtttcatcaactattttatttatttatatcttttttttgtctgcaatgtattagattcaatacaggttcatcaaggccctgaaaagttgcgctatccaaaccaacgaatcctatgggcatgtgaactttgtagcatcttcatcagattcaaaagaagagttcttttttgctgaagtttgttatgatcccaagagcaatggattggtaccaacatgcatggtatctttggaagaaaacaacagaattggttagtcctgcaacattgccactagctagttttagccgttcttttaccgaagtatttcttttttcaatcctaattacctatgtcattacaacaggaggacttcttggtgttggatttgtagggtgcccagatcttctgaatcctcctgtcgacaacgatcactgctatgcttgtgacgataggcttaagcacccaaaagatggaactctgtttaagggtgggcatgtagccgccacgggtttctatacgtcctactgagtttgtaacagacaaaaaaaaacttagttatctatcctgtgctatattttctagttgtcaattgactttttgtttatctctatttaagcacacttttagcaaacatcaccaatcaaactgtacaatctcaattgcactatcatattttaagttgtagctatctcaagagagcttaagattttttttcagtggttaacattttcatataggtaagggaaaaaaaggctagggaaagtagcgaacgaagcagctgctggacgtctttaagcttttttacataaaaattgttattgacattaattacttaaataactctgaataggcactggaattaattggaattaatttgatagcagctgtgacattgaagaagttgattggggaattttttttagaaaaataattattttagtgaaaaatacaaaaataaaagctgatcggctaaattgcaagtttaatactctgtcgaacaaccacagttcaacagatacttgtcgaactagagcatagcagggggcctatggaacaatgtttgatagcatgcagagttcgataggtccttcatgcacagtgctgcacaatagtgtacagtgtgcatagtgattgttctcttttttttattatgttttatcccatatcgaacaaccacagttcgacagggtatcgacaggggataaaaaataccatgtcaaactacagttgttcgatatgtaccctgttgaattttggctgttatatggttatatggtgtactaaacttgcaattttagtctatcaacctctatttttacaattctctattaaaataatattatttttaaaaaattcgttgattgggtggattttgcaatccctaagggtgctgtgcgtggccctttcctttcctttgtccatttgcagctttgtctctttgctattccctccgtcccaaaaaaaaaaagacaaatcctggtttccatgcccaatgtttgaccgtccgtcttgtttgaaaaaattatgaaaaaaaataaaaagacaagtcacgcataaaatattaatcatgttttatcatctaacaacaatgaaaatacgaattataaaaaaatttcatataagacagacagttaaaattggacacggaaaccagggtttgcctttttttttttgggacggagggagtacctcctactctcctattaacacctctattcaagacaatgcgtttgattgatgcagtccatatttttcaaagcgataggtaaatactaattatttatatgtagtaccaaggggtgagtggtgacaagaaagagttaaaatttcagaagagaataaatgctaatcttaactatatttggttggtgtaacgccccgatttctgcgtggcgttaaaagctaatttacaaaaaaccctaattgcgaaaattttgattccttgagtgctgagtctaagttgtgccaaagatctcaatttgaatccctcctttagtccatcttcctgctatcaaaaatcgtctccttaaatttccatcccaatgtaatctcgaagctcgattccttctattcagaattccctcctaaaaccccatccgtgaacttcgtcgaatgctcaaaccctaactcagtccaatgattcacctctgcatcctaaactctcccttgggttccttcaaaaaacaattctcaaattcgaattcaacctcgattcatctacctcctcctccttatatgtctgtctacctaccctaagtttctttccgattaatcaatctcaactcctatatttataatatctccctacctatcgctcaatcaccctttgaaatcatctccgagtatttgttccaaatcccaaggtatagatctatcctcgggataatacccgttccaaataatctcgtatgaacctttctattcatatttctcttcaaaatccttacctgcatatctcgtcgagtagtcaaactcaaactcccaagttacactctcttcctctaaattatccatctccctttaactcgtctccgaatattgtttccttcctttgactcctccctattctcccgagtccgagtatcaacttcgacattaaaacctagactccaactctaaacctctccaattaaacctctctgtgaaagtctaatttacccgcccatggtggtggattcccttctttcatttcctcccaggtccacctcttcctgctcttccggcccatatctctctccctctaaagtctagacctatcaaatctacctatttatttcgtccctctctctacattgatctacctagcgatctatctatctatctatctatctatctatctatcgatcgatccttttatctatctactatacctacctatatgtttatctatccatccgtcaatccatctgtctatccgtccctctacctatcgacctatctctctgtccacctatctatcaatctagcttatccatcgatctgcccgtctgcatatctatcgttgaactctttcccaaacaattgtcccaactccaagaatacgaggttccttttgaatccctctaaaataactcttgagccgcctaatacagatatattccagaaatatataattcccgcctttgaagcctttcctcgacccctccatatttttccgagttcaaaacatccgatttgaattcaaatcccaactcaaattctcaaaatactccttaaagaaatttcctggagaaagtctactcgccccccttgcggttttgggctgatttctccctccccagcccaacactcccttcggctcacaccctccacgtgcgccgcacgtgatacgcaccgaggacaccgccccctttcttctctctcgcgcacgcgtgcctccccgtctcgctctccgctcgccgcttttgatttccgccgcccgtcggcgatttgaatttcgtcaccgccattgccgctcccgcgcgcggcgccgctcatggccgaccgctgtggccgcgccaccgtcacccctgccgcgtcgaccgccttggtccgcgctcgccgccaaaccagccctcctcccttttcgctgtcatccgctgcgtcaccatggccccgcctccgcatgccacaagccgccaacgcggcgacgccaatcccacgcgcctccccagcctcgccgcccaaaaacggaaggagcaaggctccctttcctcctcctcctttcgctttttcccttgcgggcaaggccgcctcgctctctcccttgtcctggtgcgggagcggacacagggtgccgctgacgccgcctttgcgccctgtcgcgcccacgccaccaccgcgaccatgccagctcgccgcccccaccttgaccgcgctagcccgcgctcgcggtccgattcccaccgcacgatccaccgccttcgctgcccaatgcatccacgccgtcgccgctttcgcaccgcccacgaaaccgccgctgtcgccagccgagcgcctcttcgcctataaaatcccaaccccatgcccacaatcctttcccccttcaccccgtgctccttggaacggagtactgccgcctcctccctcgaccccggtcgccgtcgcgcggccaacccagagcaccgccgcctccttcgtcgtcacggccaagaacgccaccgccgcgaccaaggacgccgttcccgcacgcctccgtccccttccccggcgcgcccgcggcggcaccatgccacctcggcgtcgtgttcgtcgccgtgcgccgctgctcgtccatgcgccgccatcggccttcctccccttcccatcaccgaagtccggcgacgccgttccccgctcgacggtgagctcctcggctcctccctccccttggcaccccctttccttttccgcatcgtgtagctctcgccaccgccgcttggcgctgctcgcgcgagcagccgcggcgagcttcgtcgatgccgcacccggctgtgcgccgccgtcggtctccctctcttcgaacccgctcgccatcaccttcctcggggccccctcgacctccccaatccattcccctggccgccgacctccccttttgctctcgcgccgtgccgcccgactggcagccgcagcgcatggatgtgcgccgccgtcggccatcccctcgccgtatcctctcgcctccgccctcctggagcccccttggcccttcccagaccgccggcctccccaatcgctcccgcgccgtgccgccccttccgccgccgcatagcgccgccgcgcgcgcgtcgccggcgaccattgggttctgcgccacggcgtgtgcgtcgcaatacctttccacgtcagccgagcccgagcccgcgcgcccttcgctttcctcgcgcgcgaccacgtcggacatccggcgagcttcgcctccgccgccggccgccgtcgtacctcctctctcaaatccaaaccgttgaattcattccccttgtcctcctctcgccgccagtgctagccacttcctctggctcgccgccgttcgccggagcgcgccgagcgtcgccggccatccgatgaggttccggccccccctctctccccatccgacgtggctgcccacgtgggcgttgaccgggcccgcccctgcccagtcagccgtctccccctctctcctccccgctcttggtccaggcccatcggccaacccccctcctcggccaaaaggaacaaagtccactcttactccctccgtccgagcccagtgaacacactcttgaatcaaagttcatatttcgtccctccaccaaatcagctcccttacacaaaagtccacctatctcccttgttggctccacacgtcaatgagtgactaaacagaatattctcgggaatattcttttccataagttcaaaaaaatcatttccccttgctccataaatcatttcctatattccaaattccataaatcctttctcttaatcccaggatttcaataattcattcccttggtcccgcatgtcaagtgattgtcaataatattcttgagaatattatttctataaatttcataaatcaatttcccttgttccacaaatatttcccttaattcaaataaacttccaaaattcatatctcgcgatccgtaactccgtttgactccgttccacttccaataattccgtaaaattgtgatctatctaatggcactattaattagcctaaataggatcttttatttggtcttttgtttaggttttcattgtttgtgcctagttgcggttgcggattttcgtcgatcagggatttctcgaagattcgtgaagatcaagaccctgagcaaggcaagccacctttgaacatcttgagcctataattgaacttaattatattacttgcaaaatattatgcattgataggattgcacataatatgtttgccccgtctgcgaggcatattagtgggcatacctaacttgttgcatttgatccttccgttgttaaattgttatgtcatgtttccttgtaaccacctggtcgcgcctcagtattcttgcactcggtgcgagtatcgacggtcgccgtcaaacttaaaatatggtaaacatcttgggtaaaacttggtttacaaaacgattggaaaaccagacgcctgggtcggtgccttgtgaaagaaaatgagctttaaaaataaaactcgtgacacaaggccattcctaggcgggatgcttgtgcggtcgcatttaaggaccgattccttcggaattatatccaagcatatgatagtgcaaccacatgggtggaatgggacacccctggctgagtaattagctaatcaggggagccttgatgctgagagacaagtggattcgccggggtggtgtcggggaggacccctgggcttcctggcacagtatggtctgggacctaacctgttgttggtctgggacccctctcgtcagcatatggtaaacctgtgtcggctttggaaatgccttgtcatgaaagcttggaggtctcccgacgtggctgatccccacgagctgggtgatccgggttagtaatgtcgtgtgggtaaagtgtaccccctctgcagaggttaacaaactgttcgaacagccgtgcccacggtcatgagcggatgtgaggtgattccttagcgtagttttcatttttaccctgttttatgaaaaagtgatgaggtttgggaaacccgatatttggaaggcaagtggctgtcagggagacagcggaacagggagtccctaaaagtgactggttgtttggagacaaccaaaactctgaaagtctggaaaaattggtttggtttgggaaaccagctttgaggccaactctgggagttgtgcaaatcttgataaaataatattgttcactcctcacccccggccgagctgagacttgtctcgctctggtcgcggaatgcacacacttagattgtcaaaatgcttgcaaataaaactgattgaaaaataacagccttcccttgaagcttgcattaaccacctaagttcccttggcttgctgagtacgtaagtactcacccttgctctctatatatacatagttctgccagctctgaagatgaagttgaagcaaagattagggtttcgtcctagttcccagccttcgcctgtggtgttgggtgttagaccgttggttccgctgctgctgctgttgttggtgtttcctcgtccgcgtcgtcggttgcattctctggctgttctgagctgcaacctaagttaagataaataagtactctatttaatttaaggattgcaatgattcatatttgtcactgttggtaccagcgctatgtcctgggactggtactgagatcgcggtttcgtaggaagcggttcacgccgtttttcttacgacacgctgctgtcaggcgccgttgtacgacggtaccggattggggtgtgacagttggcatggctcgtaactcttgaagatttcattagctttcgtctacattttttttgttctgaacaggcactatcatatggtgcatcatgagccgaaactccatcaacagttctctgcaactgtttttttttttgaactggcaactgtttgatttactacaatagtgaagcgtttgatgacatagccgcagtaacaaataatgtttctatccagtttactgaacacatgacattaacatcacaattcatacaacaaaaataaacaatagtactccaacctcagttctggccatctgttcctacttcctatccgcagcacgtccacataacagaattggcccaacataggacggagatggcaatggggacctctaacccgtgactcgacgggtttttactctattagaagctaattgtgttctaactcttatacccatgggtctactaatgggcaaaactcttacccattgggtacgcgggtatggatctattctttacccacccatacccaccaacccgtgagtgaaaaaacccgttgattgagcctaaaactataagcaatataagtctcaacgactactaaatcagtatgaaactcctttcacatcttaagcattgttacattctagttatatgaaattattattcgatttcttgattatgtaatgtggttgtataatttttttacttgcctttaaacgctaatgttaatagattgttgctagagaaaatattgatggtttacaactctaatatggctaattatagtacaaaactataaatgctacaagttaactatatgggtatgggtacccgttggatacccgttacccgcacgggtgtgggtatggggcaagggaacccgattggtatgcactcgttgccatcgatgggctcgaggcggagcgagagagcgacccatcttcaaggtcaatggagaagcgcgaaagcgagtagcagcgggagttgtaacaatcggtgtggatgaattaggccctgtttagttcccaaaaactttttctcaaaaacatcaaatcgaatctttggatatatgcatggagtattaaatatagataaatttaaaaactaattatacagttaggggggaaatcgcgagatgaatctttcgagcctaattagtcattagccataagtgttacagtaacccacatgtgctaatgatagattaattaggctcaaaagatttgtctcgtggttttcaggcgagttatcaaattagttttttcatttcgtatccgaaaaccccttccaacatccggtcaaacatccgatgtgacacccaaaaatttccttttcgcgaactaactaggcccttaatataacatggattgaattatatttgctgaaaatattattattcgattgatatttgaatttacattcaaatggatattagggtgatcatatttaagggaaacactcatgtttgtagattataaaatatacccaaattttacttctactacaaaaatttactactactactagtcaacttgcatgcaacattaaagaaactggacttggacgagagtcagtcaataatatatctagctaactgaatcagactgatcgcataataaagccactagcaaggctatgtttagattttaacttttttttcttcaaactttcaacttttccaccacatcaaatatttagacatatgcatggagcattaaatgtagaagaaaaaaaaccaaatgtacagtttgcatgtaaattgcgagacgaatcttttgagtctaattacgtcatgattaatcataagtgctacagtaacccatatttgctaataacagattaattaggttcaaaagattcgtctcgtagtttacggtccaaatctataatttattttgctattagtctacgtttaatactttaaatgtgtgtccgtatacgttaaaaaaatttttagctctgaactaaacacggcctaacacgacaacctatgtgaatcccattaagatggatcatggatgcaagaagacttcgccgagtcataaagaataccctatccgtttccatattaattgacgttttagataaggttgaggttaaacttttataactttaaccatcaataactttaaaaatatttagtttaaaggaactagaacaacatgcatttatttattatatatatattataataaaaaaaaagatcacagatgcatcttgtataccgtgtcattgtccaaaacgtcaattaaaatggaaccggagggaatatggtcattgtatctagtgcgcataccacttgtttgtctttttcttttttttttttgaaagaaattaaaggcaagaagataccacttgttagtcataatgaggacctctacttgattgataatgaggacttcactgcgtcataaacaatgataatcaatgtacgtatgaatctgatttagtcccttcgattgcatagaggaattcaccacatgcacaaatcaaattaaatcaatgcatacggtttaaagaaacactgccacaaaatgaaatcaatataggaaatacttttaagactgcggtgtagcgtagatggcatggtgcagcactgcagccatacgttgtgctcttcgcgacctgcgttcaaatctggctgaacgtactcaccctctttcttaataaattcaacattgggtcttttccagtataatttttttttgttattttacgcacagaaaataaaaacaaaaagaagcgggcacacgcatttgtactttgtagagcatttggttagcacactgacactcctgtttgctctcctctagctacttcctcaatgccttactcaacggaaaggacaactcaattatcttagctaagtcatgggtggtatctgtgcacagatgtagctgtgcagtagcaatagccagtgcaaggatctgagaccttgggtccctttgcttgtactaataatgaagaggacttcacttggtcataaaaaatgatgggcgaggacagcctcaacctgtaaatcatactatatactccaacctgtatatcacctacagagggtgaagcgagtcagtgtgagcaagcagagaagagttttctaaaggaaggagatgggatcttcaagtgttgtgctatggtgggaagagtggcagctccgtatcctcgtcctcggcagcctcttcctgcagtgcttccttgcatttgctgcagttcaccgtaggcgctccatcccagcatccttgagattctttatttggttagcttaccttggaagcgatgctctagcgatatacgctctcgccacactattcaaccggcacaagaccgataatcaaggcggcagccatgtcctcgccaccctggtcagccctcaggggaagggcggtggcgatgacactggccttgaagtcttctgggctcctgtcctacttctccacctcgctggcccggactccatcacttcctacaacatcgaggacaatgagctatggaggaggcatgtcctgactgtgatttcccaggtgacagtatccctctatgtgttttgcaagtcttggtcgggtgagaacaagcttcttagagcagctgttctgttgttcattgctggaaccctcaaatgcattgataagccaatggctctcaagagcgctagcatatatggcctagtaacctcatctcctttccatgaccaaaagtcacaaaataatgaccaaggcgagaatagatcacttgaagcctacatacaagaagccaagggttatttttccaacctaaagatcaatgatgtttatactgagttggtagcagctgcccaaaacaaagacctacgggttatgccgttttggttattcgtagacctcgcatctaccttgtgtcatcgtcttagagtcttgcgtttcttcttggttcttgacaacaagagcgcggattcactgctacagacggcactgtgtggttcctttgttcgtctttacacaaagaaaagcatgctcctcagttatttttgggcaaaagataaaaggaatgctctcatatctacttattcccacctgaacaggctcttagcagtatgcctgactatttcagctgtcgcactattccaccagagccataaacaaggctacaataatagtgatgtcaaggtgacatataccttgctatggtgtaccgctgctctagaggtgtacgcacttttcggtcccaagtacaaatttttcacctggtgtaagaatgttgcccaatacaatctcgtaggattcttcgcccgggaccaaacgcccaccaggttgctcaagttggccagttgtttttggtgcaaggactatgtggaccagcactggtatgtcaaccaatgctcatcgtctttcgccatcacagagcttgtaattgaacaggttaaagccggatggaagaactacatagaagatacctccacctactggatgttcaacgatcgcagaggccaactaaccattcagcatgagctttgcgatgaagagctgtgcaagagcttagatgtgccattcgatgagagtatcattgtttggcacattgcaactgacatatgcttctatgagggtgcccctgcagctaatcatcatcatctcaaggctgccactcgatgcagagagatctccaactacatgttgtacctgttggtggttaacccggatatactaatgtcgggcaccagagcgaacatcctctccaatacatgcaaggagcttcgtagcatgtttgaggatgagaagccaccgtctgatgaaagtgaccttacaagggagatacacagaagggcccaaagctcgaatgtcgacgctgctgcaaccgaagaactgattccccgtgcatccaagcttgcgagccagttgttggccatggatggcgacaagaggtggaaggtgatgcaaggtgtgtgggtggagatgttgtgcttctccgcgagcagatgcagagggtacttgcacgccaagagcttaggccagggaggggagtacctctcctacgtgtggctcctcttgtggtacatgggcttggagagcgtggcagagaggcagcagagatcagatttcaggagtcacgtagaaagagtagccagcagacaactaccgtgtaccgaaactgagagctctcaggaaccgagattcaagaggaggaaggagcagttgtgccattgtttcaggagggaaacataggtgtggccgttagatcaaatgttgaagatgaggaagcaggagcagtcacattggaaattcaagatgatgaagaaacggcgacgactacacatgcttccaaagcaactgtcccgggggacaacaatgtctgaaattcgtgtggtttgtctttagtttgttgcatctccttgtttttatttttcaattgtcatgtttgttggtgttagtgttgttgctggactcttttatgttgttgctactaatacttctctagctttgtagccttataataataataataaaagactgtgtgtctgatgatcattgctacagtaagtgacctttactgttatttccaacttttcaccacaattgtgtgcatattagttgttgatataaatgtccacgctttttgtcattaaactcaacgaattgttctggggtgctatgaatgcaagctattcttgagtacctcaacctccggaccatcctgagatctttgaagcaacccactgatcaaccggattctctttcttgaaagtgggaaccatcgggggagtacacttcctggtcggcttaccaggtgctatatctggggagaatcccattccaaccaacgccaatttgatattccttggctcctccacgttgtcgctacttcgtttgggtgaccgttctgaacgggtgttgagcggccgaccgtttacgcgctcgagggttgccgcaccctgatcgttgtgtcctctgttatcagcatgagaagtcgatcacattttggtcatgtgtccggaatcccggcaactctagtggctcgtgctcacaacaaacggatagcccggttgcctgccaatgaatgaagactcctttcacctgtggatttgcaatagtcggaagaagattgataaagcccactgatgaggtttcaacaccattgcaactcttgtagtgtggacgatcgatctagaaggaaagaaataatcgggtcttcagtcaacaacagaaatctttgtccaaggtgacgtaggcgatagctgctgacgcagcactttggcgcttggccaatgcggtggcaccggcgataggattgtaactgcctagagcccatggtcgccaaatgcttttgtgagaataggctttggttgcttaggctgtgttcggcagccttggttgggaacccatgtcccgcgcacggaaaatagagtggtccattagcacataattaattaattattagctgtttttttaaaaaatggatcaatacgatttttttaagcaacttttgtatagaaactttttttttaaaaaaacacaccgtttaataatttgaaaaaacgtgcacgcgaaaacgagagggggagttgggaacctgggcaacgaacaaagccttagtcgttcctgtttcatgtctccttcctcttatttttcctttgaattaccttgtaattaaccttcatttcttttaatacatattccttgcgtactcccaaaatctttatgtgctctcacaaattgagaaatacaattttgaccaatctcgcccagacaagttctggtgagttaagtgtctgttggtctgacactaattgttcgtgagctcggaaccggcgtgtgttatgttttcattttctggatatagggaaaaaaattgcaaggcccagaaaactcagaacaggatcccgtgccttttccaagggacatggactatggtgaaaatctgacaaaaatcacgtgataattagttcaacaccatacctacggctgtgttcctagaacagtgcaagcacccactatgaggtaccacagggtgacccgtaggatgaagagttgcaaagacattttctccactgtgcaagcaccgataatgggacccacagatactactttaccaaatcccctcgtcagagcagcatcctccctcctcacattacgccctcacctcccccaactccactagctctccccttgcccctccgccggcgccggcgcccctcctccctccgccggcgccggctcgacgatgccgcctctcccctcccggccctgggcggcgagttgacgagctccccggccgccgcgccgtttctccctcctccccatccgtcggcgcacgatgcagaggagcgtggtggcctcggggacgagcggcggcggcggtctcggggccgagcggcggagctggcggcggcctcgggaacgagcggcggagcttggcgtcgaccttgatttgtgttaccgcgatttgtgttggcgatttttccaaatcccctcggagccgagcggcgagcggcgattttgttgccgcaattttggtgggcgtgttccttgatttgttgccgcgattttggtgggcgattttggggaaaacccttcaatgggcagcgcgagggcacgagcgggcggaggcgcggggcaacgcgctccacaacgtagaaaagctgtcaattcctcgcctggcatgggcctgcggcagggaggaatcgtgcttccctccgtgggagagaacgtctctgctggggcgcggaacctagcgccacgcaaagctcgattccgacgtggcgccccatagcgtcggtccacggtgttgcactgtgaagggccttaccccatgtttcataacctatctctctcgttttccgcgcacacgcttttcaaactgctaaataatacgtttttttaaaaagtttttatgcgaaagttgcttaaaaaaatcatatcgatccttttttaaacaatagctaagttaattaattacgtactaatgaaccgttcccttttcggtgcgcactgttttcgattgggaacacgctagaacacaaccctaacgtcatatactaatactcgtattctttgttagagagttttttttattattttaatggtgaggagtcgtactcgtactcgtattcggatcttgagttatttatcacgaacgtatagctagtacgcacgcacctgcggacctgcctcttgtgaaggccgtagagaaaccacaggaaccgggaggatcgccgccgcctacagacaggatgccgtcgtcgtcttctacgcctgcagtaacgataacgacgagggaaaggtaaactaaaagcaacgtatctccgttttaaaatccttgtgtttctcgttttatctcaagtcaaaatatttatatctttaatcattaattttgaaaaaattatatagtttaaaaccacataatttatgttttttagattcatcatgagaaacacatccataacacgtaattcacaagttgttaaactacataaattttaaaaacttgatgatcagagatagaagtactaagttcatggaaaaactagagcgtcaagtaatttgagaaacgaagcgattatttatttggttggctccgtcaaagtcgaaccagcagtgttataccaaattgttatggttatggataccacatacctaatagtagttgactaaacttagcagggtccaccacatactgtcttatacgaaaacaaacctcgtatacagaaagagtttcggataagaaaggacgaatagagttctatatggaaacaacaaggactactcgtattgtatctatattggtctccataggataagaaaggacgaatagagttctatatggaaacaacaaggactactcggattgtatccatattggtcttcctagttctatatggagaaggggacatctatgggtataaatacaagcccccctaggaggagaagggacaagtcacaagacataacacacacacaagccaacacacgccgccggatatcaacatcagaaataagcctagacataacccatccggtgcctacgtaggttatcccaaatattgtatttgcgtgatccagatgaataaagagcaacacctgcctacgtaggttatcccaaatattgtatttgtgtgatccagatgaataaagagcaacaccggctttggccaacaggatatatggctattacctatcagataagataaggggcccgaacctgtataaaaatcctcgtcttcatctcttttacctcaatcacgcatatactctggtaccaacgatccccataccatccaaataccgtagtcgcgatcccaaccgtcgacacaaatgatataaaatttatcaataaatataaatacaagtaatttaaagtattaccctaacaatcgtccctttttaaactttttttcttatctcaaacaacccctcctacttcaattcatcccttatttaatactccctccatcccttatttacgttctaaatctctactattataaaaattaaagacgtttctgccgttactttagtacgtcatctatgtatgagtcggtttttaagtttgtttatttttggaaatacatatctatatttgagactgtttttaaagttcattcgcttttagaaatacagaagaagtgaaatacagaaggagtcgtataagaaatctttctaaaaaaaactcgcatgctaacttgagacgaatggactcttatatatagctcatgattttataaaaaaatatatatccaagcaaattcccacagtaaattttaccttaactaaacaataaacaataataagattaaaatagtatccatctgttgtaacacatgggcattttttctagtataaaaaaatactccataagcaagggcttgtttgaatgaggtttttagctatgtgccattaaaaaagatgacccctgcctctatgccactaaaaagttctagcctcccagaatgccatcgtcgagctttatcgcgccctacacacccttccgtccgtttttggtcctaacggtgtcaaatggtgcagcgaaatgactattttgcccttagggtgaataggccattttaacatggtagtttccttgtgtgccattcggacggcacccacaggcctatttttttggcgccaaagacagggctggttggcgccaaaggcaaggcccttctccttctatatataactcttcccaatccatctccatctcattgtcctctcttcttctcctatcttcttctcacctctcttcttatgaagccatgtcccaagcatccaacagctatggtggtagggtgaagcgggtgctttgccccaactgcggtgtgcttgcaaaccggttcatgtcaacaacagagaagaacaacaaccgtgtctttcacaagtgcccttattttgcagtttgtgcttcattctttgctgacatcttgtattttggttgtttttttttgctctttgctcacaaaaaaataatggtctggctttcagattgggggatgtcagtattatcagtgggaggatgagatggtggacagtgcagtgcaggcacttcatgcccttgcttcaatgcatgctgttcccatacaggcagtggcaccacctggtgcttttcctactacactgactagaggcaatgctcaagtggttgcagcagattaagtggcttgaaaagctggtctatgtttgcatttttcttgctatgtatgctattttcaagaagtaggtggctcagtagtcatggatggatgtatggatgcatgaatgaatgaatgaatgaatcaatgaatcaatgaatgaatttgcaatgatagtgtaattgcccagaatgtaagaaaatatcataattagctgtttcatcacatgacagcaccaaatgtgacagcaccaaatgtcagcaacagacattacatagaaactacttaagtggtggtttgcaatgttacagaccaaaagaacagaacaaaagatgtttgacatcacagaacaaaagatgacagaagtttttcgccatcacagaacaaaagagcccacagaatgttcagaatgctttactgcagctggagcttcctgctcctggtatttctggcggggctgtctgggcttgatggagtggctgcaacttgcggctgggtatcctgttcaatggtctcat

SEQ ID NO: 55824 - DNA, 2163 bp, Oryza sativa
tgtcgtaggaaaaacggcgcgaaccgattcctacgaaaccgcgatctcggtaccagtcccaggacatagtgctggtacccacggtgacaaatatgaatcattgcaaatccttaaaataaatagataacttatttaccttaacttaggttgtagctcagcacagcccgagaatgcaaccgacgacgcggacgaggaaacaccaacaacagcagcagcagtggaaccaacggtctaacacccaacaccacaggcgacggctgggaaccaggacgaaaccctattcttcacttcacttcatcttcacttcaaggtggaggaacaatatatatatttatatagagcaagggtgagtactttcgtacccagcaagtcacggaaatttaggtgtttgatgcaagcttggaagagaggcaaggttgttttgcaaatcctttattttgaaatcattttgaaatcactaagtagtttacttctttctaagtttgggccgagaagagacttgcgtctcgattcgactttaagagatgtttttcaacaactcaattggtaatgtaccgaccccccgggtcagatcactacttctcggctcccagagccatttcacttgattaagcggctcccagagccttttcattttctcggactcccagagtccaactacccagcagtacaacaatccgcttccattcgggaagcctagtctatgatgcccgtagacatcccgaatcacacagattcgtttcttgaccactcaggtcatccatctgccacgtaggctgattctggtaacgattcccacaccacaacaacttttcacaaagcacatgcaaacaaatctacactataggaaacacctcacatccgcccatgaccgcaggcacggctgttcgaacagttagttaacctctgcagagggggtactctttacccacacgacattactaacccggatcacccaacccgtgagatcagccacgtcgggagaccttaaggctttcatgacaaggcattttgaaagccgacacagggttgccatatgccaacgagaggggtcccagacagacaacaggttaggtcccagaccatactgtgccaggaagcccgagagttctacccgacaccaccccgttgaatccacatgtctcttggcatcaaggcttccctggtttgctatttactcagccaggggcatcccattgcacccgtgtggtcgcacttgttatatgctcggatgaatttcccacaggaatcggtccttatatgcgaatacgggagaatgccacataggcacaacccccgcatcgcgagttttcacaatttattttattttcaaacacgccgacaccatatgtcgtgtttttcaaggtttctcaaacccatttcccaaattatcgacaaacaacggtgtatgtggaatagttggtatacgcgctcagagagcacgaataccgaagtaccacaagggtggagcgacaaggaatcagggtagtacagcctacaggaattagtgcgactacttgggtaggtccgtcggtttggcacacaaaccgaggccaagcaagttagacgggtgattctaataatgcaagttgcagaaaataataatgtttttccaattataggagcaattggtcaaagggtgacttgccttgctcaaggtcttcacgaagcttcacgtatcttcgagaaaacccgcgatcgacgaaaatccggtaaccgcaagtatacgcaaacaattaaaaacctacacaagacccaaaataaagatcctatttagactaaataatagtgccattatatagatcacaattttagagaaaaactggaagtggaacggagtcaatcggaattacggatcgcgagatatgaattttggaagattaattgaaatttctggacaagggaagatattttgtggaacaaggggaaaatgattttttttaaatttatagaaataatattctcaagaatattattgacagtcattgacatgcgggaccaaggaaaatgattcatggaattttggaataaggaattgatttatggaacaagggtggaaaggaaatcaaggagggatatatactagacttgtttcgggtggcattggtgcggcccaaaggagattggcccattagagcccgggtggggagagagaggtggtcc

SEQ ID NO: 55825 - DNA, 746 bp, Oryza sativa
gcatgcttcctaaactaccaaagatgcggcttttattaaaaagatttatatatatgaatctcttagaaaatcgtttcaactttataatagttaattcattcggttgtatccttggataattgtcacgaaccaatcggtcactcagcatttagctcaaaagaatagacacttagattgtcaatatattactggcagaaacctgttaattctcaattcccttgttattaccctcatatctaactacgtaagagaagtttcttttaaaaaaatacagtctctctgtaccttctcaagagccttaaattaatcgtactccctctatttttatcaacatgacgttggttagttcaattttaaacatcaaataaaaacagaaggatttcggtaataatttccacaaaattgagggggaggatatagatgtgtttacctgcaggtagttcaggatggacatacattgtcaagctcgcagcaaactttctgaggaaaaagcatatgcctgcaccaatcgctgcgttgaaattgcaagcaaaggtaggcatgatgaattgatgatgatgaacatggcgacaccggtctctgcagcagttggtctctctctctctgttggtttggtccccggccgttgttaccgttactgacggacgtacgcacgcacgcacacgtacgcacgcaccgaatccatcattagtgcgccgcacgtcgtgagagccatataagtatatagtattccttgcaatacgctg

SEQ ID NO: 55826 - DNA, 715 bp, Oryza sativa
ggatcccccttcttggtttagaaagactgaaagagaacaacatatggcttttttatatacatagctaatttagtaagattaattgaaaacgcaaaaggtcgtcagaaatttgacttgaggggatattaaatttgggagattagcgaagcttaacttcatttgtcaatgtgcgtacataactgaagcagatatgtcaaccaaagagatggaaaagtccagcaggatcgagcaatcaattttcaggtttaatggattatatattcaggacattttcgtgagataggcgccagttttggggtctatttatatatatatatatatggtttcatacatttccactaaataagttaggtacggcattgttatttctccgaaataggctctttcaaaatagagcaattttacggtccttaagaaggtaccatgaggtaccacttttttctattgtaaatttggtacctcttgatatctatgtactattaggtaccaaattttacactgaatttttttttgtaccttatggtacctcctgaaggaccgtagaattgctcatggtcctcattgctcccatgttacctatttaaagaaagttaatttttgttagaaaaataagttattctaacccaaacatggaataaactttacagttcatatttttttccaaaaaaaatacatgtgaaaatattcaaacttgggtaaaataaaccaaccaaat

SEQ ID NO: 55827 - DNA, 1925 bp, Oryza sativa
ttaatctggcctcagtaaaagtgagcgtgcacgggatcctaaacttctataaatgcacacatgtatattttatctttataagtatctttaaaaaccgagctagatatcttaatatttatgaagtcaccagacattcgatctcaacgggcgtgttgtccagtacttataacatataaaattagctgtaaatacaagtcaagtttaggttggaatgagtacttgccatattaatcacctcaacttataatctgataaaaataacctagaaatgcttatattgttggacctaagaagtagccgaaatttctcagtatgtagttcaattactacaaattttatgtatataattgtcttttctttatagtcgaccatcagttcgtctagaactgattatccaaaagatttattagcgataaaatattatttataggaacaacttttataggtgtttttaacgacttaaaacatcaatgtgaaatttaactttaatttcaaattttaaattttggatacggctaaatgagctgaagcaatgcaactccgtcaagtaaagttaaaagaaagaaatcctaagggtgtgtttagtgctttgggtataaagtttttaagtatacggatacacatttgaagtattaaacgtagactaataataaaacaaattacagattccgcacgtaaactacaagacgaatttattaagcttaatcaatccatcattggcaaatatttactatagtaccatattatcaaatcatgacataattaggctcaaaagattcgtctcgcaaaagttccttaggttccttgtggtggaaccagcccatccaagttcaaatcctagatttgacacgggtgctcgcatttacggctaattattctttcagtggtaggcgacgaacccgtcgacagcgaggcgcctgtggtgacttcgtcaatttcaagacatgtcggctcagtctttcggaggtgctcataggggtagggtgtacgtgtgtgcgtttataggggtgagtgtgcgcacgttgtgagcgtctgcgtttgtattgtgtttctaaaaaaagaagattcgtctcgcatttacatgtaaactgtgaaattggtttttttttctatttaatatcacacatttgatgtgacattttttgccacaatttttttttatctgaacaaggcctaacccctgctgcgtgagacgtgtcaataaaggtcagaacagaaaaataaaataaaaattctgcatcttccccgaagggcgcgaggcggcgagcctcacgccctctcccgagtcccgagtgaggacacgccggcggaggccgatggccctagccgctctacctctacctctacgggctcctgaaccgtgtcggcgttcacgaggcaggcggtgcctaggtgatgcaggcgagctccccctcctctcctccgctggttgcttctgcgggccgtctctttgcccaggtgagtggtgctcgccacttgctcgacgaaatgcgcacttctccctgactccgctcttcgctctgcaccaggtgcggacagatgaaggcgtcgatttgatcatctgaagtggccgggaatccgcaatcatgcggtggcatgcagccgtcctattcgatgacaatgcagtggtatctttctgatggagtaactcggaattaaggtacgccccccatcgcgcgcctgccgttctcagtattaaatatgattgtcctcttcggctctttgtgtataatatagcattgcagcattctgtgtggtaatacgggctatgtttatctttcttgtggcatggctaatctccgcgtgaaccctgttcatgttgctagaaggtcccatgtttcaagtgggcgaattcttcaaatcatagatagttcaaacattcaggtctatttgtgcagcctctgaatacataacgaacaatctac

SEQ ID NO: 55828 - DNA, 1615 bp, Oryza sativa
ccagtggagtgcttttgctatattaataggagcaataagaaacctgtagatatcagattacagcataatgtaaaaagaacataaacagaagtggactatctgatggtaaaaggtttgcctttcctcttgctcttcctatggtccgagattgcaattagtcagggaacttgtttacctgctacaccgtggcctcttcactcaattgttttgttcttcaagattagccaccaacttcttaatatattatacacagtaacctgaaaactgcaaaattcaagaaaatcattgctcctgaaatggatgataggtgtggtggaaatgggaaagccaaccaaaatatagcactgtagtttctaagtttttgagaagaaactgacatatccatcttgaccattgtaaactgcaaggggccttgattttttttttgttgaaaaattactggtgaaaccttatagtatgcattaagatgctaacctgcaaaatatggttttgtgaagacatattttgttaaaccaatccttctaaaatacttcatatgtcccaaaatatagcaagttttatcccttggtacggctattaaggagatcggtaaacatacttgtttgcctccttggggtgggtgaggtgtgggcccgaactagttggggtgaaaatgaagccaagggggtagtcgatagctttgaaaccttttttgcattcctcatagaccactaattgtcttaaaaactaggattcacaccagaaatctggttgttgaacgatccgcaccagacatcgcgaagattcattgaatagagcaggagaaaaattacaaggctagagtcctaggagacaatagccaggaaagaagaaaaaatacaatcaataatcaataaaatcaataatgatcaagattcaagaaagaagacaaggctagctttttttttcttttcttcctctgtctcacttcaatacaatcaataatggtcaagattcaagaacctcccttagttgcttatgttcttactctccttggaagcacacttcacagatttgaagattccatacctcggttgacgccaacaaatggtttgggagatcaatcatgattgccaaacaatcatgaacttttaaacatgtcatgttttcctcctcggcttcttctgttcttacaattctaccagttcgtgggatcctacaagaacaaatttggggagatcaactagctttctgcaattctttatcacaatctttctgatccgtggaataatttgtgttggtgctatatccatccacctcctccaattttccatgtcacggaacgtcagttcttcaagggatggaaataccctgtcataactgccataaaattcctttccgatatcttttatttgttccaagccttgtagaattagaaccgcaaggtgagaaagatttccaagaggtggaagttctaccaattttttacagccactgaatttaatgtatcgcagtgtggtgaagtgctggtcatctgctatccatcctggaaacttcactcccatgtagcagtggatctcgagatccttaagttgtccatttggttttaggtgtgaaacagtttccgtgcaccatcaggtaaaaggggatccactag

SEQ ID NO: 55829 - DNA, 781 bp, Oryza sativa
gacatcaagcactgcttgcagatgaacaagggaagcctccacgttaaacacccgcaacgtcaccatgcagctcatggcgctcctccaggatggaacgcgccttgcccacgaagttggcgatcacagctcctgcgaaccatccgccgatggtcaatccgcctccaaccatgtcgaggtcgcccctccaactccaaggcttcaactagtagcacggaacaggaaagagagttcagaattgcatcctagtagaagaggactggcagatgttctcataagctaatagaatctgagtgcgaatgggtcatggccagctaattggtgtgttcagtcattgacctaaatgtgggcatgtgtgcgaatgggtcatagccagctaatggaatctgagtgggagcattcttaatgctacagtagtcgaccttcgttgttagtggcataaggtacatttgttttttctcaatagggattaaatacacattcagacaatgaattaagatgaatctgacttttctttttttttccccgcaatgacatcagagttgtcaattaattaaaaaaaatatgtatctagctcctttcactataaacttgtctgattttgatcccttaattataaaaccaactactattggtactttaaatctcaaaaccattaacatcttatccatgggtttaaataaggatggttttttatgacatgttgggttatggcaagttgtgttatagcaagctaaggtgaatctagcttctagtttatgtttgaattacacaactacatcag

SEQ ID NO: 55830 - DNA, 737 bp, Oryza sativa
cgactatggtagaggtggcatcacagcattaggtgatgctctagcaaaaaagaagtctaagatagcctacaaagccaaattgccacctggtgcttcaaggactaccatcgaggatatgttgatgcatgtgaatgaaatgcagtctcgcgtctatgttgtccatgtaaaccctgactctggcctggcagtttttgctgctgcaaaatctttgggaatgatgagtactggctatgcatggatagcaacagactggctctctgcagtgttagattcatctgatcatattagcactgacagaatggaacttactcagggggttattatgcttcggcaacatgtttctgattctggcattcagcattcgttggtttcaagatggaacaatctgaccaggaatggaggtcattcaagctttagttcttacagtatgcgtacttatgattctgtatggttagttgctcgtgctgttgaagattttttgagtgaggggaatgcggtatctttttctgctgatccaaatttgcaagatataaaaggaagtaaccttcagttagattccctcagaagtttgaacaatggagaaagattactggagaaagtttggcacacaaatttcacaggggtttctggcctggtacaatttactgcagaacgagatctgatccacccagcttttgatatcttgaatattggtggtacaggtttcagaaccattgggtataaaacagggggatcca

SEQ ID NO: 55831 - DNA, 3159 bp, Oryza sativa
tcatatactatgagtgcgggttagcccagactacagacacgtgtggtaatgtttttttttagttttttattttgtttgttaggtggtgtttggatccagggattaaactttagtctttgttttagatactaatttagagtattaaatattgactacttacaaaactaattacataaatgagagctaattcgtgagacaaattttttagggttaattggatagatgccattataaaatctttagttttgaaatataccgttactattaaactatttagaaacatgccattacaactttttcaggtattggaaatatgtcactgtacaacctttggatgtgtttaacaaaaattttagaccaaatcgctctcgtcttctcctttgtctccaccctctcctgttcatcttctttcttccatttctttcccttttggatctggtatcttagtattcttcctccacatctcctttctcggccagcaacggcggtgttgtgctgcaccatctagtttcccttcttcccttcgctggccgcatcaccaccttctcagtttccagcctccccgaggtctactgcaacaaccaagacgcggagcatgtcgttcttgaatgtccagcacccggacgcccaaggacgtgcccctgtcggtgcagctggagtcattcgcctacagcggcttcaccatggcgtggtccacgtccaccgattacgtgctcgtcgacgagcgcgccttgtgcacagggccggtcctgagttttcaagctctaggacaaaaacttacgtggaggcccctatatatatacataaactaatatatatatttatagtcttataaacatgtaatatttaatatttgatatgataaaattatctatatataatattttaaaactttcaaagagaaataatataatcataaacacttacttggcactttcaaaagtttcttctaaaatttcaatgaaatcatccgaacattttttccgttttcttttttcgctaccggatacatattttcttgacaatatgattaatgttgtgctaaaaaataatcattaattattaagtagtacaagctaataatttttgatctataaagaggaaaaagaaagatagagaaaattaccttagacgacgactgcgaggcgcgagcagccgatcggccgatgagggcgcgccgccgggcggttggcctccaatcgacgtagtcagccagtcatgcagagccgctgcgatttgctgccgattgccgtgtttgcgttgcggtttgccgccgtttaccgtttgcaacgcgacgcgaggcgtgatcgaggcgacgggaacggagtcagatcgcttcacttttccttcgctcctcttcgtcttctgtcttcgataccatacatgattcaggactgagagcgatgctgaccctgggggcgtcgtgggccatggcccatccgccatggggccccctaaattttgggggactcgggcgtgcgcacgggctgaccccccctagggccggccctgcttgtgcatgatcctgacaaagtgactattactgtgtactcctaatctcacagcagcaagaaacgggaggaagaagatgaacaacagaacaggagagatgggggaggcaaaggaagaagacgggggcaatttggtccaaaatttttgttagacatatccaaggggtatgtaatggtatatttccaatacctgaaaaattataatggcatacctccaaatagttgagtagtaatggtatatttcaaaactgaagaatttacaatggcatgtatccaattaacccaattttttaagcctaattaattcataattatagaatgtttattgtatcatcacataggctaatcatggatttattaggctcaatagattcgtctcgcgaataagtccaagattatggataggttttgttaatagtctatatttaatacttctaattagtgtccaaacatccaatttggaagggactaaaaaattttagtccattccaaacacctccttattatttttatcaaatagccacgtaagcgtcatgtcaatagcacgtgggacgaagacccctagtcaaaggcgtcatgtcagctaaaaccggagacattgctaccgagagagctcgtttgcacagtttgaagaaggcgtcatgtcagccaaaaccagaaatattattaccgagggacctcgtttgcacactttgaaggatggattgtatatggttttcggataaggatgaaaaacagactaagcgacaaagtaagagacctaaagtgaacttatttgagggataaagtccacttggacttccttaactataagggaataagttcacctgacgtcccttaactttaagtcgagttcgtctgaggttcctaatccacaataaaatctctacctctcaactaatcataaaccgtgcgaaaaagatcacaaaacagacggagcgatgaagtaagggacctaaagtgaactcattttgagggataaagtcacttcataactataagggaatataagttcacctgacggccctcaactttatgttgagtttgtctgaggtccctaatccgcgatagcaaaaatctctacccctcaactatcataaaccgtgcaaaaaagatcccaagacaatattgatccattttctccggttttgctgacgtggcatacggtgggacccacatgtcagcgtcctgtcttctcctcttttcttttttctttttttttcttcttgtcttttctttcttctctcttctcctcttcccttcttctcctagcctgagaggccggcgggcgggcgagcaggcgacggcaggcggtggcggcggtgtgcggagcaggcaaggggtaacgggtggcgggcgagcgacggcgcctcagagagggtgtggtgtgggcgtcgctgtgctgtggcgggcggagcggggtggcggcggtggggtgcagaggacgacgacatatggaagtgatggcggacgctgtaggggacgatggcgaggaggacgaagtaggccgggagaggatgactccgacgcgcttggggtttcaccaggagacctcgccttcaccgtcttcgtgccctcaccagagtcgttccaccgcgtgcttaggctgcggcgtcccaataacaacgttgccgatgggtgggtctca

SEQ ID NO: 55832 - DNA, 13659 bp, Oryza sativa
actgccataggacataaattgaacggttttgtatatttggggtgaagatttctggtattgaggataagggatggcaaacaaactcggtgtaaagttgagggacatcagatgaacttattccaactataaggcaacgcatcacggtgcatggcccatgggctgcgcattctggcccacaaagcagcacacgcaccagtaaaccctagcctccaggagctcacccgtataaagtcgcagaccttctccttcccctccccgccgccactcgccgcagcgtgtcgaccagacaaggcagcgcctccgaaaccctagctccccgccttcccctccgcggccgccaaaatggtacgcttcttcctcctccccgtccgcctctctccgccgcacgacggcaagatcatgcgctcgtgtgtcctcgtgccagtccacggcaccctgctctggtcgatttgtagggggattgcgttctttattcatgttgatctgctgtagatgggggcgatcttgagccggaggagtagctagtttcttattgatgcggtttcggggtttttagagatttaacacggtttcgcggtttctctttagcgatttcttttttcatgttgatataatgatatccacggtggttgttctagttatgtcatttttatcttgagtgctttgtgtgattgtttttcaattgtgggtagagaccagattattgtcgttaagatgcatgctctgaaacgcggaatttttttgtaatgggttatatctagattatgtgtattgctgtcattcaatagtcttttcttaatacaaggcgcaaccgtcttttcttcaagtaccagtatacaaggcggcaactgctcaactccgtacttggtgcatgcaagcattgaatggatggttgcatgagctcatgatattcggttcattagtttaaaggcaaaggatccaccactcggatgcttgcatgcacgcgcaaaaactgcaggacacgggtgcatgctgctttggcactagatgcgatgaactgatcaaagcgtcacgcattggaacgcgctggaataaatcggtacgatgggtagttataggttttcttgttctccgagtccaaacaagttatgccttgtattaaggaatggagggagtagcaattaacttctggagtaaacatttttcatcatcttccttgaggacgtgggatgaattcttttttttatcttgtgcgaaaattgtttggtaatcatgtctggttttgactgatgggctccgatgatggcatgaaatctttgagacctgacattcttgtgatgacaaacataagcatatttcctgaggacccaattgaggttttaaccattggtctgctgaatttgtctttgctgtcgaaaaatatcgattcacatgtgcttctgattatgcacatttgattgtgttgtttataggcctgctatgtgctttccaataaccagtatttgttaaatttgtttcatatttcttatgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggtattgtgacagtttatatgtgattacgcagtgctgtgtgtgattgtctctcttcattagaaacatatggtgtcatgatttgtgtctgttcaatgcaaacatgtggcaataaccatcatgtagttttaatgtatctgactttcagctgtgcatttttcatgttatgatacatggttcctgttttcaggcaaaaaccaccaagaagattgtgctgaagctgcaatgccaaagctgcaagcattactcccagcaccccatcaaggtattatttcattgtcaagactcaagctgaaaattgtcatgaatcaatcagtatctttttagatgtgttgggtgctatcttacattattattctttacagaggtgcaagcatttcgagattggtggagacaagaagggcaagggaacatctcttttctaaactacctactggatactgaagttgtgggtctattgtgcttcatacttcaatgttattaggaacttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggcagttttatctccctaagtcctcagtgtctgtttttcgttatcttacccgagtttgcaatcctagagcgacccacgtaaacgaattcctgtgacatgaatccctgagaggctagtctgatgaacttccgtttttcagatcgaatttcgtatatggttaactatactatgttttgttcaatatcttcgtaacgagatggaaggtatggaatactatggatggaggtgaattgaaagataggccttggtcttgtgattgttatcttagaaggtcgatactaatgtttggtcttgtggcgttagtgaaactgttttcgtagcaatgtttggtcttgtgatgttattgaactgttttcgtagcattgtattacttgttccattcttcatgcatgatttggataggttattgacaattgtttatagtaatgaattaaatattacactcctaaattattataaaccgaataaatagcttaaagcgagccaggcaatgctgatgtagaaaatttctagtttgagaaccgtggtatgcatatcccgaagttcataagctgaaaagattgcaccctaaatctaatgtattgtagttttcctgtactgaaaatgctgttggatcggacagccgtggtgattggttgcgttcattttcaagttgtagccaagttaaataaagtatagaaggatatgcaagtagcaacatcggaggagtgccatcgcagtgatcctcccaaaaagcacgaaagaaacatcttcattggaacctaagcagctctggccttttgagcccagaaaagctatccttgattcaagcacaaaccgtcatttggttatatgctttctccaaatactagcatgagtaaattgcattggcggtacacgaacttgctaggtggaagcaatctagtacataaacttataaaacgctcattttgatacacgaacttgttaggtgcatgtgaatcaaggccaaaagaaaaaacaaagctaatcttattttagtgttaattaggatactacataaacacatgtgtgagaaaaatgctaagtacatatacatttgttcaataaaaaggggttaataaggcctaaagattgtatggagaaagacacaaaaatactgagaaatagtgcaaggggtagaacaaagaataataaagcacaaatgcatgtctcatgtccacctccatatgcacatctcgtcctaatcagtgtataacttagtaaaattgattatgatgtgtcattttgaccttgtttcacatgcatcgaacaaattcatgtaccgaaacaagtcttttacaagttcgtgtagtaaagtgcatccatctggcaatttactctactagcatttgaagctaaaaggctttggccttttggagcccagaaaagctgttcttgattccagaacagatcgtcatttttggggtatatgcctcctccagaatcctaaaattctcatttcatgtaaggaaaatcgcaagtgtccaacgctgaatccatcccagagatctcagtgagcaaattgcacagcgccagttgggactattcaaggattttcagggccatgccctgtacccatcatccatcacccagcaacaaaacaagccggaccgtagtgtgtcaagcatgcactgcttctgctctccgatctaaccggtagcccccaactcattctgaaccacaccttgtgttttggaccacatcacaaaattcagaagcagcagcagcagcagcaaagggtcaagcaaaaaatctaacagctttatttaggcagatccacctctctacatcatcatagtcatagtacaagaactcgacgaattcagaagaaacattggcagctacacctagagaaagaaaaatgaaaagaaaagaagatctaatatattacaagggatccttggatatatgctcatagcattgttacatcccgagcaccgagtcgcgacttgtggcgaaaacgggtgccatttccatgcttatgccattactgcttcgcctgaaaaaatgagatgttttttttttggttagagattcagacttatgttcatgaattggctcttttgtgaaaaatgtgatttggtaaaacatgtgcggaaaatctacctgagagtagatgaaagttccgagaatcgcaatggcggctccgagggcgttgatgggctggaccggcgtgtggaagatgatgatggaggcgacaatgacggagatccgcttcatggtgttgccgatgctgaatgtcagtggtgagatctcgtccaatgacatgtaggacacttggttgtacaagtggtagaacacactctgcgccgccacccacctacaaaaccacagagaaatccatggccacatgaatcagctggattatcacacaaaaatatcatcaaatcttttgatacttcttatttctctttcagaatgaactgaagaagatattgccgcttaggaggaaatgatagtgataggacgatcctatatctatattaattgataatggttctttttgtatagaatacttgagtgatgttactgaaagtacaaagtgttgcatgctgaaactgtttgaaagcttaggtcaagcacttatcactagaaattttttgcccaattgatacccaaaaatctcaactgacgtgatggttgtgacagtgaaacggtgagaagtggtacaaagaaaagcatgtgaggctcaccagacgaagtttggaccgatctcggcgacggctttttgccagccggcagcccacaccttgggcccctccatggcgaaggcgaaagggaggaggatgaccagcgagagcatggagaggcaggcgtagtagttcatcccgctcaccgacttgcccttcatccccttcttggagaatatgttccggaacacgaatgccaggttcgagatcatcgcccccatgaatcctgcatcgaattttcagcaatacacgatgaacagattgatgtgatgtgtcaggtttatgaacaaattgtgcactttttcgtggctggtgtatatttctttatctgacataagaaaacatatctttggttaatggacagttcttgttctgaagaattcttggagataatatctatttttttaatcaaaaagtgaggatatttctggtgtatctgctgcaagtatctccaggatttcaggtggagagacagagagatgcagagtgtttgctcactcaccaatcatgttgaaattgagctcggtgatggcggcgagggcgcatccgccgatgattgggaggagggagaagtagaccggcgccgggaagtgctcgccgaggaagaacctggagacgagcacgctgaacgccggctcgccgctcttgatgatgtgggtgaacgacaccgccaccttcgccatgctcaccgtcgccgccacgtgcccgatggtgtgcgcgatcgccacctgctcgtcccacaacgagcaaaaacgaatccccaaatccaacgaacgcgtcagagattcagaatagaacagaatcaagaaggaggagacgatggtgtccatggtcaatgcgatctcaccggagacagggccttccagaaatcgaggtcggtggcgggcgcctcggcgatcctggtggcccaggaggcgagcatgatggcggagccggcggcgagggagagcgtggacgtgagccacgggtaagggaacgcgttgagcaccttcttgttgtagatgttgaagatcacgttcagcgcccaccacgtcgcgaagtagaccccgatcttggcccgcctcgccgcctcctccggcgccgcgcccgccggtgcagcctccaccggccgggcgccgtcggcggtggcggacggcggcggcggcgccggtgacgcgacgcgcgacgccaggaataacgggtcctgctgccggtacagggggcgcgccgagagggagaggggacgtggcccggcggcggcggcggcggcggcgaagaggggagggaggtggaggggcttgaataatgccatcttgggcgccgtggcggtcccggccgtggagagcttgacggaggcggcggcggcgagcatattggcggcgggaatggtggcgccggcttcttcagttacagttactgtgttgtgttgtagccggccgtccgtacgtctatggcggcgatgggttgcggccatagagactgctcgcatcgagtcttcttcaatccgactataacaaattgctagctagttccacgccctccaacgcccttttagggaaggaagcctcaaaggagagagggccgccgaacaatgtggttgaggacaatccaaggaaaagggtggagacgaagagggagctggacaaaagataagtggtagaggggggaatcctacagctagaagaacatcaaccgcgtcaacagggaaggctgcaagaatagtagccattcaagccaaagaaaaccgtaggcactaacataaaagacctgacctaatccatcaatcaaggagcatgctaaaaggagatctagagagagggagaggcactggcaaatcctaattgatggatcagagccaagcatgttatggcaaggagctcgttggctagctcaagggcgcctcaaagaggagggaggaggagggatggggatggaagaaggtgttgggcaaggtcaccagtcccgcggggagaggggggtccgaggccagagcctgccaccggtgccacggattcgaccagatccagccgctaggagcgcagatctgcacgccaccagtcgggggcgccgggcctagccttcatcgccggccgaggggggggggactataaggagccaagccgaggcccatcaccgccctcacggacgacacgtcgccagacagcaccgctggcgactgccctccgcggccaaggagcacgaccgctccttcgccgggaacagcacaccgtcgccgggacacacgccgccgcaccgcctccaccacgccccatcgcgccaccgcgcacggcattgttgctctcctccggccaggtccaaaagcagggtgcatttttcatgttatgatacatggttcctgttttcaggcaaaaaccaccaagaagattgtgctgaagctgcaatgccaaagctgcaagcattactcccagcaccccatcaaggtatttttgcaatgtgaagattcaagctgaaaattctcatgaatcagtatctttttagatgtgttggatgctcacttacataattattctgtgcagaggtgcaagcattttaaaattggtggagacaagaagggcaagggaacgtctcttttctaaactacctactggatactgaagttgtgggtctactgtgcttcatacttcaatgttattaggagcttaatttaagcagaccatatcatgtattcaagtactctagcaaggattggctttctgctgaatcaagttttgttgcttaatgctcattgaatccaatgtgatgcatgtgtttatgttgcactgcaattttgtcttatggcagttttatctccctaagtactcggtgtctgtttttcgttatcttacctatgtttgcaatcctagagcgacccacttaaacgaattcctgtgacatgaatccctgagaggttagtctgatgaacttccatttttcagactgaatttcgtatatggttaactatactatgttttgttcaatatcttcgtcacgagatagaaggtatggaataccatggatggaggtgaattgtaagataggccttggtcttgtgattgttatcttagaaggtcgatactaatgtttggtcttgtggcgttagtgaaactgttttcgtagcaatgtttggtcttgtgatgttagtgaactgttttcgtagcattgtagtacttgttccattcttcatgcatgatttggataggttattgacaattgtttatagtaatgaattaaatattacactcctaaatctattatataattaaaggaatagaaaaaagagcctccacgtttactctcatggcttagaaattctcacattaatcggagaaaaaaaaacagagtccatatagaaatacaatttagaaatagctgaaattcggaattaaaaaataaggaatattagaagagaagactagagttcatatagaaatacactttagaaatagttgaaatttggaattaaaaaataaggaatattagaagaggagtatagagtccatatagaaatacaattaggaaataatagaaattcggaattaaaaataaagaatattagaagtagagtatagagtccatatagaaatacaattaggaaataatagaaattctgaattaaaaataaggaatattagaagtagagtataaagtccatatagaaatacaattaagaaaaaatagaaattcagaattaaaaaataagaaatattagaagtagagtatagagtccatataggaatttaaaactaactaaaattcggaaaaaaaaaaaggagcctctacgttcgctcccatggcctagaaattctcacattaatcgaagaaaaagaaaaaaacagacttcatatagaaatacaatttagaaatagctgaaattcagaattaaaaataaggaaaattagaagaggagactagagtagttattacacattagtagttttgaaaagttattgcaaaatttaaaattatgttgtcattgtaatatattataataatataatgagaaaacatatatgctattatatgagagaaaatataatgatgctagccgcgcaatatgcgcaggccaccatgctagttattataaaccgaataaatagcttagaacgagccaggcaatgctgatgtagaaaatttctagtttgagaacagtggtatgcatatcccgaagttcataagctgaaaagattgcaccctaaatctaatgtattgtaattttcctgtactgaaaatgctgagggggggactacaaggagccaagccgaggcccgtcaccgccctcacggacgacacgtcgccagacagcaccgctagcgactgccctccgcggccaaggagcacgaccgctccttcgccgggaacagcacaccgtcgccgggacacacgccgccgcaccgcctccaccacgccccatcgcgccaccgcgcacggcattgttgctctcctccggccaggtccaaaagcagggtgccagatccagccacgggggcgccagatccgaagcttcgcgccgcgctgatgtcagcccccacctatcacgcgccgcgtcatcatcctcacgctgagccgtcgcgtcgccgaggaatggcctcgccgccgccctcacagttggccgcgcggaactccggtggcgcgctccggcggcggcgaggggggagaggaagggagggggcggcgggggctagggttcaccccctgtgccgctcgcgtgagagggcgacgcgggggtcgtgccggcttcgtactcttccaattgaggataagatgaactgatgtgataagtagtacgggattgtacttattttaaaacaaaatttgaatataaaatcatacttattttagaaggattgtagtatttggacttgggagtaattttactgttcttggtattagaaggtaccatttcttttatataaaacttggtatttctcgaggtataaaaaacatacggttaggaccgtaacgaactgtgttagctgtaggtttgcatctgttcccaaggtgatttaatttgagcaattgcaaatagctttttcttctttcactcggcagctgaatcttgcttggtggagtactcgggccgtgcacgttcatccacgggtttgatttgacattggtcatgagcgcgttttagtggacaaagtggtggttagcatagtgaaattgtcaacgcgagaagcagaaaccaattgctgttgctgtcgccggtaccaatactgtatggtgttcctgttccatcagaattcagtcgagtgcatggcagctcattcttgtggcccatcacacaattaatctccgacgatgtactgtacgtagtggagcatttagattagtaattctcgaatacattttcgtaagggttaagtgggcatatgtaacgtgttcactccttgttactatctctgttttcagatgagtgacatcatcagcatagtccgcaatacacattttatcatcataacaattttacactataaaaaacgatttttcgtgatgttaccctatattttacgctggcgtccatatgcaaaaaccgccaaaaaaacataacaataggtggggggctacggaccaccagcagaaaccaatttttgctgataaccacgctaagagaaatgcctaaaaaaactactctatttttcgagacgaacctcttaagtgtctgccagtttttcgaggcggacctcttaagtgtccgccagcgaaaaatctcattttcaccggcagtaggtaaggaggaccactgcgaaaaatgttttgggcgaatatataaatctactgtcccccacccccaccgctcccttctcccttcccccactgcgcggcccctccgccgcctctcttccttctctctcggtttcaccttcttcctcccttctccaccgccgccggctgccgtcgcctctaccgcctctccgcggtggtggggcgtggcctcctcctctccaccgctagccgccataagctcggggccggattcggccgctgcgacgatggtggaggccggatctgccgccgcgacgacgggggaggctagatccgtcgccgcgaccgccgcagggccactagtctctaaagactaaactatatatttaaaaaaacattaccaatataactttatgaaagagagtttctcataaaaaaaaatataccaatataacttttcatattttaaatatttttacgtctattaaatttttaaggtttcaagatttgactgcacttacaggagatactactatacaagaatcaacgagaaacgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctcctcctcccctccgccgcacgacgggaagatcgcacgcgtgcttgtcctcgtgccagtccacggctccgcgcgccgtctttctcatggtgtttcacaatttgtaggatgcgttctttattcatgttgatctgccgtagatggggggatcttgagccggaggagaggagtagctagtttctttgattatgcgttttggggtctagcggattttaacatgagatggtttctctttagcgacattttttttgttcatgttgatgtccacggtgattgttctagttatgtcatttttatcttcaagacttcaatgctttgaatcgtgggtatagaccagattattgtcgtgaagatcgacgtattttccgagctgaccctctgcatgctgaaaattttgtagtgggttatatctagattatatgtgtattgttgtcatttaattagcacttaaacttctgtagtatgaacattttcatcattttcctgtgaggacatgggatgagttcctttttttttctcttgttctaaaattgttcggtaatcttgtctggctttgactaatgggctccgatgatggcatgaaatctttgagacctgacattcttgtgatgacaaacataagcatatttcctgagacccaattgaggttttaaccattggtttgctgaatgtgtcttcactgttgaaaaatttgtacacacatttgcttcaaattatgcacatttgattattgtttataggcctgcgatgtccattccacattcagtatttgttaagctgagtgcttttgtttcaaatttgttttgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgaaagcagtcaggatatggtggtcagaccaagcctgttttccacaagaaggtactgtgacagtttatatatgattatgcagtgttgtgtgtgactctctgttcattagaaacgtacggtgtcatgattgatgtagcagtgatatgtgtctgtacaatgcatgtggcaataaccatcacgtagttttaattgcatgtggctttcagctgtgcatttttcatgttatgatacatggttcctgttttcaggcaaaaaccaccaagaagatcgtgctgaagctgcaatgccaaagctgcaagcattactcccagcaccccatcaaggtattatttcattgtcaagactccagagctgaaaattatcatgaatcattattttgctggatgtgttggatgctcacttgcataattgttctctgcagaggtgcaagcatttcgagattggtggagacaagaagggcaagggaacatctcttttctaaattgcttgctacctactggatactatagttgttggtctactgtgcttcaatatttcaatgttattaggagcttatttaagcagaccatatcaatgtattcaagtatcatcgtctgacatttactctagcaaggattggctttctgctgaatcaagttttgttgcttaatgctcgttgaatccaatgtgatgcatgtgtttatattttgctgcaattttatcttacgacagttctatttaccttagtcctcagtatcccttttctttttttgttatcttacctgctgtcttttgattagtagttagcaaacatagagcgacccactttaattacttcccgtgacatgaatatgacctcgagagattagtctagtgaacttcctttttcagactgaatgttgtattgttaactgtactggcgtttggtcagtatctttcgaaagagatggaatgtagggacgtaattttattgcaagataattcatttgttcttgtggttcagtatcttggaaggtcttgtgatattagtgaattcttttcgtagcattgcagtacttgctctgtc

SEQ ID NO: 55833 - DNA, 2592 bp, Oryza sativa
atccaccggtttgatttgacattggtcatgagcgcgttttagtggacaaagtggtggttagcatagtgaaattgtcaacgcgagaagcagaaaccaattgctgttgctgtcgccggtaccaatactgtatggtgttcctgttccatcagaattcagtcgagtgcatggcagctcattcttgtggcccatcacacaattaatctccgacgatgtactgtacgtagtggagcatttagattagtaattctcgaatacattttcgtaagggttaagtgggcatatgtaacgtgttcactccttgttactatctctgttttcagatgagtgacatcatcagcatagtccgcaatacacattttatcatcataacaattttacactataaaaaacgatttttcatgatgttaccctataatttacgctggcggccatatgcaaaaaccgtcaacaaaaacataacaataggtggggggctacggaccaccagcaaaaaccaatttttgctggtaaccacgctaagagaaacgcctaaaaaactactctatttttcgaggcgggcctcttaagtgtccgccagtttttctaggcggacctcttaggcgtccgccagcgaaaaatctcattttcactggcagtaggtaaggaggaccgctgcaaaaaaagttttgggcgaatatataaatctaccgtcccccacccccaccgctcccttctcccttcccccaccgcgtggcccctccgccgcctctcttccttctctctcggtttcaccttcttcctcccttctccaccgccgtcggctgccgtcgcctctaccgcctctccgcggcggtggggcgtggcctcctcctctccgccgctagccgccatgagctcgggccggattcggccgctgcgacgacggcggaggccggatctgccgccgcaacgacgggggagaccagatccgtcgccgcgatcgccgcagggccactagtctctaaagtctaaattatatatttaaaaaacattacgaatataactttatgaaagagagtttctcataaaaatataccaatataacttttcatattttaaatatttttacgtctattaaatttttaaggtttcaagatttgactgcacttataggagatactactatacaagaatcaacgagaagcgaatttttaagttgcgataaactggtagtagtaagattttgtgaacaaggataatgcatatctgcgtaaaaaaatatatagtgcaaatcacatgtacattgaaaatctagaaactattgtcacaagagtaaaatttttaccaaccaaacggccacaatgtcgcgcagggcttatccggggcactactgcccttgggctgaaagtgcggccacaagcccacaatatcttgcggggcttagccggggcaccacggcccatgggctctatctccctcaccagtaaagccctagcctccaagaccgcacccgtataaagccgcagacctctctctccttctcctcccccgccgccgccacttgcctccgaaaccctagccgccccctccccgcggccgtgaaaatggtacgcttctccctcctcctcctcctcctcctcctcccctccgccgcacgacgggaagatcgcacgcgtgcttgtcctcgtgccagtccacggctccgcgcgcgccgtctttctcatggtctttctcgatgggtaggatgcgttctttattcatgttgatctgccgtagatggggggatcttgagccggaggagtagctagtttctttgattatgcgttttggggtctagcggattttaacatgagatggtttctctttagcgacatttttttttgttcatgttgatgtccacggtgattgttctagttatgtcatttttatcttcaagacttaaatgctttgaatcgccggtatagaccagattattgtcgtgaagatcgacgtattttccgagctgaccctctgcatgctgaaaattttgtagtgggttatatctagattatatgtgtattgttgtcattcaattagcacttaaacttctgtagcataaacattttcatcatcttcctgtgaggacatcggatgagttcctttttttttctcttcttgttctaaaattgttcggtaatcttgtctggctttgactgatgggctccaatgatggcatgaaatctttgagacctgacattcttgtgatgacaaacataagcatatttcctgaggacccaattgaggttttaaccattggtttgctgaatgtgtcttcagtgttgaaaaatttggacacatttgcttcaaattatgcacattcgactgttgtttataggcctgcgatgtccattccacattcagtatttgttaagctgactgcttttgtttcaaatttgttttgtataggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccagcctgttttccacaagaagggctgtgaca

SEQ ID NO: 55834 - DNA, 725 bp, Oryza sativa
tttcacagggagttcgctatttatcacgtgacatggatgccctagatacactaccagataaatttaaaactgaacaattgcgcacttttatgttgcttgacggcagtcatcaacccagcaataatgaaactcatctccctcttagtaattttttgtgtaattccaaaagcctacgcttactggccttctcttcaaggagttacaaatggctgggacggacgtccgctctttcaaatgttattagctcaacgaaacacctcagatatttagacctctcgtttactgggatcgcgaaactgcctaattcagtatgcagcttgtgccaccttcaggttcttggcttgagaggctgtacatttggtaaattacctggagacatgaatttcttaatcaacctacgtcacttgcatgctagctcaggcacaattgctcaaattaatggcattgggaagctaactaaattgcaagagctacatgaattccatattaaagcagaagaaggtcacgggataactgagctaagtgacatgaacgatttgggtggttccctttgtatttcacaccttgagatggtgactgatcctgcagaggcacttcaagctaacatagttgagaaggactatataacagctttagaattaagatggtcttatactttgcctgatctgtccaagtcgatacttgggtgtttgtctcctccaagatatctgcaggagctaaaactg

SEQ ID NO: 55835 - DNA, 807 bp, Oryza sativa
agaacatcagcagcgtcaacaggataggctgcaagaatagtagccattcaagccaaagaaaaccgtaggcactaacataaaagacctgacctaatccatcaatcaaggagcatgctaaaaggagatctagagagagggagaggcactggcaaatcctaattgatggatcagagccaagcatgttatggcaaggagctcgttggctagctcaagggcgcctcaaagaggagggaggaggagggatggggatggaagaaggtgttgggcaaggtcaccagtcccgcgggggagggggggtccgaggccagagcctgccaccggtgccacggattcgaccagatccagccgctaggagcgcagatctgcacgccaccagtcgggggcgccgggcctagccttcatcgccggctgaggggggggggactataaggagccaagccgaggcccatcaccgccctcacggacgacacgtcgccagacagcaccgctggcgactgccctccgcggccaaggagcacgaccgctccttcgccgggaacagcacaccgtcgccgggacacacgccgccgcaccgcctccaccacgccccatcgcgccaccgcgcacggcattgttgctctcctccggccaggtccaaaagcagggtgcatttttcatgttatgatacatggttcctgttttcaggcaaaaaccaccaagaagattgtgctgaagctgcaatgccaaagctgcaagcattactcccagcaccccatcaaggtatttttgcaatgtgaagattcaagctgaaaattctcatgaatcagt

SEQ ID NO: 55836 - DNA, 760 bp, Oryza sativa
cggcccggtgacgcgacgcgcgacgccaggaataacgggtcctgctgccggtacagggggcgcgccgagagggagaggggacgtggcccggcggcggcggcggcggcggcgaagaggggaggaaggtggaggggcttgaataatgccatcttgggcgccgtggcggtcccggccgtggagagcttgacggaggcggcggcggcgagcatattggcggcgggaatggtggcgccggcttcttcagttacagttactgtgttgtgttgtagccggccgtccgtacgtctatggcggcgatgggtaggggggaggtgttggggggaggaaggtatttatagggagcgcgcgaagaagaagggaggcggttttgtgcatgtatgtcgccagccatggcatctttctcaccgtagtgaggtttttgatttttgctgcctctgaattattgcctttcttttttcttcttaaaatgtgcatttctttcttttttatatacagtttgtccgctgtgtcgtttttcgatattacaattatttgcgattaatttatggtcatgttttatacataatgctcggttaattgtatataatgcactatcgatccaccatgcacgattaaattcagctataaccatattgggaggacataaatactatgcattatgttaagaaaaggctagtgcttccatgatttgtgcctgctaagggcttgttcggatcacaggataggaaaaagcataggaatagaacggggatccactagt

SEQ ID NO: 55837 - DNA, 709 bp, Oryza sativa
gagttgtacgacccaatctggaaaagccaaacctgtgtagccaaaaaattttatcgtctgcagatttcttggtggggacaaacactctaatatctccatgtcttgatcaggtttaattacctctggtggattcatcagatatcctgatatatctgaagtataattcttctcaactaagctagcttgaagtggctgcttttgacctctgtcgaattgactcaactcctttccatatagattatatttacctctagaagactgatttctatcccacttcagagctaaacaggtaacatactccttccttcctaagttagcctgaattgcctcttctcgattagccaccctctgtagatctgatatacaaagggacccttggatatacctcatgtcctttaactcaattaacgtgtgaccatcctctgctttaacacggtattcatataagtcttggagcctggtaagctgtccaatgccatgaattaaagcaaccgtatctgcatctgcatgcaagtgccgtaggccaactagtgagttcattcttcttggtaattgtgtgaatctacaacctctcaaaccaagaacttggagattgcacaagctacataatgaatcagggagtttggttatcccactgtgtgaaaaatccaagtatctgaggtgagtcaaatagggcagcatctgatgtgttgtggtgaactccacaaat

SEQ ID NO: 55838 - DNA, 1128 bp, Oryza sativa
ctgcgccatcggttcttctttcctgatgttgtcagtgaaatacacccatgcggaattaccgcggaagtgctcccgcaccctttcgtcgtcgaagatgaactgagcaagagctgttttccccactccacccactccaacaattggaatgacagttggattgcacattgaactgacagtgctgctctgcaccctggtgtatttcactctgctgcccatttctttctggtatgctgctgctgattctgcaggttggtttctctggtcagatagatctatgctccggagggcatcgatgatccatcctttccgagaaatctgtgatccatcagcacttgccctctcctcaaccgattcatccgccacgaaacgggcatcatccagtatcatctccaatatgacacctatttcctcatctcgcccaacaacaaagggttggtcagggccagggggcaaagcggcgacgtcatcccccggggtttccagtccatcctcgtccaggcccggcacgggaagaagcgattcgacctcggagcacgcgctgacgagcttgccgacggtgtacttcaccccgaggaggaggctgctactatcggaagctgcggccgccgcggaagcctccatggcgttgaccagctcctccgcctcgtcggcggcctccttcacctgccgcagccacgcggccgcctcttcctccctgtcggcgtcgacgccctgcaggctctcgccgcggaggatgctgagcttgtcctccagcagatcgagcatcttcatggtgcccctgtacttgtgggcgtcgctgctgcctcccaggtggagacgcagcttgccgaccaccctggcgatcgccgccggcagcggccatccgttatcttctactagctcctccattctcgcgattcgcgagttgcaggggaatggggaatttgggcggggtgacagtgataacgacagagtgaggctgcgtcaccgggagagagagagagagcaaggctgtgtttagtaggggaaaagaaaatttttgggtgtcacatcagacgtttgaccggatgttggaaggggttttcggacacgaatgaaaaaactaatttcagaactcgcctggaaaccgcgagacgaatcttttgagcc

SEQ ID NO: 55839 - DNA, 826 bp, Oryza sativa
ggccggagctgacggtcggcgggtggttcgccggcgccgtgatctccaacttggtggcgaaggtgcggtccgccatggagcaccacgccgccctccgggccgccgccggcgacatgctgtacggcgtggaggccgcgctcccccggatcaggatcctcgtcgaggcgaccgagcgcagggccatctccagggccagcttcgccgcgtggctgcagcagttcaaggacgccgtcgccgaggccgaggacctgctcgacgacctcgagacgcggaggatccgggcggcgctcagggccaggggcagcaagctcggctccgccacgtccctcgcgctcaggttcctcaggaacctcgtcctctccgatggggatctccagaggctcaaggacgtcctggccaagctgaacaggatcaccagcgacgcgaccggcttccacgacatactgaaactggccgacgacgacgtgggggcgatgcgatcggtccttccggtgccagccaccccgccggcggtcatcggccgggacgaggagcagcagcagcttgtgaagatgattttacgccccggcgcaccgccgtgtcctcaggatggagctgaatcctgctctggtgtttctgtcatatcagttgtgggagcagctggtgtgggcaaaaccactcttgctcagctgatttacagtgatccaaacgtcaaggaggctttcctgttgaggggatgggtgtttacctctcgtagctgcagtcgaacgggtctcgaacaagatatcatcgagtcttttgcgtctgagcaagaggaaagtctgcaaagaaaaacggtttcatcaga

SEQ ID NO: 55840 - DNA, 5031 bp, Oryza sativa
acatacacggtttgcgttatgccctgtgcggcaatgtcactgtgcgattagctggactgatcacgtctcccaataataagccgtacgccggctctggcctaaccagaaccacactagaacaggattagcaactttagcatgcagcagctgccaatttgccactgacgcctctcccgtccatctttttccccgtgtaccacttctccgtccgtatgcatgcgcgaccatctccagactccacagctcacgagatgcctgccttttgctccctgcagctgcagctgcaggccacaatagcccaagagtgacaccaccacatgaccgcaacaacaattgccgcctcgcctgcgaaagccaccaagagctagtagcgataaaacagcacaagcttaccatgtcatgccaccgcgtaatccgtgtacacgtacgttgtagtaagagcaagtttaatagtatagctccactactagctccaaatcatctataaccaatgtaatagtcaattcataccatagttgcttgctatactattaatatctggtcccacctgtcatacacacgttacgtcttgaagttcgtgctgcagctggctacaaatctaatatatttatagctgacttatagcctgctattgtacgtgctctaatagcttaaccgagaaatgtggcgccgatctatcgccagagagacccaaggcgaaattaaacgtaacagcgacgacgcgccctgaaactgaaagtacgtacgttgcgttccaagatgcattttgccatggtcgatcggaatttcttctccttaattttggctgtgcctgtctgtctcagcctcagggggacgctcaaaaaggtcacacggttttctttttcccttttttttttcgttttgttttttgttttctgggggaagataaaaaaaatggatggaatcttcggctaagggaagttggtgggtaccagaaaaactaacgcggttctacgtagcataatgcgcaaggcactcggttcacggtaatctgtattgggcgtagcttaagaaaataggtcccctaggccatatcgacgatgggtacatatcattgtttaggtgacaaaacaccggcgcgtacgaagcccccgtcgaatggcagccaaataaaaaactaaaattaaaaattacaaacttaattataagattcattttgagatattttcaacctagcttttttcgttggtttttaagtaaaaaaagcacgtatttaaaagttttacctgtaaatttaatttttattctctaataaaccgttttgggtttattagggaaaaggcgaaacaacatggcctcgagacggcatggagaattcgcgtgtgtcgtctcgtcgtcccagcggagacgcttccgtttaccggttcgctctcgaggaggaaagggaattagctgggacgacacgggtgtttttattacaaaccgtccttgcccgtgtccgtgagaagggggaggaacgacatgcagggaggcggtactactgtcccgtggtagacaatctgaaatctgggttaattgtttatttgttcgttcgtagctagtatattagctctttttctaagggtgtatttgaaactatgtgtggagattatgggtaccctatacccacacggcatagttatccgactggttatatggtataacttatagagaaaattcgatctatagcacaggaaaaaacccggtaccaaaatatagcagaacaaattttctacttcgactaaaagcatagggcacaaattttcttgcgattcataccacttccgtcacatttgccatccaaacatgtgagttgacatgaaaaaaaaactcatttgcccctcttccctccgctagcgctcttctcactcggcgacgttgccgcgcccgtgtcgccgacgctcggtgagctgacggagccgcgcttcccgcccgcccgctcgctcagccgcttccgatcggcgctcgtcaccacgcttcccaccgttgcccgcgccagatccgtcgcaccaccactggatttgtgcgcgtggggtggagcaccggccagatccgcatggggaggaaggcggtggaggaggaggtggagacgccgcgcttctggcccgccagctcatggccgcctactcggcggcggcggcaccgcccgaggtcatggagctgacaaagcccgccgcccgcccgctcgcgaatcatcccaacatccgccagcgcgcgccgcagcccgcctgcataagcggcaggtcatcgtccctgtcgccgttgtcgtcatcgccggcgtccccgttgttgttgtcgttgtcacgtgcaagcagcggcaagccagcgcggcgtggcgtcgtggcaagggagatgctgttctgcggcaccgagtacggccaccacgggccacatccatccacgccgaagctagggccgcccacgtcatcgtcgttgtcctcgtcgtcaagctgccgccggcgcgggaggctcgccctctatcagcaacgccgagtgccagacggggtccacctcgccgtcggcggcgacggcgagccacgcacccacgtcgttgaagagcgtgtgtagctcgctcgacggtggcggggagacgaggcggtcggcggtcgccaggcacgccgatggccgccacgccgccatccacgagggggcggaagaggagacctggtggggaacgtggggaacgaagggcaaatgtgtccgacaaaaattttctccactccgatctaacaccgttacttcaaaatgtgacggaagtactatagggcgaagaaaaatcggtggcctatgctatggatcgaaagtggaaattttttgtgctattttttggtaccgctttttttcctgtgctatggatcgaattttctctaacttatatttatagaatatgtaacggataatgacttaggtattacgtttccttctatattatggaatggcctaaagtcctggtttgataatattgtagagtagatttagaaaaccgataccgtattggttaagatttctatcttgtaatcatgtcccccccatcctatataaggtgggcaggagaccctctagaggcatgagacacaactagatcgtcagatctataatacacccggcagatttaaatccccaaacaggagtagggtatcacctctcattgagagggcctgaacctgtctaaatcctttgtctccgcatccatccacttttaagtctcgtgcgctacccctttatattgctgaaatattgtttcgacactatgggttaggagaagattgaaaagacatgtaaaacgagataagtcattagcacatgataattaattaagcattatttcttttaaatttcaaaatatattaatatgattttgttaaagcaactgttttataacaaattttgaaaaagaacaccgtttaaccgttcaacaaaagtaggaggaaaaacaagacaaatttcctctcaatttgttgcttccgaatgtagttacttgcattttttttttagaatgaacaatactggagtacttgcatttgaataaggactagggctctaataagtccatgagcttggacaccgtacctctttatcatagtaaatccagcgcaacacaaaataggctaggtcccgcctctgctcataagtcttgactagaatgaatggatgaaattaacattcaagaccaagatcacaaaggccgtcccttctttagtcgattgatgaatatataatataaacatcgatggcacatcttataaatagaaagaatctattacatgccactggctttgtcacatgtctacgatttgccactgactttgtcacgttctacaatatgctatcgacttttgtttaacttctacgatttaccatcgccgtccggttagtctccgttagtactgtacaaatttgtcgaaatgaccaaaatacccctgggacaaaacctttcaaaatttggataaaaattcgaaaatatcatattttaagtttttggctaaattttggatgtttacaatcttatgtttataatatgttattttgataattttatctaaattttggaagtttttgtcctaggggtattttggtcatttggacaaaattgtacagtgctaacagatgctaaccggacggtgatggtaaatcttataagttaagcaaaagtcgatggcatattatagaacgtgaaaaagtcagtggcaaatcatagacgtgtgacaaagttagtggcatataatagattctctcttataaatacgatagcaatatgcagagaaagggggtacgtacgtacgagtacgacttccaactttgtttcaaagtcgtcgatgacgacggccactgcccactagcagggccaagtggtacacacacatatatcgttcgtgcattcgtgcgatatcgccaccgggtccatccgtgcatttgcctcaaaaccccacacacacaagcttcacagtaaccatgcacaattgagcgcatcacttcagggcagtacgtagcaaccggcatagccagaaacaagtcacataggttcatctgtattcagtcactagctgaaagactaggctgaaacaaggttcacaatcccaacgaaaaccagacttctcgaaccggtttgcaataccacaaaccactcggttttttcgtcaatttgtttttttaagaaacaataaaattattcaaattttatcagtttttaccggtttgctaacggttttcatgaaaaatggaaatattgaccgtgagttcttttcagtccgataagaggctttcacagcacacatacttatcgtttagctccaacctgccacattaaagatttcacgctatatctgtctcttctattaccaagtgaagaacgtgaagccaagtaagacatgtgttcctcgttaggattcgccagggcggggcaaggaatggctcatgttgcatgttgggagaggcttagctccatgtgacgcccctataccatgtgcgggttggcaacgatgagccacttgtattatgagaaaagcggattttagacttatgactccagtt

SEQ ID NO: 55841 - DNA, 766 bp, Oryza sativa
tgctgcttttttgtaactagcagatgggttcccacaatccaacatatgtcagagcatgcctgcagatcactgtttctgaacaatttagtaatgctgatacttgttcatatgtttttatcggtgctctagctgaacagtgaaatggtgtccttggttcttggtattgtagctgaacagtttttatctctcttttgttttctgacagacggctattccaatcctaattgggacgaagtttgatgacttcgctcagcttcctcttgagatgcaatggaccatcgttaacgaggtacgtttattaatagtttcttgcaatcaaaatattgttcccccttgcctttctttggttcttggatatgcagccttcagcatctccaatgtttgttagcatagaaagatgagaccttttcttggttctgacgatatgggtttgggctacacatgtttcttttatctcaaacgctgcaaattaaccagataggtcagaactttaatcttgaattagccttttcatggctaccaagtgctaatagcaaatcagaaatattcgaaagccaaccatcccctgaaaactcccattttgaggttcagatttctgaaaactgctactgaatcaaaattttctcatcaaagatttgagcttctttctgtaggccatgaacacgaaatttttttagcttgatcgcatctgcaattaattaagaatacctatgtgaaaacgacaagagagcccaaatcaaacctgaatcgagtcagcatgctacca

SEQ ID NO: 55842 - DNA, 1539 bp, Oryza sativa
ctctccctcctggtgaattagtcaaaaaaaaatcttatcctcaattaccctcgcactttccatcatctctcgtttaatatagaacatttaggtaattttctcttcttatttttctctcacgtctaaaaatgctcttatattaggatagaagtagtacaagtatccctggaggcctggacatatacttagtttgaaacgagggactatgtagattttagttcatttagactttagatgaactgatcgaattaatggtttccccgcaaaaaaaaaaaattaaactgatcgaatggttcgatgagtacccatatctaaaactggtgttaaaaaaacggtgaggattatattacatggatcggttaaactcctactctactatacactgtgacgagggttacagacaacatctcacggtttcctcttctgcccttgcctgcactgcacaagggaagggataacacctcgacaacgacgaactcaacttgatcctttttctttcttttttttttcttttttctttcacctatatgtacatgcaagagctcagttctgctcagccatggccatggccggcctccattaccgggagagaaaggtcaggaggaagacgacgaaggggagggaaggaagggctcgtgtacgtttttttgcctagcattttgtcagtgtaagggtgtagagtcttcagaagtctatgatgggctcgccgacggtgaggttgcgctccaccgtccacggcaggttgaagagcttggccgtgatgaacttgaagatcttgttcacgttgatgttgtgcgtcgagctggagaagaagagggtcgccttcatcgctctcgcgtatgccctggcctgaaatttcagaaaaaaaaaatcctccatcagaaacaagaatacaacggaaaaaaaccttctaacttactgtcctccgactttaagggactgacatatggagcccataactcgtggacccacatgtcagagggcattacatcagaggagtttctttcgaatacaacatgtttttttaacaacagtaaaccaaatgcgaagcatatggttttgtgttctcgaattctttgtcagaattaaacctggtcaaacagtagtttctaggattagttacaaaaacttttcagtgaactgatattcactgtggctgaaaagaaacgcaactacattttcaagcatgagggctcccagtagcacgaggagttattttcggttagttgtgatgtagcttttccttgcttttagcatgtcgagtgattagtgaccatcgatctacattctgtatgttgtaaggcccacagggatcgatgatcgtcgtatggtttggacaagatgcaaacaaatgggcacaaacaaaacagaaattatatccattgcctaataaattttctatcgtttgactcgatcatcccggctgttgttagtggtgactggcgagcctccttccccggagacgaagacgaagacaagacgtgtttgggcctacttaacgaatgctccccctgatcaaccaaggtccactggattcaa

SEQ ID NO: 55843 - DNA, 3924 bp, Oryza sativa
actagtggatcccctttttaaaaaatctgattcttcaaccaatgcaagtataaagggggaaacaaatcctgcatttgtagttcatatgcttgtgcaaattacctgccacatcccaaatgctgaaggcaattcgagctccccgaactgccaaggtcttgtccatcagattcaggcccgtcatctgcaagccgttctgctcctcgtcgtccccaacatacttaacctgcagaatcaattacccaatagattaatttactttttactatctggattgactattctgaattcaagaagaaatgattcttgtgttcgattgctgactcgagtttcagaatttgattgcttcttggttgaaagaggaggaggagatgggagaagttaccatgaagctggtcttgccgatctggcaatcgccgagcaggctgaccttgaggctgacgacgtcctcgacatcggccgcgtcgcggtcggcggcggcagcgtcgtcgtcggcgtccctggggagcggggagaggacggcaccggcggcgacgccctgcggcggcgggccgagcctgcggtagcggccgccgccgccgccggcgcaggaggagcaggcgaggagctggtcccagacgaggcggacgaccctgctgatgacggcgaggcggagcaggcggccccagcggaggtcgagccgcagcacggccggcctgcccctccccctcctcctcccgccgccgcccccaccctgcgcgcagagctgcgtgaccgccttggtcacctccatggctgccgccgtgttcgtcgccgtgttcgtcgccgtcgtcgtcgtcatggcgtctcggccatgcacgcctgggacaaaagaacgcgccacggacgaacacctcccccaccaccgtgttattatcggccgcgggggggaaggcgctaaactaagaatcacgcacgcgcgcacgcgcgtgttcttggctgtctcgtctcgtctctctctctctcgcctggttatagccgaggaggcgccatggatggcatgcttcgatggacagcgtcttgcaatcctctttctcctcgtcttgcctacgtggggggttcttgggttttctcgccgcgcaggcggaggcgggtcggtgtgggtgtcgtttacgggtaggaggagggtgcgcgcgtgggcgaggaggtggtggacgccatgtttttgtgttggtgatggcttgcgtcgcgtctcgcgtcgcgcgcggcgccgtgcgcgcgagagaaatgggaatgggatggggatgaggagaagagaggtgggtggttgacccgtttggcgccgcggtcttgcggagatggacgtgacggctgcgatttttgtccacgtttcgtctccatggggattttttttctttttattttcttattatattattcttattatctttttttttttgagaaactagctttgaccctgccgattcttacgtgcgcttcttcttttcgctgttccgggtcgtcttacatggaggagtccaacacgacggctatggtccatctttttgctgattactccgtatatcagtacttcctctccctctatttctaaatatttaacaccattaactttttatcacatatttgaccgttcgtcttattcaaaaacttttgtgaaatatgtaaaactatatatatacatataagtatatttaacaattaatcaaatgataggaaaaaaaataattacttaaattttttaaataagacgaacggttaaacatatttaaaaaagtcaacagcgtcaaatatttagaaacggagggagtattaccctattcgttgtaaaattttctagaaacccgatacgaacacatatatgtagattctactgatctattaacatgagtgcttagtctaaacatgatcaccctaatacggaattttacgattactgaccgttatttgaaaccaccgttgcgattcttgttgttccctctccaataccatcaaccggagtggaagtagaggatgaagtccctcgaactgctccgtgatcgtcggcgtaagggaagtagtcgtagcagtgagaacgccggttgcggggtagcggcagccttccggttgccacctacactatcctagaaccgccacacgtttcccctccagcgccaatgttgattgggtttagattgagaccgagagagattgtcatctactgttgggccggcctccccttttatatttagcactgtggggaatcgggggcgactcaataggaaataaattgggtgccaccgatcacggcgcatagttaatcgggaattaacagattggatcgctctgattttgcgtagacaacgggtggaaaacggtctagcgtgatctttcaaaccgagagatcaattttcccaacaatatactcgtaacgctacctagctcacttttttttagaattacacagtacaacgcaaacacttaccgatatgaacatatacacacaccatatctttataagcatattaaaaaaactagactagttgacgaagttatatggacatctcgttgttgacaaatacgccgtcttactactaaaaggataaatagccgtaaatacgaatgctcataagtctatgacttaacctgtaaattagagtcaccgtaaatatgccctttccaattcatatagtatttttttatccatatataaaaacacgaggcgtgaaaattactccctataaaaaactgtgcgaatcgtaagataatcttgtctatatataaacataagccatttatattgttccaaccatcaaataattatatgagatagtaatatatatcaaaactgattcgcagccatacaaaaaactacgtccccctgcctctctgtgttgtctggttatgatatacaaacgcaatgcaacaatttatagtgtatgttaaatttatatcgttgctagtacatcggcatgtatcactggtggagaaaccatctttcgtcggtcggccgatttccacaatagtcccggatgcaataaaaaccagggctaaagatgatctttagtcccggttcaaaagggtaacgggcatatttgatctttagtcccggtttgtgttaccaaccgtgacggagtgtgggggctcctcaccgggagaccgcacaggcccccctatgccggttcggccgggggctcagggtgaaatcccaagctctgtctatatgtggaaagatcgcgacctctcgaaagagcatgaaacaccagcgatgtatacaggttcgggccgctgagaagcgtaataccctactcctgtgttttggtggatctgtgtatgaaggagctacaaagtatcagccagcctctccctccttctgggttcccgatctgggaaggtccagtcccaacccaagcctgctctccctatgggcaaggtcctccttttatatttcaaggggataccacatgcacccctctctctcttttgtgtggggacttatcctatcttttcataaatggacggagatttgtatggttgccgtctgaatgaccttctgatgggacagcccacacctacctccacttccgccggaagcaggcgcgacgtgggaacatggctgtctgctgacgatatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaggaggtaacacgccggctccggctagggacgagtgcttggaggctctcgtcctgacgggatggggcgaggcgtgcgtcagaccgcctgtcgccacctaacccacgatctgaccggtctgtgactgatcacagaccggatgaacgagcgcgctgtactgcattacgtgtggcgtgacgtgctcacc

SEQ ID NO: 55844 - DNA, 1925 bp, Oryza sativa
ggcttctgtgccgagacctcggggtcagagggcgacaggcgcggccttcccgcagtggcctcggggccatcctgggggtcgggggcgcctggcaccgtcggacaagcaggcggagggccagctccggccgtcgggggccttgggccgccgttcggctcgggggcctctcctccctgctctctctctctcttcgggcagaatcccggcggtcgcaaatcgcgcgcatcagcaagggaaaaccgaccgacaataaggagcggcccctcggctcgcgtttgccttcaactccaacgaggagtgcggtgacgacggtgcggacgacagcgacggcgaggccggctacccaggcgcgtcggagtgagcccccaggcctccgccaatcttaatagcttttcattcttcttccgaggccttcgggcccccttcttgttataggctgatttaatctgcaatcaaataaagaggaaatttttgtgtcaatttcatttgttctgtgtatgagacgaggatggtctgtgccatagtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattccccccggagttcaccacgccccggggcacagctcggttctgggccccgtttggcgattttagccgacccgagcccccgagggtaggattgagcacgagtgacctatttcaagccaagattcttcaaaaggaaataacagcacagatacagcctttaagaaatcgaaaatgcttttattgaaatacggaagagaaaaaagataagcccccggccaaccctgcacgcccggggggtgtggggttggcccgagcccaagacctgatacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagtttgctcagtccagcacgcgtttggacgcggcgtaggacgaggtcgtcgacgcagagtgatcggacccggacgtggagctgatggtagcgccgcaggctctgctggtagcgcgcggctcgaagggccgcgcgccaccttcgctcttccaagtagccgaggtcagggagcgtcggcttccttctttttgtcgctcgcaggcctcccctttcgggtggcccgcggagcgccctcgacggcgaggacatgaccctcgtcgccggaatggaccgacctcttcttcttcctcctgtcacgctgccctgtctgagcggcggatccgggggcggcagaagctgccactccggaaccggaggggttccaggtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtgttgcggacttggcaaaaccgctgaatgtacgagcgaagtgattcatcatcccctcgctgtactgcgtgcaagtccgcttcttcgcctgggcgcggatatgtgccttgaaagttcatggtgaactgttggcacaaatcctcccaggagtggaccgacgcgggtggcaagttcattagccaaccccgcgcctatcccttcagggccatgggaaagaaattcgccatgaccctgtcatcacccccagtggcctcaatcccagtcgtatagacctggagagactcggtgggaaattgacgctcccgtcat

SEQ ID NO: 55845 - DNA, 2293 bp, Oryza sativa
aactcggtggggttgacgctcccgtcatacttctcagcgatggtgggtcggaaccttgggggccaacggacattccgaagactcgccacaaaggctctacagccgacaccaccagccgggggcacggagggctggtcctcgtgtccatgtcgaggcgacactctggacgaagaggcgccctccgtcgcgtggggagcacgccggtcattacgccggcgctcgatgtcgaggcgggcatccggctctccacgctgatcgtcccgagtcgaaggcgccgacgagggagtagcagccgaatggcgtgcaacagccgccgctcgccgcgccctccgccttgacgacacggagccagtggtagcggcgccggaggtcctggtggtggaggaccgtccaccagcacccaggcgctgctgtgccgtcatgaccaagttggccacgtcgtccagccatcgctgggctggagactccgggtcagggacgacgggcgagtgacgtaggagcgcgccagcagcctgaagcgcgccctggggcgtgctgccgtcgccatagacgaggaggcaacgctccccatctcgccgttctcctccatcgcccgcgatcggtgaagccgcggatctatcgaccctctcgagcgcctccccctgcttaggactttggtgtggaggaggcggtggagtacgagctcgacggcgtgggtttggctccccgtcgtcgccgctcacactcggagagaggtcgtgcgcctttgcttgcccggccattaggctgaacaagaaaaacttggcgcacacagaaaagtgcgagagctcagaaaacacacgctgagccccctacctggcgcgccagatgacggagtgtgggggctcctcaccgggagaccgcacaggcccccctatgccggttcggccgggggctcagggtgaaatcccaagctctgtctatatgtggaaagatcgcgacctctcgaaagagcatgaaacaccagcgatgtatacaggttcgggccgctgagaagcgtaataccctactcatgtgttttggtggatctgtgtatgaaggagctacaaagtatcagccagcctctccctccttctgggttcccgatctgggaaggtccagtcccagcccaagcctgctctccctatgggcaaggtcctccttttatatttcaaggggataccacatgcacccctctctctcttttcataaatggacggagatttgtatggttgccgtctgaatgaccttttatgggacagcccacacctacctccacttccgccggaagcaggcgcgacgtgggaacatggctgtctgctgacgatatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaggaggtaacacgccggctccggctagggacgagtgcttggaggctctcgtcctgacgggatggggcgaggcgtgcgtcagaccgcctgtcgccacctaacccacgatctgaccggtttgtgactgatcacagaccggatgaacgagcgcgctgtactgcattacgtgtggcgtgacgtgctcacccaaaccgcaataaatgcggttaggtgagccccgctgcgctcacctaacccatacacgcggcgcaaaacccacaaggggtcggggcgcctcggccctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggtcccatgtcaccgacagtagcccccggcgttatgccagggcgatcgccctccccgagggaagcggtcgggcgtgacgccacttctaaggcctggtgacaggtggggccggttcctacaggtgccgtcgaactacatcacccaaagggcggtgtgaggcagctgcgatgggctcgagctggcctcgggggcggagacaagctcgggagctggggtccactccaccacaaagtcggcgagggcctggctcttgatcgcgtggcttggttcaaagcgcaaatcgaattcagagagttcgattgcccatttcaccacccgtccagtaccctctcggttatacaagatttggccgaggggataagacgtaaccaccgtgacccgatgcgcc

SEQ ID NO: 55846 - DNA, 758 bp, Oryza sativa
atccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttggtgttaccaaccgggactaaagatcgatctttactcccggttatttcacccgggactaaagatagcgatctttagtcccggattggtactcccggtttggaaaccgggactaaagggggttacgaaccgggactacaaagggtttctccaccagtgtatagtgtatgttaaatttgtgtcataaattggaggggtcataaatttctgccatttaacatagagaattttgtccttatataaatatgagacttgcaatagcaatgcgtgtggtttgcgaaatttctaatgggcgattgatcgccccgcgtgatcacccctcctcacgtgatttccttttttggcaccgcattacttttctattttagtaaatttatgcatctaaagtttatacacctcaagtttacacatctaaagtttatacacctaaagtttagagacccaaagtttataagtcaaaatgcccgattcaaatttgaatttaaatttaaatattttatatatatattatttctatatatctaaagtttacacacctaaagtttatagacccaaagtttttaagtaaaagttt

SEQ ID NO: 55847 - DNA, 759 bp, Oryza sativa
tggtctctacccacaaatcaaaaacaataatacaaagcattgaagataaaaaaaccataactagtacaatcaccgtggatatcattatatcaacaagaaaaaaagaaatcgctaaagagaaactatcaatctccgtgttaaatctctaaatcccgaaaccgcatcaacaagaagctagctactcctccggctcaagatcgcccccatctacagcagatcaacatgaataaagaatgcaatccccctacaaatcgaccagagcagggtgccgtggactggcacgaggacacacacgcgcatgatcttgccgtcgtgcgacggagagaggcggacggggaggagggagaagcgtaccattttggtggccgcggaggggaaagggggagctagggtttcggaggcgctcccttgtctggtcgagacgctgcggcgagtggcggcggggaggggaaggagaaggtctgcggctttatacggctgagctcctggaggctagggcttactggtgggggagagagcgtgtgctgctttgtgggccagaatgcgcatcccatgggccatgggccgtgatgcgttgccttatagttggaataagttcacctgatgtccctcaactttacaccgagtttgtttgtcatcccttatcctcaataccacaaatcttcacccctaaatatacaaaaccgttcaatttatatcccatggcagtatagatgtcttggtttcgctggcgtgacatcttagtggacaaaataaaaa

SEQ ID NO: 55848 - DNA, 762 bp, Oryza sativa
ttagagctgagaagtgcaacaaagatgaaaagtatcaagaagttgaatgaagaaggtttgctgtttgcaatccatttttttatgcattgaaaaatagtttaaacaaagtagttgctggctagctgcggactgcggtcttgttatcgtcttatcctcttatataactagtataaatttagtacaaaaaatgcctagatctgtgaatttgcactttttcactctgacaacccaactagtgctaatttggtctagattccttcatctgtgaaagtgtgaatctgcccttctctgacgagcattttttttttttgagcaaagggcagagccctccatttccattaaagaaacgcatgagttcttacaaaaaaaggagtcttggaaaaccagaggggaagaacccccaggtgctcacaaaagaaacaaaaacaaaacgaaagccagctagcacaggccttagagtttaagctatctctccacaactcatctcatttctctccaattcaccattgtgtcctcaactaccagctaatcttctttgcctgatgcgccatccgaactgcgagttgaagacctcatttgccacttgttttagcagttgtgctccccattgcaaccttccttgtctttcccccgaattctgcaaaacagcccaatccgacaaaaaggaacaagcattgtatataatgtcagttgggttatttggtaagatttgatcaaaacaagccttatttcttgctttccaaatgcccaaattatagcagc

SEQ ID NO: 55849 - DNA, 4920 bp, Oryza sativa
ttcggaatggtcgatcctcagcccacgcaaaccctgccatccaacaggcaaggttaaatggaaagggaggcgagagcatttcgtcgagcgattggtgggcacggctcacctgccgcgtcggaggccggagaggcaacagcaaggaagtggagccgtgccactgcccacccccgacgcttgcgccgagtgcacctacccacgcgccgtcggactaccgaagtaagccgcccgccatccaccggacgactcctcgctccatcccgccatcgccgccttttagaagagagtcccggtgttctctgccagtagaaatctaaatttatatctagttttatttaggataccacctattaataatagaaatatgaaagggcataactgttaaataaaatatgaacgcggaaagctaaatttgtactactcttttgaaaactagcaatgcacaagtaaggatcttctaccctaatgttattatcattacagtcattaatatgtgtgtcatatttttttattgtactacatgtcagtttctgtaatgataataccattatattgcaggatgtgaatccacaatgtatgaacaccatccactcccctcgatcggagccgtcgtcaccgccgccgacgccatccattccttcccaatctccaattgcagtcgccgcctcgttgcttcgtttcctccggacaagggccatggaattggccggcgcatcgccacccacctggtctagtggtcttggtcagagttctgaggttttcttgtcacgcatgtgttagctcctagctaacctgcaaattagaattccactggcctcctcatccgccgtcgtcccgcctctgggccgaacgcgaattacgcacaagcatgcgttgtgtgcgtccgtgtacatgcatggtactaggatagatctggtaaaatctcctaccagaagaaatgaccattgtcaggtgcaggagaagcacagccaaccacaggtcatgttcagaactatctcattttgcaagcctgaaacatgaaaattgaggttgaacaagcatctcgcttacaaatcataccattgaacttgcacaataacatagactacaaacaaagtactaactgattgcaggtactaaactgctattaactgataatacattatctaaagaaaagtaactgataataatctagaccacaaacgactgaggtggtgtttggatacatagactaaactttagtctctatcacattgaatatttagacattaatttggagtattaaacatagattacttacaaaactaattacataaatgagagctaattcgtgtgataaattttttaagcctaattaatctataattagcacatatttactgtagtattacatatgctaattatggattaattaatctcaatagatttgtctcgtgaattagtccagggttatggaatgagtttttgttaatagtctatgtttaacactctaattagtgtcaaacatccgacgtgacatgactaaaaatccgatccaaacagcccctgaatatcctcgaactagctttgcactagcactgggaagccgacgctgaggcagacgtcaggtgggacgccgagacggggaggtcctcaccgttgccgtggtgacgatgtcgccgcagggcctccgccgcagtcatcttatcgcgatgtccttcgccgcgtccgcgtcctcgccactggcctcctccgcgatcggctgactaccactgtcgtaccaagctagcacagccttaccgcctgctagctacatgcgcgggcctggccgcctcgactggcccaaccagcccaatcccttcggctctccgtcgactacctctccgcgctattgttcaaccccctcgccctcaccatgtggaagtccgtcggcgtgtctccacctggtcgatccctccgtgtcaacccccagcagcatcaacctccaccctatcgaggcaggcgcaccttctgtttgaccacgtgcgggaggacaccgcgacaagatgacggccgtggaggctctacggcagcatcgtggacgggaacctaacatggaggtagcagaaatcgaacaaggatcgaaccggaggatggtgatcgaatgatcgataaggtccggagagggcggcggagcaggggcgaaggcaggccagctgacgaagacagtcccggttaactgggctcggccctggctgctgcacagccaccgcggcagatctggggccggcaagcccgcgcccttgaggccttgagtagttgagtcttcttgagtctctcgactcttccgaggacgccgagctgatgagtcttcaccaaatatcttttttttttcttttggagaaaacaacttatatgtccaatatgatataatcatagaactatcatatagtgtaatgtacggaatttcagctcaactcgttataatgaagataaatttattcatgaactggtatcagttttttaaagataggtgacctatgaatttgtatttttttccccttactccttccgtcccccccccaaaaaaaaaaaaacaaaggccaatatggacagacctctctatttctaggttggctcttttttttttttggacggatgcagtatatgttttcaattgaaactagcatggttgcgcgggccagtattattatattttctctcgtataataatatatatatatatatatatatattctcaatgtattatttaaatatattaaattcacaacataattttaaattttgtactacctttacgaaactactaatgtataatattcatattgtattttatatacgtattagttattaattatttgtaatatcaaattttagttatttgtaaattatattcctatatggattctatactcgtctttcattttttttaatttcgaattttcgttatctatatagactctaggctcttcttccaatattatttatttttaattctgatttttattacttctaattgtatttctacgtgtactctaaactcatctttaaatattctttaattttaaattttgaaatttagttatttgtaaattgtatttttatatgaattctaaactctacttttaattttattatgtttattctaaattttatacgtgtactctaaactcatctttcaatattctttaattttaaattttaaaatttagttatttgtaaattgtatttttatatgaattctaaactctacttttaattttattatgtttattctaaattttagttagttttaaattcttatatggactctatattaatgctgaatttctattatttcttaattgtatttctatatagattctagtctactcttccaatatttcttattttttaattccgaatttcaactagttctaaattgtatttctatatagactctgttttttctttttctccgattaatatgagaatttgtaggccatgagagcgaacgtggaggctcctttttctattcctttaataagttaataaatacgattacaacatgctatcgatttcaatgattatttaaaataaaaattaatcatcaaattgagctaaataaaattttatcaaagtaaatactttgtgtccaagtatttttagaaattttcttgaaattatttgagcactagaagtatttttcaaactttagaagatcattttgaggattaatttaatcagagaagtaattaaaactccctctcctttcgggtcagaactggaaaagtatgcttttcgtccctcctccaaccgacctagtcgcctcctctccctcccaaaagtccagccggcttccctcagcccctcctctctctggcgtttgggccccacacccacagtgcgtcgtctttaagctcgggatggagtccttatagcacccgaccccatctccaggcaatccgactcgattcggcctctctattgcttatcctctaaaattgatcacggaaaccaaatccccttgatctcctttcctttttccctcaactaatttcgaaaaatcttgaggatttgggagaatgaagaccctgatcggtgaaccaatccatgtgtactactaacaactaatgtactagtaccactgctctatcttttgctccaacaatacatatatatatataagaccaagcagcccaccccctgcgtgggccacgaatacggagaacaattttactaaaatgatgcaaagcctagatattatttcctggaacgtgagggggctcaattcggctgcgcgctgtaacacgatccatgagcttatggcagacacgaagtgcagcttggcatgcttccaagagacaaagctacagaatatagatgacggtctcgcccactttttaggaggctacaagctcgacaaatttgcctttaagccagcaagaggcacgagaggggggatcctcctcttatggaatagcgcagtctttgacgtccaagaggtccgagtcggccgcttcttgatttcggcgcaagtgacggtcatactcacaggggccacatttctgctcaccggagtttatgggcccacaaggcaccacctcaaaagcgccttccttcggcacatcagaagaataaggcccggccccgaggatggatggcttatccttggagattttaacatgatctatcgagcaagggacaaaaacaacagcaacgtcaaccttgcacgcatgagacgctttcgctcaacaatcgatcgatgtgaactgcatgagattcccttgcaaaataggaagttcacctggagcaatgaacgacgaagggctacacttgttaagttagatcgctacttttgcaacgagacttgggacttggccttcccccaccatgtccttcacgccctacccacagggccttctgaccactgccctctagtcctctccgacccccgatgtccatgtaaaaccgagtgccttc

SEQ ID NO: 55850 - DNA, 4948 bp, Oryza sativa
  unsure (1)..(4948): unsure at all n locations
cgagggcgtttcagacttcaggccaatcagcctaatccacagtatcgctaagatcttctccaagatgcttgcgttgcgactaaggcctcatatgcacagcttgatttcgatcaaccaaagtgccttcataaaagggagaagcatacatgacaacttcctcttcgtgagaaacatgaccagaagataccatcgattgaggcgggcgatgctgctattcaagttagacataactaaggcctttgattcagttcactgggattacctgctagccttgctgcagcgaaggggtttcccaacaaagtggatagattggctgggggctttgctatcaacttccacctcccaagtacttctcaacggcttgccagggcagcggatcaagcacggaaggggccttaggcagggggaccccctatcgccactccttttcatacttgcgattgacccccttcagcgaatccttttcaaggctatagagctcggcgcaatctcaaaaattcgggggagaacaactaggctaaggatctcaatgtacgcagacgacgccatcatcttcattaatcccacccgaggcgatgttacggccttcacggacatcctgcagcacttcggcactgcaactgggctcgtcaccaattttcagaaatcccaagtggcggccatcagatgcggcggcatcgagttgaatgaggttcttgagggcgtccctgtggtgagggcaaatttccccatcaagtacttgggcctccccctagctctgggaagactgcggaaggtggacttgcaacctgtctttgacaaaaaatttccatgaaggggtagcatagggctggagagggataaaaacanntggcagcggcatggatagaacctacgcnactcatcaaatctgtgctaacggcgcaaccaatctaccttctgaccgctctgaaaatcacaaaggaatccctcgagcagctagacaagcagcggcgccgcttcctctgggcaggcacgggtgatattaccggagggaaatgcaaggtcaattggacaaagacgtgcatgccgaccagccaaggaggattgggggtcctaaatctggacaaattcacgagggccttgaggttgagatggctgtggcatgaatggaaggaccagaccaaaccttgggtggggctggagacgccatgtgatgaaatagataggaacctcttcgccgcctcaacaaacataacaataagggacggaaacacggtgcgattttgggagtctgcgtggattggtgggtgaagacccaaagacctcatgccacttgtctttgcgatctcaaaaaacagaggaaaatcccttcggcaaggaaagaaggaggacgcctgggtgcaagatttgaagcttgattcacaatcatctatcacagtcgacctcgtcgaacagctagtcgcactgtgggaagcggtccgaaatgtgcacttagacgttggagaaccggatcagattacttggaagttcacaaacaacgggcactacacggcctcctcggcttaccatgcgcagtgctgcggggcgccgagtacaaacttcaattccttgatttggaaagcctgggcgccggggaaatgcaaatttcatgcttggctcatcattcagaacagagtctggacttcagaccggcttgcgaccaggggatggcagaacaatggttgttgccctctttgccgccgcgagactgagacggcattgcacctcgttgccacttgtagatacaccaagaggatctggcacctcgtctctgcatgggtgggctatcagcagatggacccaacggaatgggaggaagcccggtcagtcaaacagtggtgggagaacattgcaaacacgcctagtgtcccgaaaaaaggacttcgatcgctcattctgttagtcgtctgggaaatttggaaagagaggaatcggcggatttttgatcacaaagaggtggcaacgaacttcctactaatgaaaatcaaagaggaggcgagcctttgggctttagcaggagctaagcggttgcgtgagttaatcctgcactctgtatagtgtactagtgtacagctatagtggttctccgttttccttttacccttaggggtttgtattttctcctgctctattcaatgaaaaggcactctagtgctgttttccgttcaaaaaaaatgtttttcttataactacttatctgatctacgatccaactacaacattctatttgtttgaatctttataacaccaaatccacgcctagatctagcagggaggcggtcggaggcggggtcggcggcgggcgaggtctgtctccgcatcggctggatctggctggtcgacgacacacggcggcgggagctcctatggatgtgacagccggtgctgtgggcgacggaggaagcggctggcggcgatgatgcgacggcgtggaggcacgtgcgacggcgtggaggccctggagaccgcgccagtggtggggagagggggataggaggccacgtcagcggcggaggtggcgccatgcgcgtgcgctggtggctgcggttggccggagaggtagaggctcggccgacagctcgcgacggcagaggtagcaccggcttgccgaaggagttgcggctggcagccgtgcagcgcgagtaggcatggccggcggcgttgaggacggccggcgcgtgatggatgcacagcgggaggtgatgttggcggaggcggagcccggtgaggtggctgcacgcggagactggctggtggggggcgccggtgcagtgtgcccacacaccggcggagtttttgatggcggtggagcaatggagttttcagtggtagattggcaggtggtgaacggcgggtgaaaacttaggacagcctcggccatactgacaatcaatggcgcttaaatgacattcccctcctgagggcattgtcgtgctgtcacaccctaatctggcaccaccgtacaacggcacctgataggagcgtgtcgtaggaaaaacggcgcgaaccgcttcctacgaaaccgcgatcacagtaccagtctcaggacatagcgctggtacccacagtgacaaatatgaaacattgcaatccttaaatttaatagaggacttatttaccttaacttaggttgcagcgcaggacagcctgagaatataaccgacgatgcggacgaggaaacaccaacagcagcagcagcagcggaaccaacgaactaacacccaacaccacaggcgacggctgggaaccaggacgaaaccctaatcttcaattcacttcatcgtcacttcaaggcagaggaactatatatatttatatagagcaagggtgagtactttcgtactcagcaagtcacgggaatttaggtgtttgatgcaagcttggaagagaggcaaggttgttttgcaaatcctttattttgaaatcattttgaaatcactaagtggtttacttctttctaagtttgggccgaaaagagacttgcgtctcgattcgactttaagagatgtttttcaacaactcattaggtaatgtaccgacctcccaggtcagatcattacttctcggctcccagagccatttcacttgattagtcggctcccagagcctttttcattttctgggactcctagagcccagctgcccagcagcacaacaatccgcttccactcgggaagcctagtctatgatgcccgtaaacatcccgaatcacacagattcgtttcttgaccactcaggttatccatctgccacataagctgattctggtaacgattcccaaaccacaacaacttttcacaaagcacagacaaacaaatctacgctacaggaaacacctcacatccgcccatgaccatgggcacggctgttcgaacagttgcggcatatgcagctgcgcaatatacaggcatatgcatgagatcaatctacatgcatacgaggacaaggactagcatgggagaaaaggaaacactacatgcatgcttcgatgcctgctagtaattaattagcacaactaataaccagaacccacagagttttggtctgtactctgtaattgattggatctgtgacttagcagtgttgtgcatatgcctgaccgattgatccgcacgcttcttgccttttgggggtaaaatttgtgcacaccatcggtgaatatattctacgtgttcaattcaaactgttgagaatctcatcgggttgatgatcagatcaaatggatatatatctgtttctgctttatatgagaatgagatagtgcatttggatagtaaagatgggcaataatgagctcatttttttactcagcgcacttctttttcctcaatataatatcaatactgatggtccattttctgctaaaagtatacctcagtagcatggccattaaaattttctttcctttgcaatggactatggcataaacataactgcatagctgcatatgcatgtcttatgaagtaattaaaaataactgatccagccatgaacaacaatgccttatgcgctgccataatttatgatccagcattagatctgagctaggaggtaatatctgaacatcacttctgctatttgatgaacatcatattttcatcatatatactttctttttccagatttcctggtatatattcacatatataaattgtgtagattttagtagatcttttcagttagagcatgaaaaatatcatggtttttagatggctgttgtaggtccaatgcttctcttacaacaaaagaaacctgctatatattcacatatataattgttatagcttcatgaagaagaaatcaaggctgtaggatgacgacgttgctgtgtaagaatcgtgaagaagaaatcaaggctacaggatgatgttgctgtgtaattaagagtcatgagagaacatgttgatataaagggggagaattttcaacaccttgctgcaaaaataaa

SEQ ID NO: 55851 - DNA, 2377 bp, Oryza sativa
ccctggtgtgtcgttggctgtatatttatgcaatcgatttggcctaacaaaataataacgtaatatgatataaaatgtgttcccattgcaacgcatgagtgaaatttcacatggtattcaagaattcaaatttgaaatagtaatatcgatctaaatttgataaaaaaatgtatcaaaatttggtgaaaaatgtcatatagctcagggttggcgtatgacctaaatcgaaaaggtgtacctcggctacaaaggcttagttgtgtctggattatccaaaattaatcatgccatataattcatttaatacttaatatcttttaatttgtaaacaaaatatcatttggtaacaaaatactagctcagtagctctcagggctcatatttatctttgatgaatcatgaaagggctatcggcggggtaaatatcgagctttgaacatgatttcttttgattcccgttgcaatgcacgggcacacaactagtaaaaggtaatatcttgaatgttcttatttatcttaatttattgattgtattgtactttttatgtgattaaaatatataaatataatacgtgccgtgtttggttgtacttatcgagcgaacatatccgccccatcttttttataaagctgcgtccgccactgactagggagagaggaagcctatgcacacgtggctgggtgactggagaggaagcggatgtgcgcgtggcagagagaaagaggaagcagatgcagatctattgggttcgatggcggtggtgggtaaatttacataaaatttgtaaaggtagtgggtctttagctacccaataatatataaaaaaagcatgtttagaggagattgccagattatacttttctagtttatatattatgataatctatcataataatctacttgtttgttttagattattgcgaataattcatattataataatcctaagctgaaaaaaaatactcttagaattaaaacgacaagtaatttaaaatggaggaagtgctacttcaatatgaatatatgttctaccctaaaaaaaatgaatatatgttcgatgcccagacctgtgtgctgcaaagattaattttgctaactacgaaatcatcatctattcatcgcgagcactcgttgatgcattgtgggctgtgcgacgacgaggacgacgtgttcgtccgcgtcagcgaagccttggttgtttcgcctgccataccgtctgattgacaagcgccgccatccctgcattgcgatgcagctgttccgtcgccgtcgccggccacgccgtcctcgtcgtcgtcgtcgaagagttctccgccttggacgtacacgccggcgagcctcccgacggcgagctccatcctgaccttgttcctggcgtcggaacgcagccaccctgtcaccacctccgccgccgccctgcaccgccgccgccgccacggccacggcgccgcccagcaccaccgcgccgccttcttctccgcctcgacggccgcctccatctccccgacgaggtcctccagctcgttcgtcgccccgtccagccgcagcttccactccaaccgcgccacccgcacgtcggggtcgtcgtcgtcgccgccctcgccgcgcccgccgccgccgagcgggagcgcgcggagctgcgcctccacgatgtccagcgccagcagcgcggactcgtacctggcgtagtcgtcgccgaggaaggcgcgcagcttcctcgccgccgccgcgatcgcggcggacaccagcgcgccgaggtcgtcgcccggcggagaaggagaaggagaagccatgtcgctccggtcgctcgtccgtcgtcgcggcaaaccacctgccgattccggccttgactttgatttatagcagcggcatatgcaggggtgagtgcacgtgcacctgcgcgcgtgcacgtagtacgtgtccgagctggttgctgatgtgatccacttccaccatgtttcggactcgatgatgggccgcgcgaggggggcggagtagtgggcttgatgggctgcgcgctacagattgggctggcttggtgcgcgttgtgagaggcccagttcggcttaggttctatctatcgaataagatcactttgggtccctctatttgtcgcccagtccgattttcgtcccttgaccacaaaacccgggtatgacccgtcccccaacttacgaaaaccgggtaaacgtggtccctcggcggttttgaaggtggttttggctgacgtggcgtctacgtggcttgtttgacttggttttcgtcccacgtgccattgacgtggcgcttacgtggcaattatatctcggaaaaataataaaaagcgtggccccacatgtcagctgcacaaacaaaaatagtttttaaatggtgggg

SEQ ID NO: 55852 - DNA, 8432 bp, Oryza sativa
ccgcctccctcatcgcccggccgtcgtgcaccgctccgcccatcgcccccgctgcgccgccgctcaccactgtaagggagagagagggggatagagagtagagggggctgacatgtgggaccacaggggccccaccttttcttattatttttgtgtagctgacatgtaggtcccacatttttttattattttcttaagatcctattgccacgtaagcgccacgtcaatgccacgtgggacaagaccaagtcaaagggaaccacgtaggcgccacatcatccaaaaccgggcacaatactgtcaagggaccttttttgcatggttttgtaagttgagagacccgtcatacccggttttgcgaccgagggacgaaaatcggactgggcgacaaatagagggacctaatgtgaatttattcctctatctattccccgggaagggttttttttattaattaccaggaaaaaaatacccgtgtgttgtaacgggtgaaggttattttaatcttattattgttatacggtttagttaaggtgaaattcactatgggaattcgcctggatatatactttttttagaaaatcatgatcaatttagcatgcgattaggagtccaatcgtctcaatttagcatgcgaattttttttaagagatttcttatacgactcctatattttcaaaagcgaacggatttaaaaactgactcaaatacgaacatgtatttgcaaaagtgaacgaacttaaaaaccgactcatacacggatgacgtaccaaattacctgtaaaaacatttttaatttttataatagtagagatttcggcgatttttttggtctgtgattcgaattgtaatatgttgttactcctccgttttatatcatattagttttgacttttttcacgtttaatcaagtttatagaaaaatttagcaatatctgcagcaccatatattagtttagataaatgtaatattgaatagtatattttaggcaatatatttgttttatgttaaaaatattgctatatttttatacaaacttaattaatcttaaaaaattctaaaaatattaaaacaatttatataatatgaaacggaggaagtgattatttaattaattaatcccctcttaagtaagcagcggcgaagccatacaaaagtagtaactaaggctgtgttctttgctcagtgttctccaacccctctctctctcgtattcctcgcgcacgctttttaaactgttaaatggtgcgttttttttaagaaaaagttcctatacaaaagttgcataaaaaattatattgatcatttttttttagaaaaaaggctaatacttaattaatcacgcgctaatggatcgttccgtttttcgtgcggatggaatgagttcccaacctacatgaacaaacgcagcctaagttttgtctaaaatggagtgatcgaatagtactactagttattctgaaattttctgaaatgaaattcgaataaagtttcaataatgaaatgggcgttattagcagtactccactaccgcttgccatgcacgaacggtgcttctacgtactactagcctttacactttccacttctcaagttttcaccctcgtccctcagacttgatgaattttttttagaaataatattattttaatagaaaaatataaaagtagaagctgatcggctaaaattacaagtttaatgccttgtcgaacatccacagttcaacaggggtacatacagaggcgggcccagagggtagtccaggtaggcccaggactaccctagaatttggcccagaaaggagcatatattcattttttatggcccataaacaaagtctggcccaacaaaaaaccctaactttcctactagcctcctcccggactcccagtcacacgcgcatgcgccgtcgctccgacgcctgatgccgccgccaccgctcccgtgtcccgtgaggccgcgacggcgcaacggcgctctgcccctcgcgcggcggccagccggcccccttcccgagtcctgacggcgccgcgacggtgcactgcccctcgcgccggcggccggcctgctcgccttcccgagtcccgacagcgccgtgacagtgcagcggagctctgcccctcgcgccggcggccggcctgcccgccttcccgagtcccaactcgcgccatcgcggtcgcaccgcctcctgcctcctcgacgcgcatcggcgcgcgcgccctacctcggccgccggcacccgccgcccggccggcatcccacatccggcggccctccccctccggtgagcactgcgccactgcttctctggcagtccggctctcctctccctcagtccctctactctcccccttccagtagtcagcaggcagtactacctccttctataatcaagttctttatatccatgattagctaattggggatatagtaatttgtatagattaccacgaaattgtgcgccgcaatgaacctcatatggcatttttgcatggtgtgatggttgttaggagattgaggaatgaagaagtcgagcattgtatttctttttcagaagcatgaagcaaaaaaagttgcatcttgtgatctaccaatcccacctatttgttattttctacttgtattgaaccatttagagttatatacccgtatcgtttaccagattttatatcgaatcatgatgtattgcatttagatttttttcgctaggcctaccctgggttcaaatcctgggtccgccactaggtacatatcgaacaaccacaattcgacagagtacttgttgaactgcggttgtttaacagggaataaaaaaatatcttaccgaactgcccctgttcgacaggggataaaaagtgatagaaaaaaaaggagatcaatcagtgcgcactgtacactaccgtgcatgcagatctatgttcgataggcccctgccatgctctttattgtcccttttctattttttaagtgaacaacaatcctgtcgaacaactgcagttcgacaggtacatgtcgagctgttcgacaggtgttaaatttgtaattttagccgatcaatttctacttttacaatttttctattaaaataatattattttaaaaaattctaaggtgtccatcttcttcttctttttttttcacagttcaaggtgtccgtcttgggaaactattctaatccctcgaggggatgttccctcgtttgctcaaaaaccatctaaacaattatgaaaaattttggaaaaatttgacaacattcatacaacacatatatataactccacaaaatcttaagtccaaactcaactcacacgtcgagatataaaaaagacaaattcagcatatgaatagtagcgtactgtttatatataaatttatcttttttgtttctcaatgtgtagatcgaatttgaacatgaattttggtggactagtaggtatcattatactctacattgtcaatttttttcagaatttttcacaactatttgcatcgaatttagaagaaaaagatatacgagggatgtcccatcgagggattagaatccactcccgtccgtcttggcaagtaattaaaccgtactccacacgtggcaatgtttggaattaccatagcgccatgcatgcaagggcgcccaagtcgtctccactaactctacgtgaaaaccaaataacgcaacgaatgtgatgcgattaaaaacgacagcaatctgctcgtgcaatttaattaattaacgagattgatcaattgatcgttgcttcttctaggcagagtgtatatatattaatggtccatgtggagcaacttgaactgcaattggtaattaagatcaataaaaccatcgccttctgaggacaagtctaataaaagagtaattaagcagccatctattagatgcttacatgttatttttatataattaaagataatataaaaattaaccgagccattattttttttctcgacgtgggccaagccttggttctctctcgtaggctatctaccaatcacagatgatcttttcatgtgggcccaccttaattatctctcacctaatttttttcaccaatcaatttagtcgaccccttctctatctccactccctctttcttctagcaatgcaaaataagttgatatcaacggctaatagtaggcatattttccctattacacttgccctaacagatcaggataattttctaacggagaaaatacgtcaaaaattttattttttgagcgaatagaaaaattaatacgtcaaatttgtgactgataccgacaagtgactactgatattttatgctaaggccagctatagcaggaaacagctagagagagaagaattctcgtcgcatacgacattggaaatgaaatggaataatggaagaagctccgcaggttcatgggattgatgactaccagagaggcacggaaacaccaccggttcttgctgttgaattccaagcacatgctttctagaattccagaaccccatgagagcccagttaagttgagttgatctcgacgacgacgacgacttctgttgatcgagataaaacggttgggagatattccgagattgagtagtattcaaagctattgatatgctgatttttcgtctttgaccaccttgggttacttggaaaagtattggggtttcatctactagctaggttgtttgttttagtaggagtagtactgtagtagctaacttggtggctacgcagggcatatatgcatgttgctagaagatgattagtgtgtacacacgttttaacgaaattaattgtgcaaattaacgaagatcatcacttcattagtactccagtagtttataatcaatagagtaactattggtttctaacgagacaaaatactcaatgttttaaagcaaagagagtactgtattatattttctctcgttgaaaaacagtcacaaagttgtttttgatgcgctcacgtgacacgtgtgcactttgcatcccgttcgttgtatccgaaaccctctgaacacgcatcatgtctggaacaatcattgactaatctttccgattaccttggggatcaccacccgcgtagccgcctagctctgaaccccagcagtagttgaatcgagtcattgctttatgatgcactgccgtcatctatgtatcttttagggtggtcaaagtaaacaagttctgtcgttgaataaatatatactgctgtccagttaactgtaatccttccgtttcagattataagtcgttttaactttggtcaaagttaaactactttaaattcaactacatataataacctagaaccagataagacgtatcccagtacttgcatattcgtagtactagaatacgttctatccgattctagtttgctatattttgggatggagggaatataacctaggtacacagccaatggataattgacaaaaagaatcctataaataagaagaaaatgtatctaccggaaaacatatcatttctaaatagtcactgctaaaaaacgattttccaagaggccaaaagtggttttcgcgtgcggacctccggtccgtctacccgaaaaggtctgcgaaaatccaaattttccgtgcaagtggcacacccgcacgcgaaaattagtttttcgcgtgttgatgcttatgttgcccgcacgcgaaaacaaaaatacgaaaaaaaataaaaatcgcaaaaattgagctgctgtcgtcctcccgctgccaccgacaggctcctctcgccgccgcggccgtgctcctcccgacaccgccgcccactggatctgcatgggggatagccggcagcccgttgcccaccaccgcgcgccccatgctgccttcgtcgctctcctgttggctgccgcgcgcgccagcctctacagccgtcaccccacgccacccttcctgataacaatctggcccaggtggggtcggccgaggcccaacaaattaaggttgcccggaccccaacaattctttggcacacccactcggggaaaggcccaatctccctaaaagactagttcaataggggaagggtggctctcccttttaaggtggcttcctcctcccaagctaagtaaggtgggattattcagttcagaggctcacacggtcgccgcccgactttgtcgtctttgccagtggataatagtggaggatgtcctcatcacttctgccggccactgcgtgcctctgccgccgtcaccccacgccaccttcaccgtccttccgccggccgctgcgcgccagcctcttctgccgtcacccctcgtcgcctgcactgcccttccgccggccgccgccactctcccggctaggagagtttgagagagggagagagagagagagaaagaggagaaagtaagagacaaatgagagtggggataaggatgagtaggtgagagagatggagaggataaggatgaaaattttgaagtgatgggaggaaaaaatctagagaggagggagggtattttcgcgtgcggttctctcaagaggtccgcatgcgaaaattcaattttgtgtgcagccctttaagatatctgcctgtaaaaataggctaatttttgtgtgcatacccttaagagacccgcttgcaaaaatcgaatttcacgtgcggttctcttaagggtccacacgtaaaaatgggaggacgatttttgtagacccgaccagttacggttcgtctgcaatataaagaggtccttgtacaagaaaatcatttctgtagtagtgaaccattgcgacaattagctagcggtttctcaacatgaagatgtggtttgaaatcattgtgaacattcgaaagccacccagtaaacaaaaacgtgagacattggttggggggggggggggaatagattcctcaatctatcatcgtcgttggcgaaaggaggaatagatgggtgtggctcactactgttcgtccgatctaacaagagaaagacccttttttgcagtgacgactggggatcgagatcgaggccttcagctgtgaacgccagccgtcaaagtgagagctgaaataattcaacacttttgatggtgtggccaaacatacagcaaacgtacgttagttagctagccagtattacaaaatacatttcggtcgctttcaagttaattaatttcaacggtgaatatatagcttattccgtggagtctagctagtgtgaagaagtaatagcttttccatacgttgacaagtctccagctattcttcttccttcattgttgctaaattataggagccatttctagaagcagaccctggaaaattggacttagaatagcgtgtattgagaatatatggcatgcctgttagataagttaggttttatctagtcatgtgtccccggcatcttcttaattcttatctttatctaaaaaaaaccttcttaattcttatattaattatattgttgtatgcaaaacagcataggtcttgactgaagaaactaagaaagaaaacctgacctagtttcaacagatttatttttttttgaaaaaaaaatggtcatgcatgactgatcaacggccaagatagaagtgtacgttcagtacgtacatgcaagctagttaagcttaattactcgctatatatgaactctagaaaaaaatagttaatatcaagagtcaaaattttgattacgtcccaagcatccagaatagtagaaacaatctacaagctagctcttgtaattaattaaaagcaccattctagaaggtcaaaattaattaagaacagcggattcccctacacacacgttcttaactactattaactccaagatgcgcgggatggatggtttatctagagcatggattcataaatttttgtgtacgtaatctcgtatattacgacatctttcaaagctagatgtactataagtaagatcgatctctgactcatgaggttttcattatgaatttaacatatgcattaataattaattaatgcactaccacagtttaagcaataacatcacgtatttttataaaattatttggcgagataaatccagcaatatatcattcagtagtccatcacaactaagtactatccccgattttaataattggtgtcgttgacttttaaacgaacctttgatcatatcgtattattcaaaataataaattgtattattatttattttgttgtgagttgagttatcattaaatgtgctttaaacatgatttatatttttcatatttacattgattacattgaacgagacgaatgatcaaattcatgttcaaaagttaactgcgtcaacgatcggcattccttgcatttccaatatcatcaaaacatctttctcatgctactcctagtccttggcactcacctcctgtaaatcattctaattaaccactgaaccttcctacgtcgcctcgagccaattaattataattcaattgatttgatca

SEQ ID NO: 55853 - DNA, 1375 bp, Oryza sativa
cggtcagaacgaacgcctcgccgccgtcgatcgccggcgggccggaactatctcgcaaagtaatcgatcgaaggtatcaaaagcatcatctgagctgagctgagcggcggcgcgatggcgggggagataaccccgtcggggagccggcggagctggctgtcgtcgggggcggcgtcgctggcgcggtcgctgcgcgacggggacgacccgttccggcggtcggcggcggcgagccggcgcgacgccggggacgacgaggagaacctgcggtgggcggcgctggagaagctgccgacgtacgaccgcatgcgccgcggcatcctccgcaaggcggtggacggcggcggcgacggcgagggggccgggtcgctgttcaaggccgacgaggtggacatcgccaacctcgacccgcgcgagggccgcgagctcatggagcgcgtcttcaaggccgtcgaggacgacaacgagcgcttcctccgccgcttccgcgaccgcctcgaccagtaagcataaaaacttttcttcttcttctcagagaccatatttacgtgaggactgtggaggggatacgagcgggtcaactcacgaacccgtttataggcaaaatgagtggataacccgctggctggcttgcgggttacctactaatttgatatataaatgggtttatagttgatccacttgcttctctatgacgcggcaagctgagtcatgacacgaaaacccgtagattactctttatttaacatataagtaaattcgtgagtcggcccgcttgcatccctgtgaattttaactatttgaatcaaaatttattgtgaatttgcttcgttgatttgtagggttgggattgagctgccgaagatcgaggtgaggtaccagcatctggacatcgaggcggacgtgcacgtcggcaagcgcgcgctgcccacgctgctcaacgccaccatcaacacgctagaggtatatacacatgtacatcgctcagctcagctcagctctctagtgtgatcactcaacaagttggatgtgaagatcagtggcgccttaatacttaatttggggcgtacgatggattttactgaaattttaaagggattaattaagaaaactgaagggtatgaaaacatttttgtctcttaaaaaaaaagtcattggatgaagccactagataagtacatcaatcgaaacaagtcaagcatgcgcagtacaaaaatcaagaccattttattgtccgactctggagagagagattagcttaatttggagctagtagattcttgtacgatgtccactagcttagctcacgtatgactgtggggtccaccgtagaatcttgataaatagtaatgcgtaaaacggccggtcgcgggtt

SEQ ID NO: 55854 - DNA, 712 bp, Oryza sativa
agtttctggtctgggtttagttttcgcgtctacgcttacgcaaacgacaccacacgtacacacaccggccggcagaaaagtttatgagatttccatatatatatatatacagtacttgccaatctcggttggtatagtacatgtactaagatcacggaaggaaagggtgtcaaagtcaaacacatgatgatttccccttgaaacttgaaagtgcacgagcaaaaatttcaaaacaaaacaaaacaaaacaaaaacgtgcacgaacacgaagatgtgggcttttaccaaaagccactggttgaggcctttccaccggcctatatagcggcccacttcttcgcgagcccaggcccatcagaagagaagtcggcccacaaatggtggaccttgggcctcgcctgccgctctggactctccctcctcgagcgggcgatgggcgatggcggcggaagcatcccgcttccgtcgccggctcgccgccgctgcggcggaggaacggcgagggcggcgcttgtcggccacgcgcggtcagtggtggtgcggcctctgcagctctgctcccccatgcgtcggtccgcctcgccttcgcctcctccagtaggagccgtcggttcgtgtgtttctccccccattccgctctcgatccgttcccttctccatgcgggaggggggaggggggggggccggttgctgacgccgtagaggcagacgg

SEQ ID NO: 55855 - DNA, 1252 bp, Oryza sativa
aaaggaatggtttgatgagcttttccgccgatcattctttcagcccacaatctggaaaaataggtacatcatgcctgatatgattagaaagccattatgttccattgctggaaaagaatgccatgctgctagtgagttgggagaacagaaaagacggctccaagattaccgccacctagccatcagttttcctgattttaatgtgcacctagacttgagaaaggacaacaagttgcggaccattttgctttttgatggtcgcaaaacaatcaaaccacacgaagcatttgctaatattctgtcacacctaagtggcctgcgagtattagatttctcttacagtgaagctaaattggagaaggctcctgatttcattaacaaattcacacacctaaggtttctggatctctcctttactgggatgacagtacttccagactccctctgtaagctgcacctactacaagttcttggattacgaggatgtcagttcaaggagttacctagagctataaatgagttagtgaacctccggttcttatatgcagaagctcacacggtttccttgatatacaagatagggaagcttactaatctccaagggttagatgaatttcttgttggtagaatggatgggcacaaaataacagaactaaagaacctgaatgaaatcagtggacaactatgtattggaaatctggacaaagtagcaagcacagatgtagtgagtgatgctgaattattcaaaaaaaggcacttaaagaagttggtattcagatgggggttgacagcatgcaaaccattagccgaagctgatggtttcatgagaactcttgctggcttaaaaccaaatacaaatcttgaagaactgaaaattcagtgctacatgggagttggatttccatcatggatggcggaagagcagtacttcatcaatctgcggcgcatccatcttattgaatgcaaacaattattaacacttccacctcttggacagctcccatcccttgtagttttaattcttcaaggcctaacagcaattgagaaaattggatatgaattttgtggaaaaggatacagggtatttccatctcttaaggaggtgacatttcttgatatgccaaattggaggaagtggtcaggcatagaagaactacaagatttgcaaattcctccatttccacagcttagaaaggtccaaatcaagaattgtgaggtcttaattgggcatgccagtaaaattgtttaaaag

SEQ ID NO: 55856 - DNA, 1550 bp, Oryza sativa
acttctaatattccttattttttaattccaaatttctattttttttcttaattgtatttctataaggactctatactctacttctaatatttcttatttttaattccgaatttcggttatttcctaattgtatttctatatgtactctatactctacttctaatattccttatttttaatttcgaatttcagttatttcctaattgtatttctatatggactctagtctccacttctaatattccttattttttaattccgaatttcaactatttctaaattgtatttctatatggactctagtctcctcttttaatatttcttttttttaattccgaatttcagctatttctaaattgtatttctatatagattctgctttttctttttctccgattaatgtgagaatttctagatcatgagagcgaacgtgaaggctccttttttttttccgaattttagttagtttgaaattcctatatggactctatactctacttctaatatttcttatttttaattccgaatttctatttttttttcttaattgtatttctatatggactctatgctctacttctaatattccttatttttaattccgaatttcagttatttcctaattgtatttctatatggactctatactctacttctaatattccttatttttaattccgaatttcaattatttcctaattgtatttctatatggactctatactctacttctaatattccttatttttaattccgaatttcaactatttcctaattgtatttctatatggactctatactcctattctaatatttctttttttaattccgaatttcagctatttctaaagtgtatttctatatggactctagtctcctcttctaatattccttatttttaattctgaatttcagctatttctaaattgtatttctatatgaactctgtttttttctttttcttcgattaatgtgagaatttctaggccatgggagcgaacgtagaggctccttttttttttccgaattttagttagttttaaattcctatatggactctatactctacttctaatatttcttattttttaattctgaatttctattttttcttaattgtatttctatatggactttatactctacttctaatattccttatttttaattcagaatttctattatttcctaattgtatttctatatggactctatactctacttctaatattctttatttttaattccgaatttctattatttcctaattgtatttctatatggactctatactcctcttctaatattccttattttttaattccaaatttcaactatttctaaagtgtatttctatatgaactctagtcttctcttctaatattccttattttttaattccgaatttcagctatttctaaattgtatttctatatggactctgtttttttttctccgattaatgtgagaatttctaagccatgagagtaaacgtggaggctcttttttctattcctttaattttataatagatttaggagtgtaatatt

SEQ ID NO: 55857 - DNA, 913 bp, Oryza sativa
tttcaggtcagtgctttgacacagctgaaattgagccctaaaagcaggtgcaataccagggacctaaccaaggtaattaattaagttcaatcaataatcagttggtgttttattgaaaagatactattataaattgtccatccatttttttcaggtttctagaaaagtagtaaaaatattgtcttgttttaacatcctgtctcttttttttttccttgaaggaagttgggattggagatgatcgtggaagagaggggatggactatgcagatgcaatggtagagggggtgaggtttgttgatcaaagtcagaagagtgtaactccatgtggagagctaaaggataaggggctttgtttgtttcctttgtccatgttgctacactaccatggatgaaaatttgagaacttcaatgtagagcacgtgtagggtttatgccttacatgaatgtgtgtgggataaatgaccaaaaaatatagtgtgctgagattactgtggatatattttttgggtgaaaatatatgtgaatatatattaccgctcctgctctccttgtttcatttttttttccattttgttttacttaccactagttatgctctgtgcgtgcagtttattttattagatatctatatggatgctcctaaaagcaacaatatatatagatggttacaaatggtacaaaattgtcatggttatttacatggtgttttgagatgttgtgcagtacaaattaatgaattaaggtgagttgctctcctgctgtcctgcacatatatagctatacaggtaagttccaacgattgatcagaggccatgtaacttagtaagacattagtattaattagtatattcacaattcacaaatgagtgaatgactaacacatgagttacagaacatgtcaatgctctac

SEQ ID NO: 55858 - DNA, 706 bp, Oryza sativa
tggataacctggttttagacttcagaccttgataattttctttgcaagctttcagcacttcgaactctgtgtctccacaagatcgatgtgatctctcttcaccaagagaagtggcttgagcagattacatccctacaagagcttgagttctcttgttgctacctgctaaggcagctcccatcaaacttggtcactctgtcatccctgaagaagttaaatatgcagtcatgtttccaaattcactcgctaccattgaaaggcctaccaggtaacctaagagagttacaaatattaggatgctcacctatactagaggcacgatgccagaaggaagatggagagacatgggtgaagaagaagagaggggaatggcataaagagacgataaacgagtaccgacagaagaaaacatgtgagttctgggaagggtggttaaagtatgaggaagagtgggtggagagtgctacagatcatctgaacgataagggagagtggttagagaatgaagaagaggactggctgaagaataattcagatgaactggaaaataatgaagatgtgtggctcaagagtaggggcgaagactggccaaagattgctcatattccttatatccgtgtgaatggagatattatacagaatttttatctgtgaaacttcagcgtgcagctttccgaaatctgtgtaaaggtattcttgtgtagaa

SEQ ID NO: 55859 - DNA, 6663 bp, Oryza sativa
ctattcaggataccacagcccctgctgtgcatctgtgccgctatttatcagctgctcaagttcaatgcatacataaattgtgtttacaataggagcttgggaagtgaaatgaatgttcaggtaatgtccctatcgaacgaccaccgaaaccatcatcattcatcaccaatcatgagatccactccccgatttgctacggttgtgggcagcaaaacgaaggaaaccaacggcctcaccggctcgcctcgcctgtgcggtcaccatcaccggctcaatctgccattctgccgcctccaattctccaagaacttaaggcctttggggctccacgttgaagtcggatgtgtttccttgcagctagtacgatgtattgctgctagtatctactcctagttcacaggccgtgctgctgattttctgatggactcacgaagtcgcacacgtacgagtgcacgttagagacgcccgtccaagggctatattgcttgatggactcatagctgtgggctgttcagatgagtaacccatttccacccatcgtgccaagatcatgtgccggcccgactgcgatggcgacacacaattgtcgattgcctaccacaaacagctagatcttgaagaagaagaaaacgacgagatttttttttggcatctcgactgcgcccgctaagccgtgacgttgatcgtgatgaaaacttgacatgtcgagacccagagacagctaaccactataattgctgtaggtggcccgtattctcgcctcgcaacaaacgcacccacacatggatctcctccggcgagtcgccgtggtagccgtgctcctgtcgctgccgtcgcgtggccgctccggcggcggcggcagcgatctgcacccggtcgtgctcgtgccggggtacgggtccaaccggctctacgcgcggctgactgcggcgtacgagccggcggcgcctcgctgcggcgcgcgagaggggaaggatgagtggttccagctgtggccgatcgacgcggcggcgagcgaacccgcccaggccccctgcctcgccgagaagatgagcctcgtctacgaccccgtcgccgacgactaccgcaacgtcgccggcgtcgtcaccagggtcccctccttcgcctccacccgcgccttggttgggtgagtatcactgtgtcacgctgtcactgtgtcagagtatgtcttacgtcgtactaacaatcgtacgcacgtgtatcaatgcccgtgcatcaccaggtagatactcctagatagatgggcagccaaaatttatcggaattgctagaaaacttgcgacagttttctccaaagaaaacagtcgaatttgcagcccttagatccgctccgtgattcatgcgggcaagaaggaagaaaacagctaaaaatattgtcatagacaggagtcgaaccaaggccctccccttaaaaaggacagcataacaaccactaagctagctcaagtatacgttgaatgtgaaattacattttggttacattttacttacgctttaattaactacacaattagtcccctgttttcatctaatttttggataatcttgttatatttcactctcttacgggcttgctagcaatgacgtcgctgttggatgcaaaggctaaaaaagtttgaatgtttggtacctagtttctgtcgaacgtcctatacgtattcacgtgttttaatctacttacatagcacttacactctagttacatagtagttacgtagcacttacatcctagttatatagtagttacatagcacttatatcccagttatatagtagttatatgatagttatagggtaattacattatataaaattaggatttacaatttttttaagatcatgcatattacttttgaattatttttcccttatatatgttgaacaaattcttaccgttgaatcaacctaggcataagattagtggtttgtacttgtgtggacccgtttcaacagatcctatggttgaaaaatttgaaagttttgagtctcaaaaactgtcaacaactcactagctacttccaaatttatttactatttatttattcttgtctgactggcaggtgggacccactggtgcggcagctggaggcgatgggccaccgcgacggcgggagcctcttcgccgcgccctacgacttccgctacgcggtggcgccgcggggccacccgtcggcggtgggcgagcgctacttcgctcgcctcacgcgcctcatcgagagggcgagccggctcaacggcgggcggcctgccgtcgtggtggcgcacagcttcggctgcgcgctcacgtaccagttcctgcgcgcccgcccgctcgcctggcgccaacgcttcgtcaagcacgccgtcctcctggccgccgcgctcggcggcttcgcggaggggatggacggcctcgcctccggcgccggctccggcctccccaacctcgcgccgccggcgagggccaggcttgcgcggagccagcagagcgcgctctggcgcctgccgacgccgatggtgttcggtgaccggccggtggtggtgaccaagaactcgacctactccgccaacaacatcaccgagttcctcgacgccatcggcttcacggaaggggtccagccgtacgtgacacgggtgctgccgatgtggcgggcgctcccggcgccgatggtgccggtgacaagcatgtacggggtcggtgtcaggacgccggagacgttcgtctacggcgaagctgggttcgaggggacaccggaggtggtgtacggcgacggcgacgggaacatgaacattgtgagcctgatggctgcggaggagtggtctggggtggaaggccaaatcttgaaggtggtcaggttgccaggtgttagtcacgttggcttcttcagcgatcttgctctcaagaaagtagttgctgaaatacagaaggcagttagcagcatagaggtacacaggaaagagaaaatcttctcttttctgaataattttgaatttacaattcctgtgccactaggatggtgatgtccatatgtcattactgatccgtgcaaataaataatagcaataattttggctgctgtaagtaggcaatttatgggtgactagaaatgatatgattttttttagataagttagtttggtacccctctaactatggttgattgtcggggtctttactgtaacagtgaaggatgttgatgaagccgaaagatgcacgctaaggctggggctctttgatctcggtattgcttgaagctgctgagaacttgcactccgaggtgggaatggaatgatgctggcttaccttgcgaaggattctgatcttagtgttacctatagtgtgactgtatttagtttctggtgttgctgcttagttgtctaggtaggctagttgcttaagaacctcctgtcttttgggtgacctatgtgcccatggtgcttaataggtaaagctggttttgcctaggtgggacttatgtttctgtgagaatgactaaagtttagtccctccttcccaaacactaccctagtatccatcttttttgctttctaaaaaaacagggctatgtaagagaactcttttaatcacttgaattaacatccacacgtttattacatattaattagttatgatttttaaaaaatatcaagataaattaatatgtaatatatcacttcacaaatatatacaggttcaaatttccaacttatacaagctataaaaataataaatttaactataaatgtatatatactacctagagtttaatttgttactttttataactagtcgtcagagtacggaactcctttaacaggaagctatgcgctccctaggtgagtttagctagggtgcaagtttcaagctcaagtcatgatcctgcgaagggaataaacacaagcatgtatacatattcggctcgtacggatacgtaataccctattcatgtatggtggacgatggatggtgaagaggattacaagtaagatatgaaagattctaagtgagaaggagaagatctttgctcgcacggtgtttggctagtctagaaatgtgaacccttttcacggtggtatggatcctccttttatacattaagtggagtccacaatactattgcacgcatgcaggagtgggtctcacttctctaaacttaatatacttactcttgttgttgtcacttcaagccagttggccagatgtgacgaccacagctactgattgacaaatggagtagaaaggcaaaagtctttgttccaacttccacgggtccacgtgttagcaacaatagtccacaacggtgcccccgaagggaggatgttgaggacacaccacgtcgtacgtctcgttctcttcgggacgatgtgcatgcaaggcactacatgcacagccacatctcctatatttgtggatgagctgtgcaccgagtttgtaccaccccataatcaatgtaatgtgatgatttaaaagtaaccacggtactaagtcaactctccttaatagggtaacccctctaaggagagcctagggcgtcctcaggaccctaattagcttgcttatttgtgtagtgatgtattatatattaatatatcatgtcattttagaaaaaaaaagatagaaatgtaggatatgtacatatactagttaaaatttaatttattatttttgttacaacttgtagaagtcgaattttaatttgcatatttataaagtgatatgttgcatattagtctattttatcaaaattttattattaatttattatcatttaatcgatatgtgataaacaagtggacatccattcaggtgattagagtccctcttcgggctataaacctttcctcttaaaaaaaggtaggatattttagtttgctaccgtatagaatctttgccaaaattctggcaagacaaggtggtctggtcagatactcagatagcaaaggccacaaagctccattggaagtgtggaaattttggtatggttcaaaacttcaaattgcatcgattcaaaccaaacgtgcctacgactctttgccacccaacgaagcttcaatagagtcaggacagacgggctaaaatagttgggctttctggcccaacatcagtcatagtcggcttcgtcagcctggatgacagccgaacacttctctttatcgaacggctccagttatctcgtcccctgacaaatccttgtttgggctctatagatgataggcactcttctaacatgggctgcccatgtgcacacgcccatgcgctacttggcacaagcctggaaatcatcacttcaacgaagcaacgaacacttgcccaacatgaaactgtcagatgtgcccgctttcgagtcgtctacccaaggaaatgtccctgtagcgcacgaacacgacaggtcgcgattttgcgagtgctcgtcgtatcgttcgtcctgtaacgatttcgcgacgagacggagcagcagctagccatctagcgaggaccaccattatcccgcgggccctttcgatgggcatctttcggccccattaccccgcgcagtgaagttgatggcgctaggccatccgggtccagccaatcggaggaggggagatgggcccggatgcctgtgtggttccaagtcctgtcgttggtttggctcttttccgccacttccacggtttcaaagcaactggatcttctgcagatcagtacagtggagttagctggaggcctggacctttgatttcttgagattttgctcaacataaatggcgcaggttatctgtcgtttctttttctgttatggccatgggtgtgagtatgctttaggtctatcattttcatcaaacctttgtgtccccgtcagtggtataagctatttagaaaagcttgagaaattcatgtgtttacttccggacattgtgtttttgactagtccatttaaagctatcttgatttgtagggaaaacatttgaatcttggaagatttcaatctatagaaaaaaaatcttatgaagtactttcaaatagagaattgaattgtatcctatctttagaaattactatgaaatcgacaacaaaaagttagcaagagcttaaacggattgaaaatttccatgtgagaatattccatttgttagttcttacggtctattcatacgatcattcttatatttttcgaagtttgttttgcaattgaatttctatcaaaattaaatattttttctattcctttatgttttcgatcctgcattttaaagagctttagttgatatttttttccaccgatcgattcggtagcacctgatggacatatattttctttccaaaatggtccagagcgggaatttcttgtagcgtatagccccaagaccgtgggatccataccagccaaacgagtcccctaccggcagggcaagggaagcaatcaaacggatccacgtccactccgtcagttcatctcttcaccaccacccacctctacgaccacgattactcctatcatcttcctctctctccctcttcccatccaatcctgttaacaagtgttagctgagaaaagaaaagaagcgaaagcgttgctgctgctagctacaaaaacccgaccagcactggtccttgagaaagcgaagtgcaacagatcgatcaaacgcttggtgaggtcacggtcaaagcgaggaggaggg

SEQ ID NO: 55860 - DNA, 2310 bp, Oryza sativa
attagtagcctacgtcgctgcctccggattattttgattactactactagtaatcagaccctgtttacatccctgataaaattttacacgctatcacattaaatatttaaataaatatatgaagtattaaatatagaaaaaaaaacaaattacacagattacgtgtaaattacgagacaaatcttttaaatctaactacgccattatttaaccatgtggtgctacaataaatactccatctgtactcataaagaaaatcatttaggacaatgtttaagtcaaaccttgggaatataaatcataaataactctcaatttattgagtttaaaaatataaaaaatatataaatagatttatcatgaaaaataatttgataaaagtatacatgcatcgcctggagcgtagcgtgatgatgatcgtagcagcagcgcgcggttaagttattgctgtttgggtcgcgcggatgccggtgcgggggctggctatctcggcgagggggaaagcgaccctgtctccctgatgccgcgctgatttgttttatggctgctcagacagctgctgttcttctcctttgtgcttgtggtactagagttgtactatactaccactaccaattggagtattttagccgggggggggggggggttagagcaagtttaatagtagagctcactacttactattagttaatgttaaagctaacatatatagtatgttggctataaggttatctttattttcttcatcctctctctctctcaccatgaatttaatgcatattttttagagtttgtgtgcagttagctcttgcatgagagccaacactctctactttttttatctctctcttccacataagcatatagcttgcttatagcccactattatcctttttatctctctctttcacataagcatatagcttgtttatccttactcttataagatgctcgctttctgcctctcagggacagaccggattaattagcagcgcgcgcatcgcacaggcttttgacagttttattatagtgctgctgcgtcgtcccagtgaccgtcagggcggttttggatgcacgtggacgctgacactaacctgaaagatgggttcaaggtgggtgcgtacccatgctagctcaatgccacttgaattcacaaatgtttcgcccgggtgaggccatgtactgtagtacgatggtttgattcaggtataggaaagctttgaaagaaatgatcgtaaaactaaaaataaaacctcgtaaaaacacatgcataaaaagacagaaaccaaatgccatactaattggattcctatgaaatttcataattcacaaaaaaatcaaaactattgttcgattggcacgcatgaaaatcacaagaaatcaatacacctgaacaagaaaacatgaggtgagatttcacttttattcttagacaaatttgcttctgctattccataggaattttacaagaattgctagaaatcgatcatttgtttcaaaggatttcatagagttatttttctcagaatacaaatcctctataaattatatggagtgaagtgcatgagcggttcttaaacttgtacggatgtatcatctatatccataaactttcaaaatgcatttttgggtctccaaacttgtcatgagtatcatatatgtccaaacaggccccaacctactccgtgaggtgacgtggcatccatggtgacgcttatatgtcagtgagatccacatgccagtcatatagaaaaaataaaatttaaaaagaggggggagagagagagagagaggagaaagcgatgtttttaattttgaaaaaataaattaaaaaagagagaagaaaaaatatgttcttattttttttctatatgtgttgacatatgggtcctactgatacgtaggcgctaacgtggcatgctacgttagcacatggagcaggttgaaatctgtttggacctatatgacacctgagacaagttgagggatccaaaaaattcattttgagagtttagggatctaggtgacacatccagacaaatttaggggccgcccgtggactttacttaattacatgttattcctttatttcaaaacccgaattttttattcataataattaataatgcagaaattaaatatataataaagcaaagtcattttttacgaaaatagaaaggacgctattgcatagggcgtccaggtgtggacgctgttgtagacaacgtccagatggggacgtttcttacaagggcgtccataatgctgcagttgaagaccccaaagagccgtccaattcaccggactagg

SEQ ID NO: 55861 - DNA, 19885 bp, Oryza sativa
gtaaacattctgaaatgacgccatgcaactagaatattccaacctcacctaatctaccttctttaattcggttgcctgagtcaggccacccaattcaagcgcctgagcctgagcaaccacgcctgtgtccagcaccttctcaggacttgaaccaaacagaccaatgaaaatgtcaggcaagcttcagctcaggcgaatttgcttcagggcagcaaccaaacagacccttataagattggactttggaaccaatcacacaatggtcgaactttgcctcgttactcctatgcagactattgtctctcgttgattgcttgcttgccgagcaggcaccgctctctacctgatctgtcagacagggtcgccatcccccggccctccttcaatgcttccgctgttccgcatgacggacactctactcggggtcatatgtgaacagccgccacttttattttgagatatttgattagtttggtttttgttctggtccattgtttactacgcatcgagctctctgctgactgaatcttgagaagcagtcgtcagatgaactgcatgcgaggtcttcgatcgatgcttttttttccttttgcaacaggccagagattggaagtcatcgggcgacagatgatctgatagaaggaggatgtttgcgtcctacccttcgtaattttgcattctttgtaaactttctattgcagaacatatacacttgaataccaagatctatgaactgagcatacttgctcggccagccatctggagtgaggcgatgcctggacttgctgttaggaaccaagaggggcggacagacgacgcaacacaagccggcacgagtgggttattgttccagcatgactcaaccagaacgtggatagcggctgcaacctcccggcgtgaaggcagaaagcggcggcgtcctctccggattcgagagccttcgaggtgagttgaggtaaacggcagattactgacgttgtggagacagaagccggaaggcggctgctgcagtctcccagagtcgaagtgaacggcgggcatggcagcaccttgcccgagccctgcaccaacattgggcccgaggagaggagagttgacgatggcgcctctccgcatggcggcatgggcaccccaaaccgagcctggacgtgcttcggtacagcgtccacctctggacacttcttagaacagcgtccaaatctggacgccctttgaaacaacgtccatcctatttttacaaattcaatttaagatttaccacttatttaattcaagacttattaattactataaataaaaaattcgaaaaccccaaattttttattcataataattaataatgcagaaattaaatataaaaaattcggtttcaaaacgacttctcatttctcaaatcatcaaattccctatgttttgtgtgtttcaagtcacctttgtctccacgccctgtaattccagtactctgctcaccattggttggtccttgcaagttgcaaccgcttcggagaaaaacagctggtttgcttactgaaaaatcaacggtggctggagcaacgtactgcgtaccagtactactactccaccaatatactcggatactttctccataagtcagagatatatttcttttatcaccaagaaatatactccctccatactcgtaaaggaagtcgtttaggacagtgacacggtctccaaaacacaactttgacttttatttctataaaaaaatatttattgaaaagtgatatatatatatacttttataaaagtatttttcaagacaaatctatacatataatttttacattttcaaactcaacaacttgatagttatttatgatttatattcccaaggtttgacttaaacaatgttctaaacgacttcatttataagtatggagggagtactttattcgtctcatattaagttaatttttagctcctttagtttatcccaaaataagtttatttttaagaacaatcattgtattgtagcttgtaaaagtaaggactagttgtaatgggataagataatgcaaggaataattgtattggatttgataaaatataggcattttactattgttggttttatattggtatgtgtggaatgagtgaaaaaaatatttcgggatggatgtagtatattaatatatgcaaccaataaatattaaaatgatttcttgggttctttaaccgtttaatttagtacatcaagattacaaataggtattaaacttttaggaaaaaccaaaaaataaaatggatcttagacttttggatgaatgtctgagtactactcatatatattttatttaatgtgagtatgtattaggaaaaatcaagaaaatgcactttaactctccatatgcacaagaaacgagagtttaacaatctctaaatacttgcatgcatgcatacttaatttgtatataaagatgtaataatactacatgtgaaacaagaaacaaaggatatatgatgattagtttcgaatttctaatttttgatatgatgatcagtatggagggagtactaacgttactttgtcacgtcaggaccgtgcatgcatggtgcccatgccagcaggcgaccggttgccctgtttacctgtagtcgggcaaaacggaaggcgctcctccctgcgctcgcacgttgggtcagtcagtccgctcgtcagtcccttccgacttccgtccacccatccgtcagcccacgccacgcgcatgcgctgtcgtgcgtgctccgtcctccccccctcccgtccccgtacgtcgctgctaccgtcgtccccgccttttccaggcctcgctgcagccaccccggcgccgtttcctagccagcggcgtcgcatgcctacgccactccagggcgcaggcaaagccagcggccggtaggcggctgtgcgaagaggaagacgacgcgtctccatccgtccatcgaccgacccacccccggctcgctccggatagacttgtcgtcgttgttattcctgccccgtgtttaatgcccccgatcgatcgcttcgattcgccctttgacccgggtaatctgcagggtacgtacgcacggggtacgtactttgcatcgcatcgcatcgtgtggcagctgggcgttgagatcgtggcgttttaatttttctgtactagtactagtaggcgtcgtatggagccgctgtgcacagcgtgtggccggtcaaggagctcgctctggacatgtccggttaggctttactgtttcgcgtactgttacagacttttcccctttgtgttttcctctttctccttttgtttttcctcccttcgttatctctttcttttgcttgagagaagaaatctgtcctctcgtggtctttggtcttggtcattaagacgtccttccgcaagaaagaggggctccaacctggcatcaatgcacgtgtgatgttttgccaacctttttctctccccctatccgattgtaacatcttttccttctttcctagcatgtgtgtagatcggcttccccaaagactttaaaattcaaatcaacatcgtttcctataataaccctagtacacctgataactctcgaagagtgtttgataaactagggaattgtaatggaagacactaaaagtatagttaaatttgattaaattatattttcattgacacagttttcttttataccaaatatatttttaaaataaaattggatttcatatataattttgagctactgtttctctatataaaattgcactttttttcagtaaaaaaattgtattgtaggagtatataaatatattcaccaatttacaccattttgatttggacccaacataatctaatggtctaaatatttttctttttctctcattagtgtaggaatttctgacatctagagtaaaaaacatgtgcaattttttagctctattaataatataagtatgagattatcaagtgtgaattgaacggtgctacaataaaaagctagaattatattcaatacacaacacttgttttattttcatagatactattatattgtatttttgaccaatgtattttaaaataaaattttatttaatgtacaaaatttagcttctgttttcatagatacaactactatatcatcgaatcaacgttgttacgttctgaaccacgatcttatcgtctaaattgttttgttacctgtggttttgttttcagggctctaaagcaaacgttgtggtttacttttttttatatattttgaaaaaaagttcttttaacttttttagtaaggtgcagattgatattccctctgtttaaaaatatatatttaattttcacttatcccatacactcaataaaaaaacagaatacccactttaatcaaatctgaatgcatttactcattaattttacaaactccaataaaacaatcaattaaaaataaacagattttgagacaaattaaatactcccagatactcacaaattaaatcaattcctaagggcacccgcaatggttatcgataggctctctacaaaagatctatgtcagcatattttcctacttggaaaatattaaatagagagagaataaagctatctactaactcggagatagtctatagagaaaaatgaaacaatggattagagagctatagatacccatgtaaacatactattgaagtggtttactattaatctagtctattgctgagatgtacatgttctatagatagcaccttactttactattacgggtgctctaggttcccatactcgctgtagaccaaagagaacatgatgagtggagtatactgtgaaaactgataacaactgtgctgccagtctgctactcgtactgaagtttagcatgactgctccagtgattcccatggatttgattaggagcggcgattggctagggtttgaaactttgaaaactgatctgcggcgatcaatgcgcggtcagagctgccctcgggagagcggaacggtcaaacgggggccgggggcaccacctccggtagcgtaacgtgagggtcgcgtgccacgaggagaggctgtttgcttcggtgatggatggtgatctcaccgcacgtgcggtccgcgtgccgagaccaatagtacagtgcacacatcacggcatcacgctcgcttccgtctgcgctccctgcactgctcccattttcccagaggtaatatagatttaaaaataaaagcagtgtagtgtgagtttaataaaagtaaaatatggaggcggcaccatttgtaatgggaatgaaaatcacatcaagcctagctaacgcaccattccctgctatagattctactccatcttttgttgttgttgttgcgctttggcataaaccaatttcctcgtagtggagtagcagcagtgaaaaagaaaaaaaaatcaaaaatcaaaataatataatgccagtctgcatgagcagaaattactccataaaaaactggggagaaaggaccagctatgggcccacctcacaggcagcttgtcagtgagtgtggcaatgtctggtccccactcttctaatccaatcccctcactagtcctccctcctcggtcatcagtcatcccaacccaaaccaccaaaatgaaaagaaaacccaaataattccatcaggatattcttgctcacacatacacacaccctctcacaaggtcacagactcatcgcccttgcagccttcctctctctcctctccacccactctagcttggcttggaccagatctcacattttttgttcagtttctctccacgccaccactccctcctccctcttcctcttccccttcctcctcacctcccattccctcagatcttcccccatatctctctgtctcgccgcagtccgcctcccaatctgaggagcttttcttcagctcaagcttcttgctcgcttgctctctactatctctccttttgactcgtggccaagctgcagaggaaacccaaaattccaagaaaagcaacaggtcaagaaagagggaaagctaaggtgagaggagatgggaggaaggaaggaaagaaagatggtgatgatggcgataagtcgccccatgattcgcgccatcattccgtctcgcccgaggccagtgcgctggtaaaagggcctcgccgtccgtccgtccggccggccgtgcggcgcgcgtggaggaggtggtggtgggtgcggaggtgcgtgcgtgagaggggcgtcttgccacaatgccgcagtaccaggagcttccctgcggcgggcaggtgctcgacatcgacaccgcgctcaaggacggcatccttgggggtggcccggagctcggggacgcggcggccggggacggagggaagcagccggtggagctgaggaagatgatggacgagctggacgcggcgggggacggcggcggggacgaggcggtgccggcggtgttcatctgcccgatctcgctcgagcccatggtggatccggtgacgctgtgcaccgggcagacgtacgagagcgccaacatctcgcggtggctcgccctcggccaccggacgtgccccaccacgatgcaggagctctgggacgtcacgcccatccccaacaccacgctccggcagctcatcgccgcctggttctcccgccgctacacccgcttcaagaagcgctccgccgacttccacggccgggccgccgagctcgtccacgcgctccgcggcacggccgtcccgaagaggcagcccctcaagggtcaggccagggtagccgcgctccgggagctgcggtccctcgccgccgcccaccagtccgtgaccaaggccatcgccgaggccggcggcgtcgggctgttgacctccctcctcggccccttcacgtcacacgccgtggggtccgaggcggtcgccattcttgtgagcggcgtgccgctcgacgccgacgccaaggccgcattgatgcagccggcgaaggtgtcgctcttggtggacatgctcaatgagggtgcggtggacaccaagatcaactgcgtccgcctcatccgcatactcatggaggagaaaggcttccggccggacacagtagccagcctgagcctgctagttggagtcatgcgcctcgttcgagacaagcggcatccggacggcgtcgctgcggggcttgagctgctcaattcgatatgcgcagtgcacaagcctgcaagaagtttgattgttagcatcggtgcggttccgcaactagtagaattgctgccagagctgccaacggagtgtgtagagccagccttggatatcttggatgcgcttgccgcagtcccggagggtcggatagcgctgaaggattgccccaggacgataaccaatgctgtgagattgttgatgagggtttcagaagcatgcacacggcgagctttgtcaatgctgtgggtggtgtgtaggatggcgcctgaagaatgcgcgccggctgctctagatgccgggcttggggccaagcttctcttggtcatacagagtgggtgcggaccagagctgaaacagcaagcgtccgaactgctcaagctgtgcaccatgaattgcacatcgacggtattcatctccaagtgcaagcttacgaagacaatccagtgagtggagtttggaattgtgctgttccgcttgtgatttggtcgatggtgaatggttcacctgttgggtctcacataatctgaagaaatggcagcaattagcaattggcagtcgacagcgtctatgtatagataaactttgcagttatgcagaatttgccatgtcatctgatggcataagggtggatgatatgagtagattgtgagacctgtggccatgttatcactgtccagcgagatgatgcgtatcgcagcattcaaaatgcagcatacacacagctaattcagtggcaagcaggtgggatgtacatgcaaattgatgaggattttggtcagctcaataagcactcgaggctgggaggtggtaagtacagccagttttgccattggtagtagaaaaattaagcaagaaacctgctgttttagattttcggcaatgtgggtctttcagggctgtagatgttcttcctttttctcatcttcggtgtaattgatggtataaactgggtagaattgtatacagtactgttgcttcataattgaaatacacattgccataggccatatcttggaaaaaattggaactctttgctgcatctttcattgctttgatcatccagtaaatttttcaaggataacctttgtcctgtagcatatactgaaaagcttcaggcggcgttcctggtgctgaaattgaaacagtagaaagacgaagtccagtgtcagcttgtgctggtgccacaagtactactgtaattaacaagtatagtatcagatggcccagtttgaatctagagagcataatcagtcaagcaattgtagtcttcttgtagatttagccgcacactatccttaaaaagggagaaaacagataatttggtttaagttcttttctgatgattcagcaaatagtcgagaattgccagtcaaggttgacaacaacaccaaacattcattttcctggattgcatctactagtactctcactggaaaagcgggtctttgtatatttcacatcagggggctgtcttatctaatctcagggaaaaaaaaccttggtcatcagcaaggacagataaagccatggcaacgcctagcatagggtcactcatctatgatcaggagtaggctatgctcagtactttttccctttatacgttgccaatcgtaaagcagatgatgggtgctggtgccgcacaattgacctgtggaatggaagcaggatgaggaagtgagcgcaccatgcatgccatgcctcgtcagtctcctgcttttgccatgatccgcgacgtgacgtaccgccctccatgcaccgcgccggcgcgcgcacgcacaaacgccacaaacccacccgtcgtccgtccccatttccacacgccattctccggtctcgcctcgcgagaaaaaggtggactcgcgggccagcccaaaccatgtggcgtgggcacccccacctctcctctcctcgcctccgcgcagtcgaacgcgaggtgaggtgatcgcctgcccaaaggctggatcgggagcgagcaggaccacgggcatgcgcgcctgcctcctcccgttgatggatggacgacgactactcactgattgggtggcgctactgtgccgagcacaactcgtacacgggagcgccaggattgtggtagtgctggtgcctgtgtacgcgtactctactcggacggacactggagtgagtgatcgagtcagctgctgctgctgctgcatgcatatgtgtgcgcgtacattttgcctgggggcagaggtcgccgggaacgaacgctgcaatctattcacaggacgtggcatgcattcgccacgacgcgagaggggggcccatggtcgatcggctgtacagtacgctgcactgcggtgctgcagccccgtcactaacggctgatcgatcgatgctagtagtagctccatgtgcaatgaatgctggtgaggtgttatctgaaggaaaattttctgccggcttggcccggcttgttcgctcgctcgctcactcggagctgaaggaaagaacacatggacgcagagggaagatgttggttttgaaatttccggcatcgtcgtcagttccccctgccccgccatctccgttcgccggtagagatcacatgagctcctacccccgaaccagataacctcgttgtgagcttgtcgattatttttagacagacaggcttcgaactttcaactttcaagcgcaagctgccgctaggatggagggtgcaccgtgcacgtcattgtcagcttgaacctcatcagggattttgtctgatactcttaaaagtagagcgtacgtgcgtatggtcatggtcacgtcaagagaggagtatagaggagacggatccctcgtgccatcgaccagagaccgatcaagccatcgaccgatcgatcagagggaaaacctgataagcgcgtgggcggcagatgcgaaatcattggcgttcccctgtgggcgtggactttggtctgatggatcggctctccccctgcaacgcttcctctttcgcttatacacgccgatgcatgcatatgccgatcgagctgtccctcactcactcactcactgatgggcaattctgggctcttgccgcgcgcatctggtgatcgatccgcgtcgcgtgctgctgctgctgctgctacagccttttcgtgatgtttgtacgcagcggccatttactccgggtctccggccgtccggcgatggcattggttggtgtacactcctaccctggtggtagggctggtagcagcagcgggtcatctttcagtcactgtgcggtgggccctgcacgacagaggggacgaggtgggggcgagtggctggttgcccccaagcggcagcggcagcggcagcggggcatggggtggtttcattgacctccagagtggcaatcgatcgaacgagacgagtgaagcttttgctgccagtttggcgtccggatcacggccagtatgcgtccgtcccaagtggcctcacctgaccggcaaaactgatcacatcacgcgacgtaggcatgcaagcatatcccctcagcttttttcagctctcgtgtccaggactccggacgcccgctgtttcagccaaaacagcaccaacgcgtttaattttaccctgttcatggtttgacacgcagaacggctaactttaaaacttataaagtgctggttagttaagggttaggggagcaacgtgttgcatgcattgtgaaatagatggccttgctagatatgccagtactactagcttgtcacttgtggacgtgtgacccaccggcgtgaggcaggccggcggggttaggggagcggcacgcgcagcaccggtgaaagtgaaacaccttctgtacgtgcatgcatggctgcctttctgttttctctgctcccggcttcaccgtggggcctgtaaactgtgccctctcgtagtctaaggagacagggctggtcaatcaagcaaactacacattatcaaagcgaaagcgatcatcccatgcaaaggacagcaaggccgagacatactatgcacagtgcacagtcacacacagccagtggaatctagatttacatcatcaaaattactagcagtgcttgttactgccatcatgaagtgtaaaaccatccaggccggcagtctgtcggatcgggcgacgaaatgtatgaaatgcacagtactagtagtagaatttttggcaataagtttcgtgccattgaatgcttacagtcctttgaatttcctaggctgccttcaccataactgttgtctagttccagatcgctccccctgccgccgcagaacctacgccgtaatgtttgcattcagaaattatgaaaagacttaattaacctaggtaggagtcaatttaagatagagtgagaatgcaacctgttaaatgtatacacctgagactctgaggaggggaaattacaagaagctccacatcgcaaagcctctcttagtatcccactataaaccaaagggtcatacaacagaatgagaaggaactggactaaaagctcatgtaattcaagatatatcggcaagggtcaaggactcgtggtttgtaattccctcttccctcttctaagcaaatcatggactcatggttgcttcattgtcccagtaattcctcaactgcgacatgtggaggagcagcccatctcggcctaatccagtaacgctactcgtcatgatccatggaggaggctctgggtacagggaactgatcgtctcctggaactctttgatgttctcctctggccggccccctttacctttcttggatttatcacactttgtgaacacataggtcaatccaatctgaaatagtacccaaacaacagaagtcagactgcaacaatatagttggagaacatgaaagatatgttattagatatcagtacatggcatagactgtcttatgttgccttacattgttacggccaagccaattggcacagtctatgtcaattttctgaggcggaatactggcatcaacaaggagcagtacgccaaccaaggtatctctgttcaagaagtaacccttggtaaatgaagaccaatctgttcgagcagattgagatgcagccgcaaacctacatttgtgaacagatttgattatcaccaggcgccaaatgagttccaacagtatgctggggttgtgtcccaatgggaatggaaaagcaacagtagttgacttataaagtttatttcgtacagaatgtgctcactgttacaatgtcagatactggcatgcagaaacagaaactacagccgaatagaagggaataattgaatctatgccatctaaagatcaccacttcagaaatatataaaactgaactgactaggttcactaatatgatcaaaagatcacagttcaagtttctaacactccgcctagtttcataagccttttcctcctcattaagtggtaatgaagtgaacaacatcgattcaatggtataccctggtggcatatacacaattgcctacttctaacatagtattttcaagtgaaaatttgctaccggacactcaaagtttgcgctctttgctactggacacccaaagaacgtgtatttgctgcaggacaccgtgggaatatggtgacactggccgtattattttattatatctgatccaaatggagagagaaattttcaaaaaaaaaacaagtttacccatacgacatatttctttttaactcgaccaggtctagtttgaatcagacctacaccatcagagtgagaatggactgtatcgagggagtgaaaatggactgggtctggttctaaccagaccgagttgtcttacaagccgatgaacacaagggcaaaattgtacttctcgctctgtttctctccatttgcaatgccatctatgattttgtcattgtgatacatcctagaaagtagcacatgcaaatcaagttacatatgaattgagggtagaaaaggtcaacatacccgtaaccaggcaaatccacaaggtaccaacttttgttaaccaagaaatgattaatcgtctgggtcttccctatgaaagcataagatattccatgtaacaacagaagtacacatttcaacaaaatgcagaagataacaacatgttggttttgtaatgccaaactacattatctgaattcgtgtgcaattacgcagctaaatgcattatatacatcattatatacaattacatttcttatacacctaaaataaccctaatatctctcactagtctacaattctacagtttcaaccatccaaaaccaattgtgtgcatataccttttctccagcaatttacatggtattttttaaccaacttttgttaaccaagagccaatatattcatgaagtttgatatgaaaataacatagagttagatggagcaaatcataaaacaaaggaatcagttcagttctgaaggttggcattttgttaagagttaagcaacgaataggatagaaagataaacaagttgaaaaaaccatgtattcggttctgaagggtgcacaaataccaaactcgtcctccataaaactgcataatcaatagatttataaggtttgcagcaatatcaaagttccccatcaaaaccggagcagtagcgtagcaccgtaagctaaattaatttcttctgttgctttaagcactgagctaacttcagctcccgaattgcgagcaaacgaatgtgtttgcagtctaggacatcgcactgacggttgacgctaccacagtcctaaactcacttgggagttgggagtctacctcagagctaaactagaaattgcatcatcaaacagatatgcagaaacagataaaagcttaaaaatcaccaggctttttggaggtgagcgcggcttccttgcggcggataagggcgttgatgagcgaggacttgccgacgttggagcgccccagcacggcgaactcggggcggtcgtccttggggcagtcccgcgcgcgcgcgctgctcttgacgaactccgcctccttcacccgcgagtcccccgcgtagggccctaccacgatgttcgacgccggtatcaccatctccgccgccaccgccgcgtcccgatccacccccggcgggaagaacagcgcggggttcacggacgaacccctgggaggcggcggcggtggcgcgctcttcctcccgcccttgagcccggttcgctgcgccggcggcggcgcatcgccggcggacgcggtcctcgccgctccggccggcgaggagagcgtgcgacggacggggagcgaggcgcggggtggtggtgggacggggcgcggcgcgacggctcggaggagggagaggcgtggccggagtagcatagcaaccgcagccgcgcgcgcggcggagaggtggcggatggccggatggggcgcggcgcgggtggctcacgcggccgtcgagtcctcgtcgtccctgtgtcgcgacctgcgcgaggccgtccgccaacatatgggcctattaggcccagagcatttattcggtaaaaccagagcccgttataatcacagactaggcccaatagactgcaaaagtggcccaaaacaactgtgcaaaagtgggttttgtacactactgaaaactgataaaaaaaacgcgaatatcaggaaggtatgggaggagactaccgcccggacgtccgatgcaacgcaaaatatcggacactacccgagtcctacgtcagcaagctgatcacataactgctacatgatgatactacatgcatgcattgattaacacatactagtagcgtttgagatgatttattttccaaaccatttatcttattgtcattctgattatatggttgtattcattgtaattaaatctttacaacaatatctcacaaggttatattttaattgaaaaattatatatgtttcaatcgttaagatttaatgtttcacgtgttaaaaataaaaatgtttcatctagaatttgattatgttgtacattttaagttttttatccattagatgttgttttactgttgcacacgggatcaataaatatattatgatgtttcattatttatttgtgaatgttgcacatcatattatttgaatgtttcatcaagtatattgtgtgcaacagttacaaagaattagtgaaacataagaaaatatctattaaaacatctaaataatactaaataatactatgagcaacattttgttgcaacagtaaacttaaaatttattacaaagtaaaattccatttgaaacgtttatttctcatacatgaaaaatctaattgcaccggctaaaaaacacacacatatatataattttttcatcagaaatataatcatatgagatcttattatagtgatcttgctagaacatagaaaacaccacatgcaacattacaaataactatgtgaaacatcaaccaatatttattgaaacattctaataacaccgtgtacaacactaaaaagagtcagaaaaaagtcatcagaatacaatgatgtgagatattgttccgaagatttaattataacaaatccaactacataatttattcatagtttggataaatagttggagaaaaaaatttgaattctcaaccattatgagctgttttcctaaatttgattgcatgcacgaatgcacttacaccaactgatgtgaatgttcgatttcttccttccttctgcccggacggctgatgtgaagcattttccgaaggtatgaggtttcgaacttaattcgtctagcccaccaccttatggagctagccggaagacccaataatatttctctactaaaaactgctgattgcaatcagattattactgaggaattatgttagttttagtctctacctaaaaagaaaaggttacggagtagttttactctttgacgagattaaatgtcgttgatattttgtggagatggcacaaggctccgttggtggcatcgtcgtttctgttgctggtcattgacaatctcgcatcgtcaatactgtacctgcgaatgtcctgaaggattccatatttccattagaatcagtcacttggaagttgggaagttcacttctatggggcgtgctaccgcgtcattattgatactcgatgagaaaacaagcagcagctttatttcccggcgcttaatgacaataaccgaccaaataaacgatccaacagatcgaactgcgattatagtaaatagtttgtactccctccgttcaaaaaaaaaataaataaataatataatatattctagcataacgaatttggatacatctaggatgtgtcatggagcggagggagtatactagatgtaaaaggtagatcgctgacaatgcaaattaaatattagcaagcatactacgacgaccaggcgtacataatagaagaaccagttgtatatttgccccccaaaaaaacgaacatgaggaaaatgaaatgtgtgaaaggttttattgacccaagacctaataactggtatggactcagcaaattctagttctttgcagcgaaccttctattggtttatagttgtggcatacaatttaaaatgttaattgcgtataacagcagattcttgagaatctaagaataccttaagcagcatgtactagtgtttgaactgttctaaagtactccagttaggtcacattttgttaaaccaatgagttataaaaaggagttgaacgcatactctataaaaaaaacacgaatattaggaaggatctaatattaaataattagaaagggtgaggcttggaattcagatcgtctagcccaccacttgtatagctagccggaagatccctgggcgtttctcacacgcatactctataacaaaattgactctatgcaaagccctctgcagctctactagctgcaagttgcgacttgacagataggagtgggagaagaattgaagaaagtagcaacaaccttacaaccccagtgaggatgcgactatgtaactaatggagtataatcatgagctagtttcagcgttgactatgtacgttggcaactatcccgtcagattcaacagctccgatcgttttatttgctgtttggtctagtacagttattaggcagaatacaatacgccgatttttttttcagaaaaatgatgatactaacaacaaagataagtgaagtcaactgcttataataattggctggtagaccgggtgcctaaattaatttgactgcatggctgacgattccatctaggagcccaatacgtcaagttggtcaaccggcctaactgtccgcgcgcaatgctaactgtgcgttcagatgtattgagaagcaatagtatgtctggtggtgtgcgctgcgagcaataggacgactgcatgaatgcttgccaatgaatgaaacatccttccattttttgttctacaacagctgaaataaagtttccaagcatcatctttggggattcgacaccatcgtaacgctagtaatctgaacaatttggagggagcgaaataatagggttttcaatctcgaagaaaaggtagctgggtcaaggtagcaaaagggatggtctaggaggtagcgtcatggtgtgcggctaatatggtgatatggactatcaataattagtttgcagggagttctttttatcgtggtagacagtcaatatcgtgataataggcttatgttcatttgccggttccagtttccgtctccttctgttttttgatttggggctcttggtctgtaaataatctttatttctctttatgaaaaaagtgtgctccttgcgtattccctaaaaaggcaagcaatggtatgcagaaaattatccactttgctgaaatctttaaatgcatgccactacatctaaaactgttagtttgtcaaattattcttctggttccaccggccggcatgccaaatcaaaaatcatacacataactcgtccactttggcccaagaaagattcgatagatattagaaactgtaattttattatagctgaggcaagatggatacataagttcagtatctacagtgcttacatcccaaagttccatgtactatctgaaggtgatggccggaagtcgagaatggatatacgggctgaagaacaaggagcgagaaatgtacagatagtccactacaaagttggtacaatccactccccgcaaaaaaaaaaaggggggggggggggggttggtacaatccacagaaatgaactgcagaagatcgatatccgtttgcctcatcaagcctttcttctttgcttgtttgaacgcaggaattcacagaagatcttgtagaaactgtgcgtcagagctagttcattcctccaagaatcgtggaaaattcccgtgttccaaactaccctgggcagaaacttgtgccaaagagcactggtgcatatatttgcacagctactgtgctacactagttgtgattcccttgggtgtagatgtagtcggtgtgagcaactagtgtcctcctcatcaggcactcttcctctgcttcccctcccttgcactccactgcctgatcaggttctccctgatgcatttccacaccgattccagaactaccaacactcttctgatgggcaatactggaggcaacaacaccctagaaacaccaagaagaacgcggttagatagccagcaccgatagccaaactgctcagattggaagcaaaatgcaaatactgtgtagagttcgaccaggttatgcattacatggtgactgtacctgtgatttgtggccactggatcccggttcaggccttgctgcttggctcctcgtgcagatgaggcagagcagaattgccgtcaagaagagagcagacagtttggagctggatgccatgcctcgccctttttctctgagctctccctctctgggaagttcagggatgagggatcacaggctaattattgggtgatctacaagcttaaccaagtgctttatatagggtgaagaagaagagcgaggctgatatgccaagacaccacatgaaggacagcaatgtgccgtcgccgctaggtctactccgctgttcgcgttcacatgtggagtgtttatctgacgcggacgcgcgtgtggacgtgccagacgctcatggctctgcatgcaccgtgtcaccccctgtgcgtggatgcatatgctgccagattcaggggcatacggttgctcgtgttactgtgtcgatccatgttttctagtagtgtacagtatgtgcctagactatacggtgcccggtgtcctcccagtcacatgctccttcggttttcacgcctccccgcttccaaggaatccaacggatggttgaatcgcaatgtcaatggattacatgtacattaatcgataattatttttaaataatttaacagatttaatacagtataattctgataatttttacataactttcaaaaatcctcagtaatataaacctaaacgataattatatacgatttttaaaatatcatataccaatgacaataaagagaagagacagtggacggctgtagaagagtataatgataacatttgacggaacttatagaaattataaaaacaaaacccaacgggacaataaattataaaaactatgagatccaatttttaagagagaatctcttatatgccactgaaaattggcccgatctcttatatgccactgaaaatttgctcttcccctatatgccattggaccaaatttgcacactggatttttcacattttggtccttttgaaaaacttatttcgcaaatagacccctagaaaaacttatccaaaaatggtcctttttggggcgccagagtggctg

SEQ ID NO: 55862 - DNA, 2027 bp, Oryza sativa
aaaggaccaaaatgtgaaaaatccagatttgcacaccctattataccactaccgtcagttgactttgcgttgaccgttaactcaaaagtgaaaagacgtatttgtcccctctaagctgttaggcatgtagtaggttataatgtcagattttttaatttggttgacatatatatatgtatgtacaacatttcagctaggcattacacatattttgaatacatgaatatacagcattaatttatatattgaatatacggatatttttcagtcacataatttttagccactaccatcacgtatattttccacaaagacattatacatgtacaaaagcttcaacatgcagtaaacatatgtttccaaatcatacttagggacaacattgaagccatataatagatcgctaagaacaatatttctgtgtttcacagtataacaaacatatcttgtttgctggagcaagaacatatataaacagcggcacagaaaattgaacaaaaactagccgccgcccctccagcgaccgggcgccgccaccctcgcctgccgcctgcctgctccgacgcctcccctcccgcgaccgcgaccggccgtcgcacctccagtcgctagccctcccgtgaccgaccgccgccctccctggaccaagcgccttcgctgcgccgcctgctcaggggagccgcgccgcctgctcaggggagccgcgccaccccggaccgccgacctcgccgcgccgcctgctctcctccctctagggttttgtcgcgccgcatcctcactctgctcaggtcaatgcctcctccctgctagggtttttttgagaggattttgggcttgggccatttaggccaaaggctatttttgtcatttttgcaaaaatctgacaaggggttagttcctaacaactggcatataagggaagagccgattttcagtgacatataagggatcgggccaatttttagtggcatataagagattctctcaatttttaaaggttccaagaaaaataaataggaacagtggtagatcgagcaaacaaataaaggatgatatggtttgatctttcaaagtcttaagacaacatgataactatttaataaattttaagtaaaatcatattaaaaaatataattttgtatgttactagccccgcaactgcgcgggccacccaactagtttatcataaaataaagtctgtaggactgaaacatctcacatgtaagtgctctttgatttctttttcctcactttcatgaagcttaaagtaaatttaacggtttaaaattatataaaagctatatacaagtttttctgttgttacaacgtaattatatttatattaatattgtatttgttaaatttttaaaagaaaaattgtcgatagtttatagcaaaatcgatgccgattgaactttgcgtgcgtgattgcagggaatcacacgcaatctccggctaatcgtatgtctatcagtggtagacgggcaaatcaaccaactaacccccataattcccctcccgccgctgcgcgcaacggcaccgccaggccacgcatgaccacaaccgcaggtcatgcggccacgcgcacccgtacctcctagctaggcttgcggacggcgacaggcacgcgggggggcgtgggcgccggcggcaacttgagggggcggccgcggtggctggccagaggatcgatcgatcggtcagatatatctggatgcgacgggccgtgtcgtgcagcagctgcctctgccgagccgtgcgaacgctggcacggggcgagccgcgcgccaagcgatcgggcggcgcgcgcggtatacgcctggtcggaggaggaggcgtgtcgcgagtccgtttccgtgagacgcaggggggatatcatatccacgtatatagagtatagtactacgtgtagtagtagcgaccttagcgagccaaatattatctgggcactgtacggggcaggcgggcagccgtgcactgctacgattagtcggtacatcatctgcatgcgaactgttgcgtgttcc

SEQ ID NO: 55863 - DNA, 2335 bp, Oryza sativa
atttttcatcaaacaaatattatacaatactgttaaagttgttaaaattttggttggataaaaaatagcttcaatctaaacaatcattggtgtttgattcttgtcattaagggattgtatcatactgttatcaataatcatttttgttttattatcgctgtacactacagtttttccaaatactaaggggagaaaaccctagctgccgcctaagcataccaccacggtgcaggcgcaaggaaggtggctatggggctttcaccgtcgcgtgtcttctatgtggtagccattagtagcggctagccacaaattatcgatggcctagcgtcgtccggttgaggaacgtgtggatggatacgatgacaacgggtagtttcgccaacatcaccgatcgatgaaaccacaaccccgtagcactatggtgatgtttcgggttgttgccgcagtggccgcctcgacctactttacattgctgactcctcctgttagattgttggtgccggtgccacttcaaaggacatgtctcccatactatagcgttccgagtcccttgttgtatgatcgcctatgttgtttctctatccatattcaatgcataatcgtttcatcctcgatctcgagagattgggtatggccttgaggtcgcgatggctctggcaacaaagaacctcaccagataagctgtggcagggactaaatatcccaattttgcagaaggaacacaaccttgtctcgattctatggtttgctcagtgggcgatgggaagttggtactgttctgggaggattgctggctacagggctcttcaattcggtcactcgcgccggctgtctacgcagctgttcccgctcggttccggaacaggcgaacggtggttgaggctttgcaagacaagaggtggactcgagacatctctgcggcgctggggatccaggcaatactggaatatctcaagctttgggaccttcttcgatcggttcagcttggggagggactggacacgatctcttggcgttgggagagttcggggatttactctgcacgctcggcgtatcgtcttctcttcttgggaagaaccaacctcaagcacaagccaatttggaagtctctagcgcctcctcgctatcggtacttcttgtggctggtcgccctcaatcgttgttggacagcggatcgccttcggagttgagggctgtcacacccggctcactgccttctttgcgatcaatgtgatgagacgattgatcacttattggacgcttgcccgaagtctcgctggctatggtggattgctctttcagctattggtcatctgagtgtctacctctcaatgagcactcttttcattcctgttgtgtgacagtcgcaaaagaatggcaaaggagcatcgtcgaggatttgacaccattgcaactttggtagcatggacgatttggaaggaaagaaacaatcgggtcttcaaccagaagagcaggacatgggcggaaattgctagggccattacgggcgaagcggatctttggcggttggctagagccacaataccggccatggcgattcctatgtcgggtgaaagctaaggtctccaaatccgttaggagattaggcttttgttttcttcctcttccccctcctgtatcttgtccccttcgtttttttgagttttcagcccgcactgtaaatacttttattccttcttaatacaaagatgcgcccctcgcgtattcccaaaaaataatcgttttgcgacatgtgcatgctttgggcgagacgttagttctccctccttgcgaggagagatgctatccgtaattcatttactctccgatgagatcttccgcttcgattcgatgtcagtcattaatggtgatgtgcacgtgaattgatttgcagaacgatcaagcgataatttcagagtctgttttcaacttcaagtttaatttcaaaatttgggaaatgatcatccaggttcaaggtaaggaggtcttcatggttagtagattttatccacaataccaagacttccattcctggatatggaggacagggttaattcgattgaagaaggatatggagttaacgactacatgcatcttacaagctgttgttgaagagacaatgattgtgtagactttcgtcacctatgaatagagattcaccgataagattttttattgataatgctatccatgtcttttagactggtgtttaattattaaaaatgttatggctttttcttttagtagaactcatatatcgtcgtgtatagtcttatgtgtacagcttcattaatcggaatttgatatttcactttagtggggttagaaaaaaaag

SEQ ID NO: 55864 - DNA, 19792 bp, Oryza sativa
ataatggattatatatttttttaagaactaagaaaatagtaaaaggacatgtgatgggtgaaaaaaataaagtagtataaaagttagtaggtgggagaagaaattagtataaaaatagatcatggaggaataaattagtataaaagttggtcggtgaagaatatagtatttgagattctaaaaccccttatattttaggataaattggatggagaaaatcttttctattcatggacggagggagtagtagactagtagtgagagtggattataaactctcaaatgacatcctttcatggtttacatatcatttaaatgattatgattttttttaaaaaaatatttaataagataaattaatactttctatgttcaaaaatatagtaacgtttagctatgaatttgaacaaacaattatccaatttcatagttaaaaatacttatattcaacttatccaagttaaaaataaataaattaaaccataactaggatgaggagggagatccttcttaggactggacccgcgaggtactcatacggcgtagactgctacgctgcggtccacgaggttcgaatacgcgaggacgacatgccggactggcaaaacgcgctgcatcctgcatgcattgtggtagcccggtaggctggttatgtgcgaaaagtgtagtgcaccaacgttcgcgattataatccggcaaatcagtcggaagggacacgcgaaataggaggacacgccattttctcccattttcatttttttctcttcttttacgtgattcttctttaatccgttgcaagtatcaagtatttctgttttttttctttcacttatgtttatttcttagatttcttttttcgttatacacagtatttttttatatcttcttaacagaaattttctatatataaataatttccatggaaactttctatataccgtgatattttatatatgtaaactttatatagaaattacatcatagctagaaagtttagtgcagaaataacaaaatactaacatggaatttttcaaatgaataatatccttggaaaatttctatacatagactttctatatagagagattttatatatgtaaactttatatatatggactttgaatatataaactttatatatagaaagatcttgttttctgttcgctaggttcgccgctagcgagctttcgcgcattagacatgcctggttatgtgagcctactccatcagagctcggcagctcgcagagaaaacgaatgctggagtactcgtgaaaacgtctagccccatcatttcacatataggagaaaaaaatcaaaacgatatatttgtaaattaaaaataatttttaaataaaactcttatatatatgtgttcttaaaaaatatctaaaaacaaatgttaaaaataaactatgatgaaaaaactctaaaatcaactctaaatttaatgttgaaaacacaaattttggttgataagcgtaacaatactgcttgcatactagggctatgttcggaatcatctgttcccagcatggacagtgcgcacggaaacggagcggtccattagggctaagtattagtttttttttcaaaaatggatcaatatgattttttaagtaattttcgcatagaaacttttttttaaaaaaacacaccgtttagcaatttgaaaagtgtgcgcacggaatacgatagagaggaattgggaacccaagcttccaaacacagcctacttgcagtcatttgcagtataaaacatcttttgtgccatttaattttgtcatcacacagtactcctacttggaaagttggaaacagggcaacacagcctgatactgcctgcggccaggccggtcttgatgtggctgtagagcctcagcaaaaccccagaaaaaacaaaccaaaaaggaaaagaaaaaagaaaaaccgaagcctataaattactacaacatttaatttgggacggacggagtattccacctaggaatagcaacaggtcgggtaggacacgggtagagcgattccatgcctgaccggagacccatgtgcccgcgcccaacccatgcccacaaggtctatcaggcaaaatcctatgcatgtgcccatgcccattgagcacgggcacgggcatatcgggcccgcctgcaccgtgcgccaccactgccgtcgtgcgacgccgcctgcgccgtgcgccaccagctgccgtggggattgaggtaggagaagagagtggggaattaggttagggtttctattagttgagtatatatatgtccctggttagtgggccaagagaaaagggtatgaggaataagagatgggccaaaattagcaaatacatatgtatcgggtcgggtatgggttatccgtgggcaaaaaataatgcccggctgctgtctgctatgttcttgggtctcgggctggcatggccacgggcaaaatattacacccatgcccatgcctatcgggccgggtattcgcggatacccggaccgatgggtaaaattaccatccctaattccacttgggagtaggggtgaaaatgatacgaaaactttccacttgtgttgtaccgttgagacttaacaattggacttatatgattgtgttttatgataaattgttgaccgttgagacttgagaattggatttatcagtttaaggggccttttattccgataaatttttgttactgtatttgcaccggttcgtttttgcgtcgttttcggtttcgataatatccggggtttccaattccgattcagattccgaaaaaaaatataaaaacgaaaacgataaagatggtttccgtctattttcgtaccgttttcatccctactcgggagctaccggaggagcatggagctaccggtcttatgtggctgtagagcctgcagctaccggaggagcttaatgcaatgacgctaagctaggccctgccatgccatcctatgcctgtctctttttcttcggttacagttccaaggtctgaaccatgtgagatcgatgagggcgtcatgaagacttgctcatcctcgagaaccacatgagtacctcgcgggccatggggactggaccatcgagaaccacatgcaggcagtcggccggcctgctgtccatagtgaatgtgacaaaccggcctgtccatagtgaggagcctacatttgctcctcgccgtttgcgtgcgatgttctgcacaaccgagaaccgtgagagagaaagaggctgcgtgcgtgttgtaggctcctactacttctgtagtagccatgaaattcaaggcgactactaacgacgtgcaaaatacgggccgtgcatatatagactgtacgcggcgcacaacacgctgcgtctttgcgtaatgccccaccccgtacacgagtgatccacctccctcttattacagtcttactgttgggatcgacatctctcaatttgggatttagcgtgttgtcagcgacaaatagaacatgtatcttatatgctaaaggtacaccgatttaatttatgtactcgtacgtgaatatttacaagaattacagtgaggtacgtagtgatggcctcttaatatagttgagcagtggctaactaatatgttttcatttacttgtatttcagatctgcctgttcacggtttgggcacaaaccgttcaacccgtgaaaccaaaccaacccaaaccgtttttccatttattcacgggttggtttggaaccggcgtaacccgttgaacccgtgtctcgtccttccccctccgaacctgcgctgagcttccgcggcaacaagacgccatggcgagaaggcatctgcgtgatcgaggaaaccaagcaatagcatcggctatttagctcgcacgtaagtgcaaaacaccgtagacgttggtgccggcagcgccgatgctggcgacgacgccgaggcagccaaacggcggctcccatccgaggaggaaacaatcgctagatcgccgccgccgctggcgtgttggtgtcctgcttgttgcctgcctgcctccatcgcatggaaaggctatacgagccatggtgcaatcggctgctgttgagcttggaaggacagccatggctgtgttgctgttcttatgcttgatccccttctttcacgtacgccggaagaaagaaactttctacggtttaacccgtcaaacccattgaaaccaaaccatatgaaccggtatttctaggttggtttggtttttctgaccaaaccgccaaagttgatgaataccttgaatttcagatatacacaaccattcaaacattttaggatggtctatggatttctcatcttttgtgaatatattattgtattatttttaaaaaacaaccacacttaaatatttatcttcaaaactgaaaatatttagtcacgtgaaatagaaatatctgacataacattagagcatatacaaaagactagccattaagttagccatttcaaaatatagccaacaaaaaatgcttaaaaaaagtatgaataagaaaacacatgattcttgtttttcatgcacaagatgcttacgagttacaagaaagaggctaaagtggactttttttctataaaattatagatagagaataatgttcctatgaaaatcaagatagccaatcatttaaaacgaatgcatctattagtagctaattcaaaggaactagtatcaatctttcattttttccttcacatttccttcatgccgaatgagcccatagcttagttttgtgtattagagattactccgtatgtcatatatataatgaaaccgtggggtgtttcaaataagcgtaaacattgcatgccattccagtaggcatagaaaagcctgaattccggtttgctcttataggacctatgctatatgcatgaatgcagatcgacttcaatgcggtgtataagcataggactccatgtactgtagcactacacgtctgccctctacacactgtgtttagttcgtgaaaaaagttggaagtttagaaaaagttagaagtttataaaaaaagttaaaagcttatatgtgtatgaaagttttggatgtaatatgatgtgatagaaagttagaagttaggggtagttgggggtgaactgaaatggccggccaccatacgccaaactagtcgatcaactgtaaaaatgcagttctaaaaaaaactgtaaaaatgctctgtatataaagagttccaggtctgtaaaatggccaggtgccctcctctctctctctaaaagaacacgtgacgccttcaaagaaacaaacaccagttgacatagtactagtgtactccactccactacggaggagtactatactggctgtgcgcctatggctatgtatgcggctacagcgaaacatgggagctacaggtagaattttgtcgtcttcacttgtcgcctgcggcctcaccagacagcaggactgagccgacgctgctgtagacggagtaggactgtaggagtactcgtactagtagatgcgtacgcacatcgatacgcatttcctcccatctgcagagaatttttggtacttatgctatttatgacgggcttgccctatccaggagagccaacctgagagatttgctgaacgaacctgcaagtgcatagcctcgtttcttgctgccgcctccctggagtcttccctggcccggttaacctggttaactcgtgagccaacatcgaaccaccgaggtataacgatgacaaaacatcctcgatcgtcttgtaaaactaatatgccctttagttttctgctccttctctttagacagtactctttccgtttcacaatgtaagtcattctagcattttccacattcatatatatgtctagattcattaacatcaatatgaatgtggaaaatgctataatgacttacattgtgaaacggaggaagtattattctctttgaaaaagtgaaaacctaggtgctcttaagtctttgaacaagtgagagaatacaatttactcatctggccataaaaaagttgcatattacaatagtttaattaacgataaatctagtaacatctattttacatgattggtcttttttattttattgctattaatagttaaagttaaaaatggttgacttgatactatgttaaaaatgcttatgttttggaacggaggaagcaagtttttgttttgagagttttcgcttgatgtagcttcacaaacaatccttatttatatgaaataatacatattctcacgtaaactgtggctataaaatattaaaatatagaaaataaatcagaaactaactaaaagctagattctcatgcattatttctcagaatacttagctcggaaatactaggaccttcgtacgtgggcgagttgaatttgattgacatttcgcattggcagggaggcgcaagcagacagtaggacagttggagcttcttcctatgccttcccttgttactggtcgtgctaggtgtgaagagaaatagataattatctatataaatatataggattaactcatcatatacttaaatagttctgaaacgtaaatgtaaagtccgtttttcgtctgacgtaaacagagccgtccgtactctaacagcccgattcatcttccacggcaaacccaaatcggatccacaaaaatctatcgccatctgattttaaccaaacatccagcgcggcatgtggcggcggcggtgctcggggtcgaggccctcgcgtcgggaggggcagaccgcagacaggcaggacagccgtaacgacgtactacgccccatgggagtacggaggggatcagatcgatggcgttggtggcgaacgttgtacaccgcaacagtggcggcgtcgacggctcgacgctgcgctggccaggtcagttatctcgcttcttatttgagaaaagaaaaatgtaaggtgtggacagtttgcctcatattttcttctgttagaaacgtttgctctaatgcagtcatctttaaacacctaccattaccaacaacgcctctacttcgcccaaaaaaaggagaaaaaactctacttcacccgtagaggttaatccaattttgacatatggcccgcgttgaaataatacttttgctgaaaattatacaattcgtcatagtattgattagagtatgtgccttcgcccttcgctaaacaagtttggaagagctggcttgcggtttcgcacaatagccaatgcaatatttattggatttacacttttggactataggacatgtctcaagatttgtagtcggctccttctccgactaactccttttcttcaacactagcgacactccaaaatcaacagatgacttgtggattaggattgtggtcggggtaggaaaaagtttgaaggaatggccgtcgaggatggtacttatagtggacgattgccggagaagtgggaacccgggtccccacctctgattactcgggacatcaaagatctccggaacaggtcacgcggtactgcatcccgctagtcaccagtagactaaggctttgtctcttggtccaactaggtgtgccccaagctcatggccctgagcttggttttctgctcgttactcgggtcccctagtgaaccataagtccataacgatgatacgacctgaaccatcatttccctcacgtctcacggcgatctcacatttaatgcgaaggatacaaatcgaacgggcatgcgtgaagagcaacgaatgacaagatggcgcataccgaccataaacaagccatcattactcctaaaaacccaagggtatgggctagcacgcgacatggttgactgctatgtcacctcgtcgagccccccctcccccaaatgggcatgcctctgcccaacgtcaacacatgttaccaactccaagccatgcactgacacgaggacgaggtagttgtgcgaccccactgcatgcaagcgccatcgccatcttctctaggggagctcttagggggtctagcacaacccccatatgacagcatatgaaaatactcctcttacatgattcccctatgtgggctccatttgtaagtgacgatcaacgtagtatctagattcgggaagaacctatgcccgcaactccgcaaggatggggggtccgattccaaatcagtatccgacagggctagctagagaaagaaaactttgcacaccctgtaagattggcaaaaaagattgagagaataactcgagaatatggtattacgctttcgtgcggcttgaacttgtataaagtgcttgcctccatccatttcaccccatcgtgaacttatgtccgtacacctgctcccttgccgaatccagggggttgtgcttctacttgttattgaagcttgagctctggcagctggcaagcatggacagacggtggggatgatacggaaattgcgcagttgaaggagggtggtaggtgggggtgatggtggtgctagggcgctaggcaaatcatcgccacccaacttagagaagaggagaggtggggagaggggaagagaaggagaatggccaacagagcctcgtcggtgctgattagggggagggggggagagcgtgctacgcaagtgagactgtaacactggatgaggaggtgtcactttgataggagaacgaggagtgcagaggaaagataaggttatactgccgtttaatattgattgagattggtgatttacttgcaaattttccatagccagtcccaaaatttattacagtatatggaatcgaactgtttaaatgtgacccacaaaagaatgtcgggcatgagggagcctagaaaaagagaaggaaaaggaacatctctggtagggcacattcctctctccaatctccatggggcctatcacaaatccgaagaaaccacaaacagctggccagccgaagaacaaagtgattgatttggtagcagcaaatcaacaccatcattgcgcaggaggacaacgagagagattattcgacctcctggctcctgctgcgtgtccggcccgaactaactaaaactatacactaaacgcaacacagctgggaggaggataggagaacttatccagctactactggtcactgctggttcggtggttcccgggacaagaagctaggcacattctcctcccttttttcccgtggcgagacgaggggccctccgccattgccacgcccatgctgctcctcgagggaccagcgcgctagcgctcgcgtttgaaacctttgctgcgtgcttccatcagggagagaggatgatgcggcagctagcagcaatcagccaagcaagcatgcatgcttgcgcaggcaacttttgttttcgcgggcaaagcgcaacggatcgaccgatcgatccggtggtttcttgggtgcactactgcgtaggcttgggcagctgggctgggtatgcagcagtacgatcgtacgtagggcatgatctgaaggctgaagctgccatgcatcagacgagttcatcatggtgcggcatgccggcatgcagctcgttacggcgacggcaacttgggccgtgctaggtttcatgggctaatgtttagccttgaccttttagctttaaattagccctcagagcagactattagccagctataaacatattctaataagataaaagatgagagagaagagcagcgggctatagatttgtagccagctgcagcacggactccaagacacagtgtgtgtatgacaggtgagaccatatattaatagtatagtaagcaactattgtatgaattagctattagattggttatagatgaattggagccagtagtggcctatactattaaacttgctctcaaggatctaaacaggtgggctaattttgagctaatatgaattagcctccctcaaaacattaccctctccaagggacgctaatggggctaattttgtgttgggaccatcaaaatcagctctctctctctccttccctctcctatctttctactctctctctccaccttttagccttgaattagcccatggatccaaacatgccaccctaggctaatgtttagcctactaattcatgactaaacattagctctcaaaattagctctgggctaatcttccaaacagggccttaggcctgggttcagcacgtactcttctagtagtctagcactatactgtactaccaagggatttacagcttttctttttagggatttacagctttaattagaagctgcccaaacggttcagcttttgatttaggccgagtttagatccaaagtttttcttcaaactttcaactttttcatcacatctaaacttttctatacacaaacttccaacttttctgtcacatcgttccaatttcaaccaaattttcaattttggcgtgaactaaacacacacttagattctaagaagctagccagaagctaaaaaaaattagcttttccatattctcaaaagctagataccaaccagctacttctcataatcttaagctctcccaaataggccctctattacactaacacctcacttcccagcttcgagggcagcgacagaagacttctcaaattcttcgaaatagtaccaagcacattaattcaagggccatatttttcccttatcaaaatttaaatcttaaaacttacttttttagttaattttatttttttcatcacagtttcttttcaacattaacgtttaagtcactaaaaacacatatgtaaatattttaatcataaattatttttcatcgctattatcagtaattggccaaccgatggcaacccaaaacttcaccgagcatatatgcattgcacaattgtatcacttgtgttgttagggtttcctttggattattgaaggattttcagatgaaaaaatcttaggaatttttttctagggaagttgtttgttttgtagaatttggtttggcaaagtcctttggaattcatttcctatgccctaatttcaaaggattttaaacatgggtccaacctcatgttatccgtttcctataaaaattccaaagtaacatctctctttcactctctttatcttactcaatcaaagtaatacattaatttccctaaaaactaaagtagtacgcaatcttaaaattcctatatttttttctaggagccatccaaacatatgctatgtacaagcatgtgattttatttctcatagggtccaaccgccacaacatttcaatccttttttttattcatgtgtttttagaatgatgatgtgttcctaagaagcccttattgcttacttctagtactactaagagcactatctatttatagtaccgtcttatctgtctggtatttcctctatcctaaaatataacaacttatagcacatataatttattccaaaatacaacaacttctacaccaacattctttttccaatcaataacaacctttcaccattcacttttcttatatatctctacttctcaaccatcataactcatccccatttaattatacataatttcttaataatcgtgttcaactctaaaacttcttaggccatccctaaccatccatgtcatctagtgtccataccgttaaatacattgtcacatagcaaaaatccgatgagataagagagttaatgacgatagatgtaaaaagatgaagaaatcattctcatgcaagaaatcatctatacacaagaatcaagaatgaaaacaaatggataggtggataaaaggagagagaacagaggtgattggataagaattttatttgaaggcaccatccattcagtggcggagccagaaaatctacacgtgtggggctgaattaacgggaagtcaaatattttcagaattacatggtatttttcaagattacaatgggaatcatggagctagtcatggggctcaagccctagctgccccatgcctgtttccagccctgcatccattggatatatagtttctatacatggtgtttatatgatacggtaatatggaactacttgatagtttctgagttggggatgaccttaatatagtattgtacagaagtgaccttaatatggtattaaataggagtatgttgttgggaacggtgatgaaggtagtgcaatgcaccaaaggatattggggagtcaggcaatactccctctgtaaaaaaaatcaaatctatttagattcatccataggatttgattgttttcgggagagagtgagtcgtcattagcaatagagttcaaaattgcaggcaataatcattcgtggtagagttcaaattgcaggaggaagaacagtgcacaaatataccaggaactcgtcctagccgttttattgaaatccgatccgattgcccataaggatagctacagtaacgacgctgcatgctatacatacatggatgcacaataaactcagagtattgctacattgcattgctacattgtctctgtagatttctgtcccatccgccacagacacactgttggcacactgcttctctgccgtcatagccagatccacgttccaaaccggcccttcacccccgaacaacaacaggaggtctggtgacatcgaatcacaaaacaatttcttcttcttctctctctctcttttgaaaattcacaacaatttcttcaatattgaatactcctactactactcctactgcattgcagtgaattttagtatattcagatcaagaagcacactttcagggagaaagaagaagacaaatgctgtttcctctttatggcaattgcgtgcactgatttccctcctaaattttaagcgatccgtatggaatcagaatgtttggcttgggcaaaagtgaagccgggctggcttttatcatgccagtgggtgactttggggccctttcctcatcattcctggaacatatgtgaaggctggctaccaaagacccacacaaacgcacagcacaggcattctttgtctgcatggctgccttgcgctgtgcttctttgaccaaactccaagccaaaaacaaacgcacacagcacactagtgtataatactagtagtaataccttgacaaagcacaagtgtttattacatgcatgccttgttcatccggttgatcagaggtgaagcgcgattaactaatgcacgtatcaaccgccgctaatacgtgccaatcttgctctttttgagctttctagaacacgtccaagttgagcattgtttcagtgaagcagtgtgctaaattgaatagcagtactccggttaagataattaataggcgggcttgattcgttcgttcgctcgcgggctttgctcgcatttgcgacacaagcagtgcagcccagctaagctagctgttactgttgcgaagtgactggctccttgtacagttgtcctgccgtttcaatctctgttagatacactctccccttgtctctctctctctctctctctttctctctccaatgtccatgaagtctgtggcaaaagcagccttctttcagccactctgggcagcatccagctacatcgtctaggcagcagtagcatatggtggaacagagagaggaagtcctggccatcctgtccaatggcaacttcacaattaaattcttgcatctttatgggggtgcttgtttgtgcttgtgtgctttgaacagcatggtgcttaattgcctcgataagaaaaggagagggggttaagcagctaggagtaccagtggtgttcgtggcttcatgtcatgcaagagagctcagctcacagatccctatggagtggatagctatcgtgggagaggccaagaacaaactgctctagattttgtatcgtatcctcgcgttgcattacggctactactgctgctgctgctacttatccaccgcttttttgctttggccctctcattccttttgcagtttttttctgctcagctcaccgggtcccctctctcatcttcctcgtcgtgcaccttgcatggatgtagaagtagcgagctagcgcgcggcgactgcgagccgagagagcaacgcaagaacggcacgagaggctggcagcgagcgagcgtgtgcatggttggtgcgagcaaatggccagcggcggcggcagcagcaactggttaggcttctcgctctccccgcacatgccggccatggaggtgccgtcctcctctgagccatcgactgctgctcatcatcatcatcatcatcatccacctgctgctgctgctgctgccggagccatgtcgtctcctcccgacagcgccacgacctgcaacttcctcttctcccctcctgcagcacagatggtcgctccttcacctggctactactacgtcggcggcgcctacggagacgggaccagcaccgccggcgtctactactcgcacctccctgtcatgcctatcaagtccgatggctccctctgcatcatggaaggtcactgttcacctctcccttctctctcgatcgatttatataatctttgtctctgacattgatcttcttggtgtgaagtaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggcaccgggaaagggggccaaaagcagcctgttcaccggaagtccattgacacgtttgggcagaggacatcgcagtataggggcgtcaccaggtaatctgcttacaaagattcagcttttgtgtgcatcatgtatcatcagatcatcatctgtgagctgtttgcacatagggtgtagaggccggaaggttccttccttgttatctgaaaaaaagagaaaaaaaaactgttcttgccatggttcttgtactgactagttggcttaatgtgtttttagttctatctactgataggcatgtgtgatctcttctatgtggcatttgatagtttggttagtacacacttgtacattgctgtttttgagctaatcagttattgctcggttgccatttcttgttgtcactcctactatactagtagtaatagtactagtttccagcattgatgagttcttcattccttcttacggctctgctgctcttgttagtcagtggggcgtctactgtttcttgattactactactaataatcagtttaatgcataacgctgcaatggttggatttattctctagaagtacctcttattttggtcctttgcacaagattatggcttggggtggctctgttacatctgatgcctcttcagttccttgtattgatgaggcacctactcttttgtttttgagcaaatcatttgaccctttttatattgaatgacgaaggtttgtgtgtgtttgattcactggagcaggcacaggtggactggaagatatgaagcccacctctgggataacagttgcaaaaaggatggacagacaaggaagggaaggcaaggttgaaccttgaacatctagtactactacaacatcaaaatttgttcatcttaaaaatcttgttgacaatgtcattctgatttttatatttcatcatattgggcgttaccatgaccgaaatttgatcgcttgcagtatatctaggtaactgttgccccttacaatttctttgttctcattgtacttatattttgtatctgttgctgacctttttcttcgtgttcgttaggtggttatgacactgaagataaagctgcgagggcttatgatctggctgcgctgaaatactgggggctatctacgcatataaatttcccggtatggatgatgaaaccgtgtagtacggtgggatatgggactttgattggagtatccattttctgtaatgtggactaatttattgtgtttggcagttagaaaactaccgagatgagatcgaggagatggaaaggatgacaaggcaagaatatgttgcgcacttgagaaggtcagcagcatgctcattttgcctgaattctatgattagattattatcagattgatatgtactagtaacaagctgtttttttaaaaaactatatgtactaacaagctgttcctgctcacaggagaagcagcgggttctctcgcggtgcttccatctaccggggagtaacaaggtgtttcattttgtgctgaacaagcatatgcatttttcttgataattatttcaagaacacattcgcatcaagatacaatctcactgtgttaaatgttaactgcattgcaggcatcaccagcatggaagatggcaagctcggattggcagggttgctggcaacaaggacttgtatctcggcactttcagtaagaaagacagtgtactctatttgatcttagaatctaaacgctttcacaaagtaatgcaccataaccataagtcattgcagcttttagcactaacattaactaactagcgttcctttgggatgtgactatcgatgatctatggaaattgtcttgtcaaagtagatttgccaaagaagttagtagtagacatcaatcagcagcttttactgctaatctctagtattgtcttggagtactgtacatcgttgatgcatttctttcctgatcattctttgcttttccagatggttgttcttttcataaggctgtgacctctgaacaaagcaatcagttgactgttttaactctcctttggactaaaagatatcattatcatgatgcaaaaataaccagattgtaaattgtactttgcagtaggatctacattggtttttggatgtataaacaagatggccttattacaacggagcgtttccattggttaatctatttttatgcaatacaggcactcaagaagaagcagcagaggcatacgacattgctgccatcaagttccgtggcctgaacgcggtgacgaactttgacatcacaaggtacgacgtggacaagatcatggagagcagctcgctgctgcctggtgaggcagcgcgtaaggtgaaggcgatcgaggcagcgccggaccatgtgccaataggccgcgagctcggtgcgaccgaggaagcgagcgctgctactgtcacgggcaccgactggagaatggtgctccatggatcacagcagcagcaagctgcagcgtgcaccgaagcaacggcagatcttcagaagggcttcatgggtgacgcgcactcggctctccacggcattgtcgggttcgacgtcgagtcggcggcagctgacgagatcgatgtcccgggagggaagatcagtggcatcaacttctcgaactcgtcttcgctggtgactagcctgagcaactcgagggaggggagccctgagaggcttggcctcgccatgctctacgccaagcatcatcccaccgccgtcagcctcgccgccatgaacccctggatgccgatgccggcgccggccgcagctcacgtgatgaggccgccgagtgccattgctcatctccctgtttttgcagcctggacagatgcttaattagagccatgttgctgcttgctcgatcttgcttttgatcggctctttttgtaaactaaagcaagatcagcagcaatcaggtgcttatggtacttaaattagctggaagcctggagtagcatacttggttatgatggtaagcactaggctggtggtgtaagtgtttaaccagtaaacccataggtaggacattcaagcaaaatccaaatctctagagcatccactggtagtagtagtagtagacctttagtgttagaccggtagtgttctttgcttcttttgagcctctttttttgggggaaatttggttggaatgtatggctttttaacacgaaatcaggaatgtatggcttttaacacgaaatctggctgtggcattaaaaggaaaaggttcagtgagagctgacatggtgtctctctgctggttcgtttcgttcgttcattcattcattcatcagttaagttggttttgtaatcagtggggtcgtggggaattcactgcaggtatgatcttttgaccggagtcgtcgtcccagctctctgtctctctctctcgtgttgcattcttttgctttctctgcatggcacggcatctcttcatgatggtgacgagaatcataaacattcccttctttttggttggggaacgttgccacaaggcttcctacattccagccccaatcattccaaagggtttctcctgcagattcccacggcaatgtttccatgtcccagcctacagcttcatgatggcatggcctgtgaaggtgagactaggctgacatagtcctcgttttgcttatgttaattacttccaccctcccagaatgtaacaatctagggcccgtctcatgtctagatacattttcatcctattttggttgctatattctgggacacaggtaatataaaccgcaacaacttattgttgaagatgagactgacatagttatcgttttgattaggtttattataaaccataacagattatcaataacttgaaaagtaaataataaacgatacttatgtatgtttatagcaatttaaaagtaaaatgctgaaaaagattgtaaaattactttaaaatttagagttttaaaatttaaattttgcgatttgcttataagctgaggggttccccatcgtttacactctcttcgtatatttttttttcgcgctgtacgtacgtcgttgcatgaggataaggggcttaggggagtcggagttgcagcacgttgtgccgcaatgatgtcaatgatggcatgtaccggaatcttggcggtctcttttaccatgtcagtgtcgtggcggcacagggaggcgtttgacccttgtacattggctgcaaaccgagagcgggcgataccccgcaacagtgacgcgcactatctccccccctttgcctttggcgcttgcttgcaattgcctttgcctctccttacgcgacagcctgtgccgacaggcgacagccgcccgagatccagcaagcgccaagtcgaatttagccaaaagcagatgtacagcttcctccctagcgaaccatgttgctcgctcgcagagtcgcagtcgcaggctcgcagcggcgcacagtcacccgtaccgtgcgtcctcctagcgaaccatgtgcttgctcggccccggcgtcaggcgggcggcggggcgacgggccccgcgccgctcgctcgagcaggcgcgtgggtgcggtggtggcggggtcgggggggtcatcgtctcgatcgcgcgggcgtgtggttgcacgcatgtcatgtgatgggcgggcgcgggcacacggtcgcggtgttccgtttcgtcgttggcgtttgtagccgctcgcgaggtgacaagcgaagcgaggcgggttggtttggttcgaacgcgcgttttttgtttgccgcgcgaggggtggtagcagcatggcagggcagcgtgctcgccgtcagcagacagagcgcggtgtcgtcttgctgcgccccccgcctgttttgtcgcggcaggatttttgcaagttgcaacaacacggttgtgtgagggttgcaacgggagttgtgattttcaca

SEQ ID NO: 55865 - DNA, 1159 bp, Oryza sativa
caccgaagcaacaccatacagagaaataggaacgaaggcggcggcgccagcctctctggcgctgtcctcctgccaccgtggcgcacgcgaaccgacgtggcaggaggagggcgccagcatggctggcgccgccgcctccattcctatttttctgtatggagttgcaacggtgtcatttttattttattttgtcggatgttttttcacactcaggatcacgatacaaccaaccacaaaaaaaatttaaactcgaactatcacttagctaaatctgaaaatagctagcataccacttagtttactttgcaccttcactaaaattagaccataactccttaagtaaaaccctttgatcagcatgttaaacataatgcactctaccactatatgaaattacttaatctaattcaaaatataaccacatgaaatgacatatataagttaaacagtatatagagatgcatttttttttatttttatttcattttttgatatttttttcacacttaggagaacatagaaactaaccgtataaaaaataaactcaaacggacaaaatatgtgacatgtagaattttccaaaactctatcgaaacggacaaaatatgtcatctattaaaacaggcgtaactttatcttacggactcggaatcaggcaaataatatatgcacggacatctacagaaaaagttacatccgattctcctcgcttcgccgggttcggcgatattaaaacctccaaattccgcttgcaagattgtgttttcgaggagagaagtttttcggtggagctttggaaaattccacatgccacatatttcgtccgtttgagtttattttttacatggttggtttctgtgagttcctaagtgtgaaaaaaatatcaaaaaaataaaataaaaataaaaaagttgcacatctctcctctgcactagttcggagagagaggagaggagaggagaggagaggaaaaattttacaggtcacatattacgtccatttgagttcaatttttctatggttggttcttgtgtgtctctaagcgtgaaaaaaatatcaaacaaataaaacaaaaataaaaaaattcgggggagggggcagccactctggcgcactccccctagccacctcagcatcgccccgccacgtcggcaggggg

SEQ ID NO: 55866 - DNA, 13680 bp, Oryza sativa
  unsure (1)..(13680): unsure at all n locations
nnnnnnnnnnnnnnnnnnnnnnnnnnnnnnnnnnnnnnnnnnnnnnnnnnnnnnnnnnnnnnnnnnnnnnnnnnnnnnggnnnnnntgcaccaattcttccaagaccactgcctgcttcagtcgtggactctaggatatcagaaaaggacaatgatgctgagaaagagaactcagaggaagagaaggtatcttgtaaaaaactaactttgaagttttgatctttgattcaatgaatctagcattttagttatgctaattcatcgtacagcataacacttagttatattctttccaggcaattctggatcatactggcattttctgatttttggcatgtaagcgtgtatgccttttataactaatattatgactaatacatgcaaaaattgctgtatttcttaggagttgcacataccaactctgaattttacgctttaccctgttatttaaaatgaagtatattgtctatcttatgtcctgcatatcccactcttgcttatttgcagttgtcttggtccattatttgcccatgtgttccatttgctcccaaaatagttagatttgcttcccagttacaaccttcaataatattaggtattaggtgacggtttcatccaacatgtttgagaaatccgggttcatttcaaccttgccatagaaatgtagtatcccaaaaagttcttgagactgaagggataaaggagtccctttttcgtctgtaaattgatattcttggggagagctacttgcttgtgacttctgttactgaccactttgtagctattgttactatttccttctattatcttttctatcaccacaagcatagttttttacatctataatcgcagtgttactatattagctcaaaaaccattggctttgatcttctgtgcagaatgaaaccggtgaatatactgcaagtgacttgctgaagcagcatgtgaagcgtgcaaaaaagatccgtgctgggtatgtatttgttttcatcttccagcccttttacgtatgatttgtgaagtgagcaagtaagttcaaaatatggtgatgcaatagtgatgattggcttttgcttccaatatgtaagtccagcttgattcttcaggtatccaacgaaacaataatgatgcactagcaaaaatggtaagaagatatattatgaaagtgtttcacaagacaaatgaaaatatgtagtgtgatgttgtcatgttgattgttttggtgtagtcagtttatataacatatattaacaccttaatcgcaagctcaatcaaacttatattgctgggtggagatattaagttagctaacttaacgcccttttatgtggtgtagtggagaggttttaggttgtcattttgatagacggcagattgaaaacattagttgaggaatggctgtttgagaatgttatcttcattagacagagttactgagtgttgtgttccactttgacataaatttctttggcagtttgcaaaaggagcggctccgacggattgaaagatacaagcagcgccttgcacttctcttacccccgcctagcgagcttgggaagcatgatggtcattcgtagaagtgtaaaaccgacccaatttgtattcaagtgttgtagtagctcttatgtagccttggtgttgccgttttagttaagaaaagaaaaatctgaagaagctgaaacagcatttcatctgctggcctgtaacttcgttagcatagtcgttcgagcgacatatacttacccaacaacaaactttgacctccatgtaaacgtcttctccggctgtgttcagcgtttgagtttaacatagttttatgcaatgacttgtgctatttatgctgctggatgtttgtactagacaagaaatttgatggctgtatgcacgagtgtttttgcatgttgtgccattgcgccttgaatgcatgattaattatccttttgtgcttaattccgtcgttacttcgtcttagaaagtatctgtcaaaccatttctcttttgatagaagctattcatttttacctttttgcgtagctaattattaattcacgtgtacatttcaatcttcatagaaaagaaataactaaacgaaattaaaacataaaacacatgtgcaatctattatattactaaacaaattgaaaggaggcaccatgttcgctgtgggggctagaaatttccacattaatcggagaaaaagaaaaggagagtccaactagaaattcgaaataactgaaattcggaattaaaaataagtacggttgaaaagagagttcgtataagaacccaatacaagattaattaatattcagaataaaaaataaaataaatccgaaatttgaaaaaacgaaagaagagttcgagtagaaatacaatttaaaaataactatattattaaaaacagctttaaaaggaggtatcgcgtttgctatggaggctagaaattctaacattaatcgaaaaaaaagaaaaggagagtccaactagaaatacaatttaaaaataactgaaattcggaattaaaaataagtactattgaaaaaaagagtccatataataatccaatacgagattaattaatattcataataaaaaaatgaaatccaaaattagaaaaaaaaagaaagaagagtttgagtagaaatataatttaaaaataactaaaatttagaattaaaattaagcaatattggaagaagagtccatataaaaacccaatacgagattaattaaaattcagaaaaaaaataaaaaaatcaaaactagaaaaaaaaagaagagttcaactaggaatacaatttaaaattaactaaaatttagaattagatatatgaaatattgaaataagagtacatataagaacccaatacgagattaattaaaattcggaatgaaaaataaaataaaatctgaaactagacaaattaaaaatataattcaagtatgaatacaattttaaaagtaaattggaatcatgccattataattttgcaaagtttgagatatgtcatcggtatctcaatgacatataggacccatatgagtcaatgacatgtgggtcatgatggcatatctcaaattttacaaaattataatggcatggttccaattttccattttaagaagactgaaataaatattaaaagaacacaatacaatattagttaaaattcgaaataaaaaataaaaataaattatgaaattagaaaaagaaaaataagatttaactaggaatacaatttataaataactaaaattggtgataaaaaataaagactattgaaagacaaagatcatctaaaacatatgacgagattatttaagtaataggcctataaaggagtagagtgatggtggttgatgggacatctaaaaactattaacaaaaggaaggatgacgggcaggccgtgaagcaaccggttaaggtggttggcgggacttctataaagtaaaaaaaaaaccaatgataatcatatttgattttttaaatctcaatgataataaaatgaagaggcagtggacgggttgtacaggagtacaatggcaaagccgcggatggttggtgtgacttctagaaattaaaaaatgaattccaatgatagttatgtccggtttttagaatcccaatgaatataaagagtaagcggcggacgggtcgtacaggaatatagtggcatcgtttgacgtgatttcaaaaaattataaaaaatgaattctaacgagacaataaattataaaaactataaggtccaactttaaaagttcggtcttctaaaaagtaaaaaaaaacttcaatgatattcatgtttgattttaaaatctcaatgacaataaagaaggaaggcaacgggcgagccatagaggagcacattgacaaagctgctgacgttttggcggaacttcttagaaagtaaaaaatgaacccaagcgataattatgttctattttgaaaataacaacgacaataaaaaagaagaggtagtggatgagccgtataggagtataatggtagcgtttgacgggacttctaaaaattataaaatcgaaacccaacgggacaataaactctaaaaaccataagatctaattttgaaaggctccaaatagaatgaatagaaacagtgccagatcggacaagcaaataaagaaggatataacagaagtaacagatagcaactggtgtgacttttaataaaaaatataaaattagaaacatggaaatgataagatttgaaatttcaaagtcttaacaacaatataactatttaataaattttaaataaaatcatattaaagatatataattttgtataggtgctaaccgcgcaattgcgcgggccacccaactggtttcctttcaacaaacaatttcacggagacgctgatcaacctgatgatcagccgcggttgaccaccctgcagttcctcctgatctcccccatgctcccggtgagcgggctgatgttgcccatcttgaccatcgccgtcgcgaagctcctgaagaagtcgtcctggctaccggcgaaccacacgacgatgggcgcggtggtcgaggcggcgccgcccggcgcggagagcatcccctggtcggactggagcaggccgcggttgcgcaggaggttgccgtagtagctattgtcgaacgcgtccggcgtgggcgggtcgaggttgcgcagcgccgcgctttcggggtcgctcgccgggcagctctgccggagctcgttgaggtaggccatgtccagcgtctggtccggctgctccgtgccgctgatgttgtagagccggtcgtggaagaacctgcactgcgccctcccgatggtgtgcgcgccctggagagcgacgaagtcggtgtcgtcgaggttgaattcggagaatttccgtctcaggaggtccagatcgtccgtcggtccggggaggtctctggcgccctcgaagttcgccgccgtgccgtccctcctccccagcatcacgttccagctcggccctcctgactgctcgacaagaaagcgtacgtgtcagcgatccacagatactatatggttcggcgtgattgaatgtttgatggcatgggtgcgtgcatggactgaccagctcgacggagatctcggcggcgagggcgaggatgtcggcgcaggagacgacgccggggcaggcgttctccagggcagccttgatgccgtccaccacgtcgaacccacgcgccgaccctttgttcgggggcgcgttcttctcgctctgcatcgcgccgaagtcgtcgagcagcagcgacccgtcacacccctgcacacacaaacacgttaatcccagctcaaatatgtcacgcaaacgccatgcatggcacgcaacctaggacacactgtacgcacattgacgaagcagtcgtggaagtggaggcggaggaggctggcgggggcgcgcgggtcggtgcagcgcgcctcctggacgacgcgccgcacgatgtcgtacacgcttgggcacgacgcctcgtagtacgacgggctcatcaccggccaagcgctcgcgccccccgccgccgcgaggacgaccagcgcgcacaacaccaccaccgaagccgccgccgccatgcacgccggcgaattaaagtgatctcgctaggaaatttttgctctctgtgctagctatatctatctcgccagctacctcagctcggtgactgtgagattagctaagcttggtgttgcgttgttcgtggagcggacatggcgtcgccgggtgtatttatataccagggctcgaacgaggtttgacatgttccggctacggtagttgcagacgccgctttttcgtgcaatgatgtgtggactccctccaacgccaacgcgtactacttgcctacttgatcgtgtacttgtgtagtggttgagcacttgagctgatctgctgatgtgacagaaggggtctaatttcttgatcgtgaccagatagaggtgattactcgagagagcaactcgtcggccagaaatcgctgaattgttagtttattgtattattattagtacaaacagtaaaccttttagtattatactctgcacacacgcattagataatttcaaaagcgtgcaacatttggcttgtcaggtgttttgccttgcaccttcttcaggcctccaactgctccagtatttaccagttgatgaactggtcttggattcttactgctataagtaattttcgtgacatagaattagtctgatgattagaagggatcttcacgtactttcttatgagtctgtataactgaaaaaatcaactcaaactaagcatctaactagtacaagaacgtttacttcttgaagaaaaaaaaaaggcatttcctaattttttttagtgaccaatcatctacggaactaggtgaaacccggcgcgttgctgcgggatttcagtatgataacaataagtaaaaataatatgtaagatggctaacaacatatacttacataagttgatatggtttatgataatttaaatttaaatagtatatagacgattcaaatgtaaaagtaagatattgaagtattataagagaataaagggagtgagatagtttggaccatagattaatcatttaaggctaaaaataattgatgtgatatgatttaatgggagaagagagaaataacactaactaagtgaggatgtaccatataggtatatatgatattatcataaatgatgaagatatatattgaaatattatgtgaattatttggagtgatgatttaacatgtttacatttttaaactctaaaatttaataaattataaaattatagataagataacatgcttgtatgatgtttaaatgtaataattgttaatggatgatgatgtgatatattgttaatgtattatgatgtgacatctttgcatgttgagctttagaattagtgggttataactttatagtaagataggataagttcattattgtccctcaacttcacgttgagtcagtccgaggtccctaatctcaaataccagaaatcttcacctctcaaatgttcaaagccgtacaaaataggtcccatagcataggtcccatagcattatatatgggtggttttgctgacatggcatccgcctagtcagcaaagaaggaataaaaaaattacagagcccatatgccatttacagagcggtgccgcgccgtggagttgaggaagatcccgaccttggagaggtcggcgccatcccccacaacggagaggtgggaggagatgacggaagcggccaccagatcggaggcggtgagataggtatcttccccggagaagtacgagaaggggtctcggagaccgtgctaggtttgacggcgagggcgtaggtgccgccacgaccgccgccgctgccggcaatggaactaatcgatgggcgctggctgtggcgatgggaaccggcttgcgagaagaggacgcagagctagaggccatagcaacgtaggagaatggcatggccggcggtgaggtagttgcgaggatgaagcaggcgaagccagctggcggagcggtgagcggagcaagccgctcgccgccgcccgctgccgcgctcgcccgcagtcgctctcttctctgccgctggcgcccctgctccgctccacgcgggcgcgttgctctgcctactcgctctagactcttgtggtcttgccgccacccgcttccacatccttctctacggcgaagagaaagaaaagagaagagaaaagagaaaagagaagaaagaagggatgcataccccacatttttattcgtctcccttacatgtgggtctagattgctaactgggatgccatgtcagtgaaaacacccatatatactgatatgagacctattttacacggttttgaacatttaaggggtgaagatttctgatattggagattagggacaccacagactcgacgtaaagttgagggatggtaggggaacttattccatcatcatctacctcggcaagaacttgcccggcccactaactagaggcgcagctgggccaactattccctcggattgtgcggaccatttcggctgcccgtcttacactccacgctcccctcctcttcagaccaaaccctagctcgcaccgtataaatcggcgaacatccagcctcctctccccccgccgccgcagcagcaaggagctagagagacaaaggggagagagccccggggaagaagaagaagcagcagctagggcgccaagatgcaaatcttcgtgaagaccctgactgggaagaccatcaccctcgaggtggagagcagcgacaccatcgacaatgtcaaggctaagatccaggacaaggagggtacgcacccactacaccctcttcttcttgttgttcctcctccttcatctgtggctttgcggcggtagctcatgggggtttgtgtcggcaggaatcccgccggaccagcagcggctgatcttcgccgggaagcagctggaggacggacgcaccctggctgactacaacatccagaaggagtccaccctccacctcgtcctcaggctccgtggcggtatcatcgagccgtcgcttcaggcgcttgcccgcaagtacaaccaggacaagatgatctgccgcaagtaagctacaaacttctcaccaaatcatcttactttacttttatccagccatacaacatattcgttcctttcttgatgctatggatagtggtagcatgtttataagcaggctagctagccagcgcgtttctcctgtacttgtgccgtttatcttttgagtatatggaattgcgttcgtcaggaatggagccaaaacctagagacacatttttattcagccttggaataaaaaagataatatttttattgtttcgttacttatttgtggtgcactcttctagctttaaagataagtcacttcggtcaccattaagtggacctgaagctttcttttctgaagagatgcaagataaattatggggacctctggacatgcggcttcttccagtagattctcgcattttctcgtaggtccaacacttatataacattttatcccctactttcagctattttgtgagcatcagagtagcaaaaaacagttatttggctcgatgatgactactcttgctttaaccacaccgaatttgaagaccggaggaagtgtaaaatctcatttctttcattactctttgctcttccttctcggtgattccttatgaaatctcttccttttggtgaagaactactacggaatttattttcgtagtttttgtcctttatcaaaagattgcgattgaaggatgcagcgagatagtggagcatagtgtaaaaggaagtgggaagctatcttctgatggatcttcatgtgtggaaaactttggcctagactgagagccatcaatgtaaatgcccttagatttttgctgtggccatcagttctgggcacattgtcttcatagatactccggaagagtgtaagactctggaagatgcaccatgcacggccaaagaatttccatgttggcatgttctagacagctattatttggtttagtcttttgtgttattttttctgtgttttatgtgtcgagtgtgctacttttctacctggcagtagtgatgaatcaattagatgtgtgaagtgaccttatgaacttaacttttgaggcatacattctgtctgaactgccatatgtacttctcttcatagttgcaaattgcagtgcctatttgctttgttcattcttgttatttttggttattgattatcggtgtgtgaatttggttttctttatttgtttgtatggacagttggtccttttttaattggcaggaatgatgaatcaattagatgtacgaggttaccttatgagctaaaattttgaggcatacaattgtctgacttgccaatctactgttgtatttcagtgtttcgttacatgtctgtggtccatgttctcttattttcaattgcctatgtatgtgcatgcttttatttgacatgctatttgcaacttttcatgctgtacataactcccaaggggtcatgttttatatttctgtatgtatcttggactgtaaaaaaacaaattttaactttgaccgaccttgttatttatctacagatgctatgcgcgcctgcaccctagggctgtcaactgccgcaagaagaagtgtggtcacagcaaccaggtgagcttgatgattgatagtggggcttactattattttacagtagtcatgcaattcagtccatcttctggttaccctttaggaattgttatgatgattggatggaagtagggttttcatatgttctagatttgttatttgtgcctttaagcttgtaaataatggccatggcatttgctagcatgatttcaataacatataccataacatatcaacataccctttttattttggctgtttgatctaacgaaaatttctggtccttccactttcagctgaggcccaagaagaagatcaagaactagagcgtcactcgccgggttcatggactggttaaatcaatcgtcatattagacttttatgcttccgttgttatctccctggatgttgttgaaccgtgttttactgtgctggatgcttcagcttcttgttttgacggtcgtggtatatggtaattggcagcaaactatattggtcatgtcgaaattgtcgtgcgtttcaatattttctagtgttgttttcgatggcaagcggctctgctcccaggctcccaggtcccagctctctgctcgaccttatgtaaggtgtgcaactgtggcaagtcacacctcgtttgcaatgttaagagcatcaccaagatccatccacaaaatttagtttccgtgaatcccaaataaaatttaaggtgcaaaaaataactctcaataataaaatgtgggctactcttaagtcttaactaccacggaaacagaaattgctatgcacatctcttgctataaattgctatgcacatatctttcttcttgccgtaggaagaaaattgagaatgagagcgctttccgactttgtgaagagaatgcattctggtttagagttttttttaaaaaactttgtgaagagagtgctttctgatttatggagaacgagaaaggaggacaaaatgtaaatttttaagacatatttgaagggaatcgttagagcacgtttttcacataagaaatccaaattttaggattaggcttcacaaaggaatacgataggccatgctctaagcatcatccaaacaactcctacatatcgaagcttaaacacagaagaaaaccatctttatttatgttgaatcacaagaacaaaacatcaggccgtgcttacaacaattgtaacgtacacaccgacacactcagaaaaattaaacgagcaaattaaatggcacaaagtgaatgggcgatcaagcaacgaaatcaacatgggctttcaactatttgtcactcttacgaatggtgcttaacgatttaccactagacccatacgtcatagacacatgaggacccacatgttatagacagtgaggggtaaatcgttaattgtcatatcataagagtgacaaatagttaaattgatttacacgggacgtcgatggagaatcatgcatgaagctgaggcagtacgcttataacagagcgaccggcttcatcccctccttgatggccgcaaccaggtgctcgtaggcttcgccccacgcgtttttcatctcggggctccacatgctcgccggaatcccatctttgatcgtctcaagcagcgcgaacctcgccacctgcagtttaatttcgatgcaacaacaccatcagaacacggtcgagttttcacgtcgatcaaacgatccaagcaactcctactacatccgtcttatactcttatttcaagtacaactatcggtttctatatccaacgtttaaccgtccattttatttatttttttattagtttgtttgttattagatgataaattataaataatattttttacgtgatttattttttaaattttttaataaaatttttaaataagacgaacggtaaaatattggatataaaaacatttggctgtaattaaatgggacggagcactacgtatacatacctcgaagtgggtgtcggagacgccgttcttgaagtgcgtggagcccagcctcttgatggtggtgtccctcacggtgaccctcccggttttccgcagctgcgcagccgcctcacacgtctgcatgcgagatccatcgatcggttgatcgcggcaaatgcgcgcacaaaatctgtcagtgtcagctgcaaactctagtacaaaggtcggcgaaactgttttttgtttaccatgacgaagacggccatggcgtgtttcttgagattggggttcttctcgagcggcacatcggagtttcgcaggaacgagaacagatggcgagccgacggcgcgacctcgaagatcctggagtacagatagagtagcagcagcaatcgatcaacaaatgcacttgaaagttgcagaaaacggcagtgaaatgtactcatactacgtacttcaagaagaagcggtggccgatgttggcggaatcgtccttcatgatagcccacgacttgagcaccagcgcctcctgctcctcggtgaacctgaccgccccgttgcttgcgctcgcgaaagccatggccttcctgaatgaatcctgatctaccaagttcctgctttgatttcacaggtgatcgattcgatcgcagctagatcaacccgatcgagctcagtgcaactcaactgctggatcgatgctatgctatctgaatacaaactgcagcagtgcgaggccgatttatactggtcgatcggtccgggaatgggggcggccattggctgtcgatcgtgtcgacgagcgagacgcatggtggtggcactccacgtccactccagctgcacggaaggaagcagaaaaacgacctgaatatggcgaatatccgtccatgcaagccgtgaaaactgtgtgcccgagtgcagctgcgagagcgggaagctgcacgaaggcagcatgcctgcaactctgcattgtctcgcggttgcatgatggattgatgggggcggttttgggcgcgccgcgcgcggaaaccagcggcaggtttgagttaagaatccagtttatccaagtcaaaccatccatggtcccggcccttaatttctttcttgcctgaagactcgaactagaggcgagatggtttgttcgtgctgcccaaaagggcagtggtggatggaacgttccacaaaaatgggagaaggtgacgaccattttttggcctaacttaatacatattgttacaagaaaaaggtccactttatatccctcaattataggttgagttttattcatgtcgcttaaccgcaaaaccagatacggagcatttctcaagtatatgagatataccttatccataacattgataaattttgcgttaaaaaatctacttgttatttactatatatatacactaactgtacaatttaactttaacaaagatctcgtaggcagatgcggggtgctcgaccgcacaagggctcccaaaactaaaggctcttataggttttaattcaatcaaatattgcgtcttaataggtttcaggacatccccattccatctttgtaagtttcacatcccctgctccagtgatctcgctggaac

SEQ ID NO: 55867 - DNA, 6596 bp, Oryza sativa
  unsure (1)..(6596): unsure at all n locations
catcttcttaaatttttcaatttttttcataatcatttgagtgacatgcatacaacgaggggatatcccctcgagggatgaaaatagtttttccacattggatttagggacaatacttctgatgtggatagaagatcaccagccacatcgtggctgtggtctgtggctgagcaaagcatagagataatgaatattacaatgaattgtaaattatgtggcattaagtgaaatagtctataacattagtttatttgtaacttcaatttacatgcacagtcaaaagtaaactctactattttacttgctgatatttttaaaatagagggtcttatcgtaggtttagcgccagggcctccaatttataggatgaccgggggaaagtgattttatccctcgagagaatatccccttgttttatacatatgccacctaaatagtcataaaaaatatgaaaaaaaatggcaacgtagattaatatgaaatatatcacttcacaaacatacatgtttaaactcaactactacaagttgtaacaaaagtaacaaatatagttacaaatgtgcaataactattttcagtttaatttgttattttttttgaaacttgtagaagttgaaatttggtcctgcatgtttatagagtgatatatttcatattaatctatatgtttttataattatttagatgatatttaaataacgagggaatgtctcttcgaaggatgaaaatccacatcctaatgatcgaaatgatataagtcggctgagatgtacttgccccaattgtcttctcttttctaaatgttacatatccaagcgcatgcatgacatgtggaacaaaaaaatgtctctttattaatattttgtcacgagtagaaaaacaacagtgcttgcatccaacgtacacacacggacactccattctcggcgaagaatatatatcagacgagcatatatataatggaaaaaaaaacataacaccaatcggcgagcaacgaacgatgtcgagatatatatggaggatcttgattcttgaaggcttgaaggtgcacacgtattacgcagcagccggcttcatcccctgcttgatggctgcaaccaggtggtcgtaagcttcgccccacgcgcccttcatcgcggggctccacatgctcgccggaaccgcctccttgatcgtctcaagcagcgcgaacttcgccacctgtttgttttacaaaaatcagaacacgatcgagttttcgcgtcgatcaaatgatcgatcgaagcggccattaattagctagagatacctcgaagtgggcgtcggagacgccgttcttgaagtgcgtggagcccagcctcttgatggtggtgtccctcacggtgaccctcccggttttccgcagctgcgcagccgcctcgcacgtctgcgacacacgcacacattctccgtcagtgattgcggcaaaatcttactcatcgacggcaataacgaactatatatggagtagttctaataccatgacgaagacggccatggcgtggatcttgagcttggggttcttctcgagcggcacgtcggagtttcggcccgagggggngaccaccgagaacagctggcgcgccgacggcgcgacctcgaagatcctggagtagtacagatatagattagaaccaatcatatgcagacacacacatcaacaaatgtacaagtgaaaatgtattgcttaatgcttgagaaacacatggttggtgcagtaactgattctgccaaaatggcagtaacatttttcttacttaaggaagaagcggtgcccaatgtgggcggagtcgttcttcatgatggcccacgacttgagcaccagcgcctcctgctcctcggtgaacctgactgctcccctcgacacgacgttgcttccgttcgcagccatggcttcctgacaaaattcctgcttcgatgtggttactctgcgtagcaagtgatcgagcaagggacactgctagatcaattcaagctcaactgaactcaaatgttggttgctgcctgaatccaaactagagcgtagtgaggctgatttatacaggtcgatcggtcccaggatggagctggatctgatggtcgtgacgagcaagagaagcatgcttggtggtggcactccactacagctctacgtactggccggaggtagtagcgaatatccatcaatcaaagccgtgaaactgtgtgcccgagagaggccgggaagctgcacgacggcatgcccgcaaggccgcaactctgctgtctgcatgtctcgctcgcgtctgcataataggggcggtttggcgcgccgcgcgcggaaacctgtggcgggtttgagtttagaaaccaagtcaaaatttgttcgtattcgtgccgcccaaaagaccagtagtggatggaacgttccacaaacatgggagaaagccacggcccttttgggccaaattagccagatgttccgatccaggtttggcagccgaagggctacgcacaaatgcctgggcattttacctctagaagattgtcaaaagttaaatctggatgcagcaatatcacgatcggataacaagggagctgttggagcagtgtgtgccgtactatatcaggtgaatttgtggcagccagtactatggtctgggaagggttctctgactcagccatttagagacacttgggtgcaatgaagggttagcaacttagcaatagctatggactgcaacatgtcaaaggtctatgtagtctcagactgccttgaggttattagaagcatctcagagaagccaagacaccaatatttagtagtccttaatgatattgaggcaataaagaagcattctgtgaaagtagaatttcgtcatgaaagtcagccttgtaattttgatgctgacaacttagtttgtaagtttgcttctactttataggaagggcgtcatctttggttttcaaatcctccctgtgatatgaataggaatgtaaacgtggatgataatgaataaactgtccgcttttactctaaagaaatgtccatgcttttctctttcaccacattgtgggcagtggcaatggaagtacagtgagacgatgatgcttcgctagagttgtggagatggagggtggtaggcggtaataacaatagaagaatcttggtaaggtagttaggtggtggggatggtagatctagtggtgggagttgctggagacggaggaggtggggtaggacaggggcacctcatcgaagtagttaggtggcaatggagagtggtgatggttttaaaggctctaacgccagaggcaatggaggaaggcagggtgcgggcacctctctgaactccgaagtgatttaattacaacacatatattttttttatattagaatagtactcactccgtcctataatataagggactttggctataattgtatatccaaaatgccttatattatgggacggaggtagtatcatttaaaattttgttatgaagatttaattataatgatataatcagattgttgatcgaataagtaatttaaaaggaaaaattatctaaaacttagctattagtatctttttcttactattgcatgtttggatactcctcacataggaaagagatgcatggtactttttatcatttattcatgcaaagatagagtcgtacaattgacattgcgcgactaagatttaggccctgtttgaataagtggaaaacaatatatagaaaatgaaatattgatgaagggtgtttgtaagacatgattttttattatatattaatcttattttcttagtactaaatccttttcatttaggctctactgacatgttattgaaatcttatccatccttttatctagtctacttgcttatcaagtttttgggaaccatgatatactttaaataaaagattaattcaaccttagctaatgcactagctctctcctttgttgtcacttccatgggaaaattgtcattagtcttcactacatcttttttcctttgaatgtaaaggaagattgaatcacagagaacatttccaaaggaattgttggctccattcctccattctaaagactttcaagggtagaaaaaaatactacagtttcaaattgctttgattttttcctttgaaaatccttcataccaaacacagtctaagaggagttagttctttgggcccttggttagaacaccgtaaaatctgtatacaatccagtttcatcttccccatgaagaaaagtccaatataactccctcaactatatatcgaatcttgttcgtatctcttaacttaaagccgggtatatcaactcccgttttgtgattgggaatacgaataaaattcgacctacaattgagggggtcaaattggaccttttcccaatccacagtggaaacacgccttggcccagtcttgaatgggctggatgggttgctctgcctgtctccctccgtgcgaagtctttctatttccctttttggcaaacgtccacaacgtcagaatttgacctgtcgcgagcgagtgccggtcaactcatccattgacggcacgccaaagttctccttttttttcgtttgttcaaaagcgcatgcaagcgtagaaaaccatctttatttatgtcttatcacgagaagaaaacagcaggagcgtgcaccaatcgtacaccacatacacactcctttttttgtgggacacgatgaatatgaaacgagcatttgaaagcaacaaaagctaatcggactcgcgaggcgaggatcatggaggtggagcagctagcatgcctgtcgatcactccgcgggcttcatctcctgcttgatggcagcgaccaggtggtcgtaggcttcgctccacgcgctcttcatcgccgggctccacatgtccgccggaacctcctccttgatcgtgtcaagcagcgcgaacttcaccacctgtttacacgatcgatcgatcgcatgtacgttgttcgacaaagacacgatcagaaaacgatcaagtttcatgtcgatcgaatggagcgcaggcagccattggggatcactgtacctcgaagtgggcgtctccgacgccgtacttgaggtgcgtggcgccgagcctcttgagggtggtgtctctcacggtgaccttcccggctttccgcagctgcgcggcggcctcgcatgtctgcaatatcgattgatcgcgacgcacgcacacattctgtcagtgtctactaccacaacaaatttacttgcctgaaataatgatggtagtattaccatgacgaagacggacatggcgtgggtcttgagcttggggttcttctcgagcggcacgtcggagttgcgcaggaacgagaacatctggctcgccgacggcgcgacctcgaagatcctacaacacaatcagacacacatgtatcagcgaaatgcattgctcaatttaatgcttcacaaacccaatctctgattccgcaaaaagagaaatggtagtaacacgcatgtacatacttcaagaagaagcggagggcaatattggcggaatccttcttcaagatcgcccatgacttgagcaccagcgcctcctgctcctcgctgaagctcaccgctacggcattgttatcctccacgagagccattgcttcctgacagctggttaatttcctgctttgatcaatttctctgtaacaaatgatcgagagctagctgggctctgaaaacaactgctggtttcgatctgaattcaaactgcgcaggtgaggccgatttatataggtcgatctgacccagggtttagcggcctttcgcgctcgcgacgagccaagaagcatggaagcgttggccatcgtgccgtggtggcagttgccgttccactcccaagtctacggcaagatgtacagggggcaaagaattgaagatgattcgagccaaaaaaccgtgtgctgaatgcagctgcgaaagcgggtagttgtgcgaggcagcgtctcggggctgtttagatacccaaaaattttacgccctatcacatagaacatttcaacacctacataaaatattaaacatacgctaaaaataactaattgtatagattgcaactataaatcttttaaacctgattgctccatgatttgacaatgtattgctacagtaaatatacgctaatgatagattaattaggcttaataaatccgtcttgcggtttactgacagatactgtagttagttttttatattagtgtctgaacaccctgcgataacctatataatatttgatgtgagatctaaacacccctcaataacgtgggcgcgtggaaaaccattggcgggtttaagaatccaagtcaaaaacgttccactttctttcttgtccaccaagacggaaatcgtcgtccgttcgtgccatccgagagaccaagcaggtagaacgttccacaaacatgggccaaaagccacggcctcttttcaggcccagataactaactttccaagtttgttgggccgggcccaaaatatcaactttacaaggctctgtacattgggccgtgaaactttacgtggaggataggtgggccgttggcgcgggtgggcccacgagctcccgcgcgagcaggtagcggaag

SEQ ID NO: 55868 - DNA, 4889 bp, Oryza sativa
ccctgcaggtcttccttctccttggacttccatttcgggtacaggagtagtctcagccactgcacaaatcatatgcaattcaagatggcaaattttaccaatcactcaagcaggtcaaactgtgactaaattttcagggactttggaaggggaggttgtgagagacgctccagggtcttccggctagcttcttaaggtggtgagctaaccggttcgaagcctcactccttatatttatttgatattaggtcattccctaatattttcgtttttcttttttttttgatggggaggttgtaaaatgcaggaagtaggacaaacctgtgtaggagagtgcactcggcagcataggatatggtactctatcaactccgggtttactctctggccactgatgaggtaagataactgtggcacagaagttgttaccagattatgatttcatacggaatgagatactgctatatcattctatctaagaaaattgcagtttgaggatgttttccaccttagtaagcaatattctcttgctgttactttgcggaatcccgtattctatatgggcctaaaagaaattgtcaacattagactccacaattgaagaaatatagcaagacagaaatgtgggttaagaaactagttacatgcatcatcatggcattgtgcacattgatccagaaagcaattttttcttcatttttcattccgttgagatcagcactttctagcagctgtacaagagacctgcagaataacatcttttactagtctgcaaatagatttatgcatcatttccagcatgtcatgaacaatactcacttgtatttgtgtagcatgtctttaacatcagcagacctctgggcccccttgcaaagagcagacacctcaatcacagaatcatattgttgactgaagtatcttgattcgccagttcctaacgcatcgtcttgccaggcctcaatatagccctctttcctacatcttgggctccatatatccccagtgtatttggaagagagcccgctcgctgatgaaaatgatgagcatggtgaggggaagaagggatgttgcacggcattgaagtccctaatccttatgtatatcgaagcaatgcatttgatcatgtcctcagatattttgttcggtgtttgaggaacatgatctgctatcctggtccctaggatatccgccaggctcacaataccaggatccatgcacttgccctcctggtcatttcaattatgtcagtatcaacaccgttacaagtatatgacaaagatctgatagcaaagtggtttaacaggtcagaaatgaaagagagttttcagacatcgtcctgcacctcgacaaaggatagaggcaaagtatggcatggtttgagagccctagcaagattgtttgctgaaggagatactctggctgaacaaatggaacgctgcaggagcgaggaatggctgcgtccgataccagtcttgtcattgtaatgtgaagttctggtttcgctagtgagagttgtcggtgtagacttgcgtgccatgaccatgccactggactgcaggagttggtgtttccttggggttgagaaatccagttctgaagatcctgtgagtatacctgagaatgaccttgctgactgcttgttgatttccatgtcacaggaagaagacacgctgcaaatttgttgatcaaaggccttccggtagagtgctaggagatgttgctccaagcatatgacctctagctccagcacagcaatctcctttattagttcctcagtaggctgagacaacatgagaagaaagacacagaagctttcagtaagcaacgggaaaacacagccttcaaaaacatttgcgatacaattgaggaaaaaagtggaggaaaattttacctttggaatgcagctctcattggatgaatgaatggcacaaggcttataacctaatgctttctccaaagcacgccgcatagcaaattgatcatttagtcgcttctcaaggtgttggacctgcagagctaactctatgtatcaaaaccaatctgcagttctgcaattctgtagtatcactattaccttacaaattacagtagaaccatttgtttagtcttatgctacacttgggcaggacaaaataaaggataccctgtacttggcactactcaaaattgggatgtctctttaactctagcaatgcaggaatgaatgcctgttacggaactctgtactacgacttcccaactgaatcttaaaatttcacatcattaacacgctttaaagtagtccatgtatcacacaaatatgctacaacatcggaaactttgtgcaatacttgcgatgtctacttcttacctcttgtatcaaagagcatgggagctctgtagtccggggcagcctcttattggtgctattctgatccttcagttcttcggcattcttccgtgaacagaaaaatagaaagaaaagtgagatgttttgggttatggactgaaaaaaagagagattatattccaaagggacatagcaaatgcactagtcaagagttctgtactgatcttgggcagaagaaaatggttcagaaagttaaggggaaaaaggaggggaaattctgctgtgaaattttttaccagcaaaaatgacaccgacccacatgcttggagtcaagagaatgaacaaatgaagcaataagtaacaagccattttatctccaccaccaccaaattacctgtagatgctgaacattgcaccttggggaagacaaatccgtgccatccattctgagcattctaacagagtcgctgccgatgcaaattcgtcaagatcattaggcattagccaagaactgatcctatctaaaacatgtagaatcatagcatctggtcagagatcaatatctgtaacttggtaacaagaagtaaagctacaagctttattttcaacctgcaaccccaaccagggtgctgtaaccaaagctacaagcttctcacctcttggagcggctatgatacattgagcaggttaaggaaggagcctacaagtgaacaactccgctgcaagcctgcactgcacctctgagctcaagaagggctcctcctctctaatctttgcacaggtgagcccatcttagcgaagagttgaactctgtaaccactaaaactacactatcagttagagaactaaaaagagcaaatgatgcagggtagagactgcatggaatggggaagcatctcacctttgcagataaaatcatccaaaggaagtgggagcctgggagttgttgctgtggagttgatcacctaataaagtctttgagcctttgagctcttgacaccttttttcctctctctttttctcgtgtaaaagttgcttcttctaaaggcccctttctttctctgctaggaggatgagggtgatgaacttgatgaggtactacactactactacttgtactagcagtactgtccctactgctgaagctcttatatcagtatcatgccggatcgatcctgtccggctattcagatactttgtttatggtggaagatatatttatgtctgtcctaaaacttaccaacttcctttcttttttatgcaagatagaggtgagagctcaggaaaggcttcactctattccatccagatctggttgattccagttatttatgcccaaaaggaaaatttacttcacccaaagtggctgacatttttaccccagtaatatcagatcagaaggtgaatatataacctaatcttctgccacattataagcctgtcccacctgccacattagcttggaggacctctaaaactagtattcttcagatgtcaacacatgcctttttttttccattttcttacaaaagaaattgtttcaaaaagttgagtaactctcgtttctaaatacgaagaagtctacttttggtctctcaagtatgaccttggtttggttttagtgactcagctaacacttgaaattatccgtatttcattactccacccaacctaggtggttttcgatgacatgacgccatgtaggattaggcagagaaataggaaaagaaagtaaggttgatgttgtcactcctcatccatgtaggcaccgcgacatctttcagagctgctggatcaaaagtaaatggttttagttaagggatctaagattcaaagttggaccaaatacatacagttcagtgacaatgtagtacagatttttctccataaacgatggtaccgtttcactgttttcctgcaaatgttctgtgttccccccctacaatgatgagcagctcatatgcagataaaattgcagcagcagagaaggacagtatcatgcatgtcttttctttgacctgtgactggctctgctccggtaattgatggagctcgtcctatgcgtgtacaagaccacgccagtgaacaccacggacagcggcaagtgtgtgcggagaaggcatggagttacatgggagacccacacaagcagccaaggaaatgtgcagcccacacccagtgctgtctcggtgaatttgtcattttttttcgcctaggaagaggcgctcccttgccctcgtttgcactgccttcctgagtgaactccaaaagaaaatttttggcaggtcatgtgacacggtcacatatcttactgtctaccaccagtgcagcagcgcagtgcacgacagtgctagctagctgctgctgctgctactaccaagtactcgcgagtcacaagatcgtcacagccaccgtcctgcactgcggctatagttgctaccatcctgttcggatcaatcataatcattaaccagttaccgattgttaagcaacaatgtgaatcattgctcttggcttgttaactgtgatgcattccagttactgtcaatgccacagtttt

SEQ ID NO: 55869 - DNA, 11159 bp, Oryza sativa
cactacaagaatacaattctaacattaaaatttcattgaagaaaacaattagtacaaggtaatattttgcttccaaaccatcctattcaattttctccccatcttacaaagcacctctcctcatttaataatgtctaagtcatttactttccatctactgatttgtcttttgaatgataaaactacattcttttaggtacaaatggaaaatatcaaaaccagaatacataaaatccacagaagcactagttgtgtgatcaatgagtcatgggtgcgtgagcgtgactccaccttttagggttcaaattctagtgaacattacgtacaggccgatgtacttagaatagaattttagtaactaaggagatgttgttaatctgtctttttagcgtacaatagagaatgcaatcacgggtacataagagtggtgtgtatgaatgcatcttccatgtaatcgagaaaaaaaacataaaatcctcatacacatataataccctcctagcgtgtatcggcaaatttgccacggtagtttaggccaacttcaaggttgctatggtttaccttttgtttgaacatcgaaaatgtgaaagtctcaagtaaaaaggaaattgtgaaagtcgtaggagtctatcatcatagacttaggttcaatttaaaacatattgttggtattgttgatttgaattatctacttgcttatgagactaaattaaatattttaataaataaaattaagtctaaagtagaattttctttttagaaaacgtatatttttgaaacttggagcaaacaatcagtttcaataatccggtaaataatctgaaatgaacttaagccctcagttgttgaatgctggtcatgaattacattgttatgcagtaaaatctttggaactttgaacattagtaccttttaaatatttatttggatatataaaaaatcatatatgtagattggtggtgaaaagttttttttttcataacactgctagttcatcaaattttaaaataaggtgcaatataaattattcatatatgtttcatatcatatcacgctttgattttttttctagtcaaacttaaagaagtttgaccgaccaagtttaaaggaaaaacatagcgatatttttagcacaaaacaaacatattatcaatatatatttagtgctagatttagctaaatttatttgatattatagatgttagtatttttctataaaattgatcaaacttaaaaagtttaactagaaaaagggtcgagacatcttataatataaacggatggagtagtaataaaaatttgtatcttaaagactatgttaatacctaaaacaacatttttcttataatgagggggagtatgttgcacatatgaagggcatgtttagtttactactattttcaatcctacaaagtttttggcaatactaagatttggcaacattaagtagtggtaagatttgataacgctaagtgtcagggttacggataaggtataccctctatccttggatatacgttgtatactaatacggtatacccgcgcgtatacagatagttcccgtatacattaaggaaatctatcacgtgatagatatggtatctacggatggaaagagttctgctcagacaaagactgggtctttaccatatcgtgagaggtccgatatctccgagtcctacttggagatcaactgacccgcggtataaaagggaccccctgggcaggacctaaggcatcgaatctcaccgccaacacacccaccacagcctacgaagccggagcgcataggagccaagtcgccgggagatctagttggacctactcgactacggtatcgtcggtatcatcgagttctgctattccttttgtaatccgtggtttccatcatataatcccatatcaacttgattagggctattacctactaaggggtctgaaccagtataatcattgtcttttgtttgtttgatgtcgtattacatagatcctcgtgccaacggaccccaataccctatatatccggtttacgggtatcccccgtcgacactaagtagttgttgtttagtttatttcccttcccagatatttttctatgaagctatgtgaagaagattctagaaaattactaaatttttgcatggtaggatgtgataggttattatctaggggcttgttcaaattaatgcctttttttttggtaaagttgtcaaatatatacatccatttaatttcttaccaactctagtaaataaataagaaatactgtcaaaacttggcaatattgccaaattgccaaaatttggtaaggtttattttggctaaaatctaagcagacactaaaacttgtttgaattttgttaccttactgaaattggcattgccgaaattaaagttggtagtgttgaaaatagcaataacatgaaaatggctaaaatttcaacgtcagcctacgcgctcaatgtgatctgataaggaaccgtagttcatattttcctgttctttttgcccacatgtactaaaccagtaagcattacagtactaaatagatatatctgctagcataactgttcgaaggttaaataataaaattgccatgcctatccaatgtctgtcagctcgatcagccgttagcaatcgccaatcgaacaacttgtttgacttgtgaactagctaagcgatgaggtcatggggatatatgttcagtactccagaacacgactcttggacatatgcacctcttccaggcttctcatcaaggatagacatggaaaacaccttgtggtcttatctcggttaggtcagcagccgcttgctctgcgcacatttggcacaagttctgcccaggaaaaagctacataatcgatcatttgactacattcgacgagcatcgaaatactgactgattaatcgatcatcaagtatcacaaaatcaacttagatcatcccagcagctcctctatctagtcatccatccgatatttgaagtatggagaagaaaaacagtgctccaacagagtctccatcacatactctattttttgaggtcctccaaacttagctcttcccaagccaaatatggaggttctctctcctcactccatcctcaaccacccacttcccaagattattttttaagtggtgaaaggtgagaaaaataggagtaaaaatgtgtggtagttgaaaaatattagtaaaatataggatgttggtatatgtaggatgtaatatgaatctttttggatggccatccaaataggagtatggaggatgaaatttagatgagctgctgggaatgctcttatccgtacatccgtacacgagtgtatgtgtttatatatatttgagaaaaaaaatgggttaaaatcaattcgaagctaagtagcgagttgatttccttgacatgttcagttcgttggtttcctttgcacaagggcgtgttgcttcaaccaggtcgtcctcgtccacattcctgtacggccccgacggacccggtaaaatctccaaacatgtacgtgtcatcgacatccaaattagtcggtacgtacgtgtagcatttcccacgacgagtcaatcgttgagaaggtctctccaaatccagcgtacagttttgcctggacgcatcgtcgcgtcgaggtcagattaataataacgtgcgccgtgttacacgccccttaattaatttaatttaatttctggcgcgccgctggagctaacgacccctatccgccgcgtcaccggtgagcccaatataaataccgacccgcggctgccgttcactcctcgtcaaaatcgtgtcgattcatcggccaactccaaaccaaccaaccagcagttgccgccatctctcatctctgtcacgtaacacgagtacgtacacaacacaaaatctgcaaaatattttggttgcctgctcggagaggcgaagaaaatggcgttccgacgaacactagcacgcggcatatgggcggggaagaacgcgaacgccgccgccgcttgtccggcggctgcggctccaaaacctccggcgcggcggccgttgccggcggttgacgactgcccgacgctcgcgtacctgcggcccagaccgggaaccatccggtacaccacggcgtccgttccgcttcccgcccattgcttccccgccctccccgtcggcgaccagctgttcaaccggctccgcctcgacgggctggtcccgcctacgacggccgtgacgcggccaccggaggaggagggggtgggcgtgacggtggaggaggcgaggaaggtggcgcgtgcggcggagatggaggtcgcgcgggcgaggctgaggtccaacgcccagagcgtcgtgtccgggtcggaattcgccgcgctctgcgtcgacattgccggcggcgccgagggaggacgcaggctcgcccgcgcgctcgacgactccggcgtcgtcatcgtcctcggcgacgccgtcttcctccgccccgacatggtacgtacgtctttcgttacgcactcacgaaacacaaacacacaatccatgatcgaacacctgcaaattacgtcccacactaacgtgtctccgttgtcgtgcagatagcgaaagcgatcgggagcatgataccggcgacggcacacgcgacgcgagctgcagcaagcgtcgtcgaagtgcggaagaaacgggaggaggaggaggagctgcgggcgatggaggaggagaaggcgggcatcgacgcggcggcggcggcgcaggtgcggcgggagctgtggtgcgggctgggcctcctggcggcgcagacgctggggttcatgcggctcaccttctgggagctctcgtgggacgtcatggagcccgtctgcttctacgtcacgtcgctctacttcatgtccggatacgccttcttcatgcgcacctccacggagccgtccttcgagggcttctaccgcagccgcctcgcgtccaggcagcgacgcctcatgcgggcgcgcagcttcgacgtcgcccggtacgaggcgctgaaggagcaggtgggaggaggagcacggtacggcgtcgcggcgcgcgacgccatcgtgttgaggcagcagcacgtcacgcacgttcattagcagcagcagcagggtgtttttttttttttggtgtggctaattaggtgtgacgtcgagcgcgtgcgtagttgccagctaggagtagtacagtaatactgtactccacgtagtttgagacgtggacgatccgggactcgggtgagtccatgatgtccagctgtaccagcagccatttattcggtcagaaatctgaaaaattggttgaatcactaagtaaaattttttctccagataacacggataaatctcaagcgttcaattttagattcaacaatagtttaagtttccactcatgtgtgatttgcgctacattttcttcagaaatctacatgttaactaaggagggctgctatataccggtatcacgttcaaaaacgagatgaaaccgggtaggtatcaggacaggtgcgtttctaccacatatcagatgatacttacgaggtatcagatgatatgcgatttttaccacgtggtgggtgatgcttgtgatgtatcatgtcctgataccccttaccaggtatcatgcgattctacaacgtatcaagtgatacgtgtgaggtatcagatgatactaacaagtatcatgcgattcttacaacctagaaaatgatacctatcagatatcaggtgatttttaccacgtagaagatgatacctatcaggtatcatgcgattcttatcacgtagaagatgattctaccacactcaacagtcagccatgaccaagtcaataagctctttgcaccacatcttgtctctttgctctctcgaagcagcagatggatagaataaaggcccggacttagcagcgggatcgacggccggcgacgaaggcgacgaccgaagaaggcccgcgacggagttgggacgccggcggagggcgcaccggccggccacgcggatggagccggggatgggcgttaatggcggcaccgtggatggcgggcggcggtgctggagctccaggcgacaatccggcgaccacgtcgccaacggccacatggccggcgacggagttggggcgcaccggctggccacgcggatggagccgaaggtgggcgttaacggcggtgccgtggacggcgagcagcggtgctcgagcactaggcgacaatccggcaaccatgtcgccgacggccgcgccctcctctcgccgagcaggtcttcttccccagcctgcgccggagtcaccgacggccacctcctcctcacggctcaggcgctcagcctcgttcctctttggatgggaaaggttgacaaaatgtatcccatcccgatggtatattggtataggaaatagcatttctgtaactaagaagtgtttacggcccacaagcactatagcgatccaatttcttcataggctgggcccgtaatcaggttccctgacgggccacgatcagggtcgctaattcgctaccggaataagttcactggaggtccctcaacttaacagcgagaattttttacatccctcaaccataaaaccagaaatcttcacccctaaacttactcaaaccgtgcaaagaagtcccatggcagtatgtgcacccgattttgttgacatggcatcctagtcagcaaaaaataaaaataataattatgtggggcccacatgtaagtgagagaaaatggtgtagaccccacatctctcctttctttccttttttttttctcttcccttctctctttctctcgagcaggcgcagcggcagactccgcgtgaggtggccggcggcagagctggggcggcggcggcagtgggagagggagagagagacggccggcatgatggcgagctcgacggcggagagtagcggcgcgcgacgtggcggtgggggagaggagcggcaggagaaggggcgccggcggtagcagctggccgcggcacagcgcgccttctgcctaccgctcgcgtggcgcgtcctcgccgccgcggggaccgggaacacggccgtgtccgccctcgtcgtccacatctccctggtgctcggctgcgggcggcgcgcggggcgcgacgcagaggcaggtgctccaggcgctcggctgcgacgacggtggcaggggcggcgcggccgacacggccaacgtggcgtcacgcgtcgtgaagcgcgtcctcaaggaccagtccacctcgggcgggcctgcggcgggcggtggtgtttgtttgtccattaatatgaacagttacaaactatgaattaattgagatcagatttgctagatactacgaataaaaacatctccaggcgcgcacaacgctgagtagtaattaacctgaaattttactcaaagtaaatagtccaatctggcggatagcttcggtgcgaatctctgaagcatcggcttccccgcgacggcggcgccggacaggactccgccgaggatgccggcgacaatcatcgaccttgggccggacgcgatgcggtagagcgccccggcgctggcccccgcggcgacggtgttgacccagtcgtcggcgacgtcgcactggtcgcgaatgaaactctcggtcctggtgaagagcatcgcaacgatgccgaaccggctgccgaaggcgcggccgacagggccgctctggttgagggcgcggttgatgcgcagcttggcggactccctgcgctcggcctgcggcgggcggcgggtgggccgctcctccgcatcctccgccggtgtcgcgctgaggaggtgcacggcaccgtggaggcggcgtggctggcgacagcgaggtcgccgctcgcccgctcgcccgccgcggctctagatgggtagagatgggcaccagccgccgatcccgccgtcgcgtgagagctgagaagttgagaacagaagagaaaaagaaaagaaaaaagagaggtggggcccacatcattttctctcactgacaggtgggcccccacatatttattttattatttttgctgactaggatgccacgtcatcaaaaccagccattgccttgggacctaaattagacggttttgtatagtttaggggtgaagatttctggttttttggttaagggatctcagaaaatctcgctgttaagttgagggacctccggtgaacttattccttcgctacccgctacctagccactctgttccttaacaggctgggccgtgattgcgtaacttggtcggtcggcctggttggcgaaccatcagcctacgaggcccaagattccatgcccccactaaacccccgctttgtcacggggatggtggcttgattttcgcaactaaaaaatggctccatgcaactacacagtactacaatagagagatcagcgctgatcaacccattttttagtgcaaatccctaaaaacgaaacagaggatacaatttgcattcagtcattcacgacctactaggctactactacgaagcaaaggtaagagaaaaaaaagagagggacttgaatcaccggagatggatggcctaatcagaaatcctgaggtctgttgcggtgatcatcactgctgctgcgcggggcagaaggtgatgacgtactgcgcgccggtgccgcacgtgaacgtgctggtggggtcgtcgtacgcgtagctgtacgccgccgggcacgccgccttgaacagccgcgagtacctcgtcggcccgcagctgtccggcccgccgtgcgcccccgtgcagcagtactccgccgtcccgaacgcctcgcacgcgctccggcacgccaccgtcgtcgtcgccgccgccccggactgctggtcgttctccttccccgccacctgcagctccgcggggcacagcgcgttcacgtcgccgacgcacccggcgtacccgcacgtcgagcggttcaccctggcgcccgtcgccgccacgccgatgccgacgttgtacccgtccaccaggctcacgtcgtagaagtccttcccgtcggtgccgcccagcgtgaactcggcgagggtgacaggcggcgcgccgccgagggagcagctcacggcgccgccgcagtcccccgtgacgcaggcgagggacgcggtgccggagggtgcacagtccgtgcgcgcccacaagcggccggaccaaccagccggggccgggaacgagacgttggcgccgggcgacagctcgaacccgccgcccccgacggccaccgcggtgttgccggacaaggtggccggccagacggtgtaggtgcagttgttgcgcagcgtgaagaccgtcgtgccgactgcctcagcgccgaactgcagctgcgaccataggacccctgcattgagacacgcattgttgaagaataaagaagatgtatgctaacagcctaaagttaacctgaaagtttctcagacttaccaacgatgatttgaagggctggagttcgtccgaattccatggattgaaatggtttagctcgaatgagaaaaaaaatgaatatgtgttttttttttggaattgaggagagaaatggcagttgaacaatgcgggtaatagaagaggaaatgcgcaaatggtgaactagcagcaacagtaatttgcccggtgattatcttgtttatatggacgttggtgatatcctcagatattaggtgggaactggagagaacatggcggagtttgttgagaattcggaggaaggcacgagcagcgccggacgtcgcgtgcccaacttctgccattcacgcctaaatataggcgtagtggctcagattgatcggtggagtggaggtagtggagctgtggaggtggattggtggcaacaattccgtagcagatgaaaagtcgatagcaatgtaaagtgcatgcttggacaaaggattgaatcacatttgagttcgtacaaacgcaagtttatttttaaggcccagatatatatatatgggccatgacacactgttatcgaaggacaaacgcttgtaccaaagtcaagcttcattttaagtggaaaggaaaataataaatagtatattagtttctctctaaaattggatctcctattacacattatttgagatctatttataggtttacaacctttaaattttggtgtgctaatgattttacataattgtcctcgtgacagggatatatgtaagggcattgtcttttggtctagctggttcatgggtcttactggtccgcgattgagccccttattgggtctcctttatttctgcgtgctatggctagtcgtgctttgcctccggatctgccgccgctgccgagtccccggccttcggatccaccgccgccgccctccctaccgccaaacttcactgccgccgtcactgagccgcctgctgtcgctcgagcccgacgtgctctcgtcgagcatccccaggtgactgatgcgaggagcaaagtagcaacgggactcatgccgtgcgcccatctcaggtgggacgagttcgtccgctcgattttgccggatcggttggtcccggatttaagagttattctatttagggaccaacccatcccgctcacccctaaaccaaacctatttaaaagtgggttcgtcccatcgcattccatcccaaaccttgcaaccaaacactacccaacagtgttatacatacccattgctgtgttttgatctatctagctgccacctcgttcccaatcccgatgctgtcctccgagctgggctgccatagcctctcgaacgcgtcggagacggacagcggctgtccgagcaccgagaggctgaacgcgatctcggccatcttgggccgccgcgccgcgtcctcctcggtgcacgccctcgccatgccggccaagctgagcgccgcgtccacgccgtactcaccgccgagggtcgggtccatccacttcctcagcttcgccgccctcttgtccccgccggcgtccagcacggtgcggatctccgtccgcagcatgccgatctccaccccgacgcgcgcctccaccgccctcctcccggagaggagctcgaggaggagcagcccgaacgcgaacacgtcgctgctcgtcgccgccgcgtcgaccatggcggccggcttggccagggagaagttggacagcttcgccctgaagcccgcggtgaggaggatgttccgggcacggacgtcgccgtgcaccatgctcgg

SEQ ID NO: 55870 - DNA, 10127 bp, Oryza sativa
ggagtatagaccaccagacgacagcaacccaccgcagtgcgatgcagctcaaattctctctgtcatgaccacggtaggaaatactctccatggctccaataatattcccatcctattacgctcattctcacttctcacccgtcccggcccatagagcgtagggaaatactcgctgaaagttcaaaaaaagggctctatcaatatatttcctaacatattattggatcactattctcttaatgtttatcgctttctcttggtagggcatttttaacatatatggcccatattgacatcaagttggccctcaaaaatctaaagcagagagctaaggcctaagaacatgtacaacgttctttattagtggactctctttattaccgtgcaagtaaatttaaatttagtgtcgtggaagaaagagatgagaggaaagaaaaatatagttgctaagtataacaatggctcaacgtcggctcttagcatttattaggagatattttattcaaccatatttagaccacttttcttatccttctttttaaggatataataatgtttagctatgtaataaattagatatattaattggaccctaaaacatcatctcatttattcgcgacgaatgaattatttttaattcaaactacatttcacgtgtaaatttgcaatcacaaccctatagatcaacaaaaaaagcaaaattgaatgacaagcatcatattgttcatcctgtatgagaaatactccatcaaggtacctacaaaaatggtcgaaatgagctcacaaagacatcctttaccattcagtccattattaattcttatgggaaacggtcttccaaatgccaacggtgacagctaaaattatgcaaactacccatatgaattttagtacatgacagggcaaacaaattaaatcaatcatgcaatacccatctacagaaaaaacttttaaatgacctagcaagttgtcattttcaaacacaatgcttataactctagaaaggcaagatatcaatagtctgaatatctagcgggcattagccaaaacatgatagatgtacaagataagatgaatcggattgctttaatttcagatcaatgacaatatcgccaacatgtgattattggcttcaatccattctaaagtcaccgttagggaatcctatcctaatccactcttctagtactctatttgtggtatttcaatgaaaatacattgtatctttgttttttgattcttactcaattaatctagatctgcaaagtttatgttaaagaaaatatatttatcatctaagcatagttattgattaattatcacatttttaccttttcagagtttgaatggtacaatctaattctttcaccccatatctaatactagcatcaacgtttccactgcaataaacatacatcatacacataattagagaaaatgctaggaatacacaagcaacaaattatatttcaatatccaacattctacgtgaaatcgctgtagttaaaatgtatccaatgattataatattgttcttttggctagtgcattgtgtataccatgtgaacttgacctctacttttatgtcggtccatacatacatcgttgtttcatattgttccatattctaggggatttatactatagttttgaagtaagttctctaatttataatttatagtgatgttaactcatgtccattctctagaaggaaaagattaaaaacctcaactttgcctttttattttgctaccatctacatatgatgaagggagttgtcaccaacgttcttctttttttgagctcaatatcactagaggcgtgctatactacatttctatataaaaatgaactttctacaagtaaaagcaaataggtgagtgggttttcatgatccaaggtctggcagattaagcaataagaagatgaactatagagcatgaagagtactctcgctgatgaggttgcttctttcccgttatccttctacttctctctgtcccttcggatctttgtgactaatctggccctcttcttaaccttggtggaattcacatattcaaaatctcatgagactttcttgtcgtcgatcatctagacatcgcctccacagaggagtagcttgacaacattctatctatcggtgctagtgtcgaatgatggcaacctcggttttggtgcacgtctcccagtcaagatcaatgtgctcggagcaacgatgcttcttgaccttggccttgtccctgtttttctgtttttcttggtggggcgagaggatttctcaggcttttagttgggggggagggttgattctgtttgcagaaggctttgatgggcctattagtaggagggtggaggttgggtgaccaagagtttattaatgacaatggaaatctgtggttgtggaggtggatttttgcttctgctagggtttggtagggacagattgttccttgggatgactgttgcttccgatggcaacaaggactccttggggttggagggaagaagaatgtggtcatgcaagatctggcgttgtcggtagagaacatcatcgatgtggatgttggaagggaaggagagatcccttgcatagagacggtatagtcatggatatatggctgatgccgctacaacactcaacaccataccacatgtcatctccgtcgacatctttgattttgcatcctccactcgccccaacatcccaatttcaatgagatatagggtatggaaataacacaactacttctctaagaaaatgttgttagtccagcttaaacaaatatgttgtacacaattgcttaccatcatcacttgtgtattcagcgcaaactcgagaaaaaaaaatgtgagggagtcgtatctcaatgcttcacacatttgcacagaggttccaattttcgttcgtacttcgtgatggcggatgtttagcacatcggaatcggaagggtgaagagtgcttttacgatgcaaaaacgcaagcgaaaatccaacggaatctagcaggtcacacaacatcgcggcaattttctatttacgcccctcctcctcagcaaagcaccgcaaaccagtccctctttccggccgcaccaccaccgcctcccctccgtttcccctccctcacttccccttccgcgactgcgagcttctccgccgccgccgccgcccccaatcgcccgccgccccgcgccgcgattgcccctcccggtgcccctcccgcaggcgccgccgattcccccgacccggggaagccccggtttgccgcgagctgcgtcgccggtgggggtttgatttggggctgatccgatcgcccccccctagatggtgaccgacgccgaggaggtctccccgacggcgtcctcgtcggaattggagcaggaggacgatgacgatgactgctacctgagcgatcaggaggacgacgccttggaggagtccgtcctccaggtgctggaggacgaacgcgacgaggattgccattggtcctccacctccgtatgcccccccactatccatcgttttatcctcgtcgtatttgttgtccgagtcccaatcgcttcggttgttgatgggttccttcgattgcaggtgatcaccaaggaatccctcttggcggcgcaggtgattccgcgactagagaggatctcttcgcattcgatttccggggggtggacgcgattttcctgagattgaagccttttccctttccttgccttggtaaaattttgtttggtttgtttgggattttgcagagggaggatcttaggaaggtgatggagttgctagggttgagagagcaccacgcgcggacgctgctcatccactacaggtgggatgtcgaaaggattttcgagctgcttgatcagaaggggagggacaggctcttctcggaggctggtatccctctccaacctgctaataatcccggctcgccctcctcaacggaggtaacctgcaatgtttgctatgacgatgtgcccctctcggacgcctccaagatggactgcggccacaactactgcaatgaatgtaagcaacaaccgtttggggaaaaggaaatactatgaagttttcacctttgcgtatgtgctagttatttgcttggatatgctggtagattgatcatgtaaatgcaaatgcactttccgtagcaaagccattgggtcaatgccccaccttttgacctcaatgctaaacaacagtctgaaattcatccactagtagttactaatctgttaggtatgtggaagttgtcgtattggctaacgtcttactaccctcatgctacaaaggaaatgatgtgacataacagcttcttttagcaagcaccttttgtctactaaatgcatgaaactaaactatgggaatggtgtgttctttattttctgggataggatggtgccttatcactttataattgtatgaatagtcatttatgcttataaaactatcacatgcttcaacttatccttagtctttgcacctatcttaattctatgtcgactaactgtcttgacctcagtttataggtgttgccatagaagagtatatgacattttgtggattaatccttttgctgtatgatgatttatttcctgggtagctagctactaatttgtgtattcctgcccccttccaggctggacaggatatttcattgtgaagataaatgagggacaaagccgccgtatcaagtgcatggctctgaagtgcaatactatctgtgacgaagcaatagttcgtaagctagtaaatgcaaagcggccagatattgcagagcgctttgaaaggttcttgttggaatcttatattgaggacaatgatacagtcaagtggtgcccaagcacaccgcattgtggaaatgctatacgcgtcaaaggtgatattcactgtgaggtggaatgtacatgtggacgccagttttgttttaattgctcctcagaagcacattcaccatgttcctgtgtgatgtgggagctctggatcaagaaatgccgtgacgagtcagagaccgtgaattggataacagtaaatactaagccctgtcccaagtgccacaaacctgttgagaagaacggtggctgcaatctggttgcatgtatatgtgggcaagcattctggtaatggttattatgctgcttcaacttctacatttttgcatgtttactggttcccatttgctggtagataatgatatactactattagcatatatccatgcctttttctagtagatatatatttgttcatacaaacaaactcaaagcatttcaaccttttttttcttaaacttcctgctttgagtaagcttcagtgtaccatccaacatgatttttttcattaatgaactcacaggttccaccacctggctagctgataagttgaatgcattcctgaactagagagcttattcaatatgatactttcttcagtattgcaatatgatatggttgacaggctaatggtagtttctgaaattctatgacttaaacagtttaaccttgattatatgggatggttgatgtttttgtataagcttgaacctatttaggcagttcactcacttgattacttgaactggtgttacattgacatctctctagtagcttcttctccttcagtaacacaagtcatcacaccaagagcttgtaaaattcaaactattttaacgtgtttgcaacttgcatcagtgaaggacatggtgttagatgattgtcaaaacccaaaacaacaattttgaagtatcatgtggtgaatgtgttttgacagaaatttcattttcactgaaaatttagtttaaatttattctgatttgatgcttttgaatgtagctggttatgcggtggtgctactggcagagatcacacatggtcaagtattagtggccacagttgtggtcgattcactgaagatcagtcaaagaagacagagcaagctaggagaaacctttatcggtacatgcactaccacaacagatacaaagctcacactgattctcttaagcaggaagcaaagcttaagggcgacatccaggggaagatttccatttctgaaaacaaggattccaagataaaagattactcttgggtgataaatggattaaacagacttttcaggtcaaggcgggttctttcatattcttatccttttgcattctacatgtttggtgatgagattttcaaggatgagatgacttctgatgaaagagaactaaagcaaaacctatttgaggaccaacaacaacaattagaattcaacgttgaaagactatctggtttccttgagagggattttcaaaattttagtgatgatgaggttatggatacaatgaagcatgtcatcaatctttccaatgtggttgatagactctgcaagcaaatgtaagagctcaacaaaagtttggtagtgtctgtaaattactgttctaactatattaccttgcaggtatcagtgcattgagaatgatttgttgtatccactgcgtacgcctcataatattgctccatacaaatccaagggccttgacagggcctcagagctcaatgtttgttgggattcttctgaacaaggtttgcaaccaattaaatacagtcaagatgaacacaagagtcagcctggtttatctggtacttatattgacacctttcatttctattgcagcttcaatttatatgtttctgatagctgatgcatatttcaacatgccctgtaggttcatctatttttggaaagcggcaacttggctcaagttctaataacaatgggcggcctcacaagcgagaaagaaatgatgcccatggtggggctgccctttttgacctcaatgtgccagctgaagtggcagacaagatatgaaacttaaataacttacagcacattccgttgcaagtgtacagctgacccgggcttcttcagctacataaaggaaaactctgctcttttttgttgcgttagagtgtcgacatggcaagtttaaacggggggctataataccaacaatagggtagcgttcacttattctcttgtaaatcatgacaagaattggtggcaatgtgcaatgtgcacgttgcatagctcttataatgctaaatctacccctcgggcaagacgatggcattttggaagataaaattttgaaatgtccttttgcaaacatgcaaggtaatgtatgaagcatattggaagtgcctgcggatgcgtagcacctggaaattaatagaaacaaactaattgagtcgcgacatattcttggccgagcttatgggctcatcttatccgtcaaacctattttgtggccagaaggcagctgatctctaggtcagttttggttgacatatatccaagcattcattgctgggattctgggaatgtctgaattccgattcccatctgctgaagtgcaagatgcaaatcttggtccctgttcaggacaggatttctggttttcttctcttgtttcatcctagagcctttggattatttgtcacaacttgtactccctccgtcccacattatatgggactgggcactgttcatccaaaataaggaggttagcaaaagacgcatgtacccctcatttacttagtactgggcactagcagtgagaatatttgggtttacaagcttgccagcaaatgattggcacaaagaaagagtaagcattcctcagtacacaatgacattaatgcacatgttgacaagagtcaattaaatcccactcacctctttgctgcccaaaattcacacgcactacacattagcgccacaaatacacatgcattagctgttcaaaatttaaacttgatgctcagaaccagcccgccattttcactcccttgctctcactcacaggtctaaaaaccaaagctctcatattacactcatattagcaacctactccatcattacaccaagagagaccctcaactaatccatggaagaagaggaatatgagattcctgatctcaaccttgatcctggtgtgcaagaagtgctgcaagatgaaggtgatgggatccctgaccttaacctggttcctgctgtgcaaggagaagatgccttccaatatgaagatgaagagcttcctgacaaccaatgttttggtgctcatgaagatgaacatccaggccctgccatgcaagcagttgaactctccaatggccggagtgcacaagaaatttgtcatctaaacatggagccaggtatggaatcaaaatcttaatgcaaagcaagttatgggcttattcacatttcccatcctcccttctgctgaaataacagaaacataaatgttgaaagtagcaaagtttgtatgatcaaaatttatgaccaaattcataaactaacaagcccaatattacttctttgcataacacagagctttgcagctttgctattagtgtcaatcagttgttgcttttagtcaggagttgtaaacttcagccatcagtcatatatatactcttatgtggtactatgcaaaaatgatgatcataaatggctctatgaattttatttgctcattatgataaccagccattagcccaacaacctccaaagtttataagcgtacatcatgtgttctaaatagttggaatcagcatagttaaagttttatttcataaagctggttttaatatcagaaactactaaaacaacccaaaaaatgaatagtatgaactttatatataacaccactgcaggatgacccatataggtatgggaacatgtgttttttttgtggtagatgacctaatgcaaaaaaaaaacttttgtggtcaagaatggttacttaatttataatgcacttttctgtatatttcatcatacaaagcacatgacagggtggttaaagccgcgcgaatgcactacttcattagctagtttctttgtacaaccttcaactttaaatttatcttcgtcacatgtcatgcagcaaattatggagaagatgatattgtatttgacgatgacgaattctatgttctccaagatcaatcaaattatgcaggtacatacattattttttgctcatatgtaatcagcagtgatgcagatggggatatcatatgagtagctcatgtctcaccttttctgtccatgcagacgaggaggattttgatgtttattctccttatatggatgttgtctttgatgaagatctccatacatcaagtgatgaggaaggtatgacatgcaaatgacattcattagtgtactgcaagtataaaatatattgccaactgatatgcatatatataaatattttctttgtgcagatactcaacaagacaatataaagagaaggaaatatttaccagaagctgagaagaaagctatttatggagctttacttgcaagtactatcaatgggaaacttgctgatagagatactacagaaattattgcagctatgtttgatgtgacaaggagagttgtacaagacatttggacaaaggcgaagaaatgtttagcagcaggtgttgaagttgactttaaatcaaagaagcctggtaattgtggccaaaaaagaagtgacattgatttggatcaggttttagcacttcctttgaactcaaggtgtagcatcagatctcttgctagtgcattgaatgctagcaaaagccaggtgcataggttagtcaaagaaggagcccttcgccgtcactcaaatagcattaaaccttacttgaaggaagctaataaaaaacaaaggctcgagttctgtgtatccatgctagatgctgctactttgaatgctgaaccaagatttatagacatgcaaaacattgtgcatattgatgaaaaatggttcaacgccactatgaaaaacaagaccttctaccttgtattcaatgaagatgaacctgtgagatgtgtgcaaaataaaaatgccatagataaagttatgtttttatcaactcttgcaaagcctaggtatgatgaggaaggaaattgctacttcgatggcaaaataggaatatggccctttgttaggaaggtgaagtctcaacttgattcaatctgtttttattgctttcaagtcactttgtagctaacttgttctttgctctatatgttaggaaccagcacaaaggagtagtcgcaacaggccgaagggtaca

SEQ ID NO: 55871 - DNA, 2022 bp, Oryza sativa
gccatacttttgttttttttttactccgatggagtttgtaagtatgtggtaatgcacaccttgttaaactagcccagcctagccatacttttgtcttttgtactccgatggagtttgtaagtatgtggtgatgcagaccatgttgaacaactagtccagcctagccatacttttgtttttcgtactccgatggagtttgtaaatatgatttcagacttttgttatatataggtaattcagcataactagttttagcaatcagcaatatgtgattctatatttaattcagcactaatttcataacaatgaatacttaattgaacccatttcagaacatgtcattgcatagttaatttcagcactaactttggaacaatactacaatcattagaacaatatattataggagtatatgactataactagggcatttccataacaaaatactccgtactagtctggcaaccatatggaacactacggtaatttgtacacttataaacatggtagtcctacatccatattgcactaagtactcctacgtccattgtgcatttccacaacaaaataccacaacaaaatcacattcaacagtttggtagtcctaaattcttctacgcttgcatacctgggtataggtaggaaacatgatatcgtgcaaatctttcatatgtaaattccgaggcacaccgacaccctcatcatcagtctctgcgtcggagattgactttctctcggcgatgcatgccttcttctcaggcacaccgacgccctcatcatcagtttctgcatcggagattgacttcccctcgtcgacgcatgccttcttctcggagcttgtgttcaccttccttggatttccctcatagtccacatcagcgattgcctttttctcatcagcccatgccttctcgatggtttccatgtcgatgcttggcttctcatactctgaaatagcccgaagccaattgtgcaacattgtactgtaaagaagataagacaaatcaatataaatcaagatgtgactcaatttgcatgctacaaatgcataaccatcccaaatcgacaatctagtgtgaatcacataccccaagcgaggacgcactccgagctggcgcggccctcctgatttgcttgtcactggatggttgcaccgtaaggagaaataaatggaacatcaaaaagcacataatttaacaaaattgaatggaaaggactaataattaaataaataagagaggaaccctatgccaatctcctcgattggaacatcttgttgtgtttcaggcacaaattcgtcatcacaaccttgtgagttgaactcattgccagccccttcatcatccaagtcagggacaaacatcaagtcgtcaaaacaaacgccttccgccactggacgcggctctttgcctagcaaccaccacgtcccgcgaaccctgccgctgggccgcattctgccgccagcccgtaaaccgctgccggcgacatgttaaatcattatattcctattttaaataaattttttaattttaaactatcaaaatgaaacatataaactttaaatctaacatgaatctaagatatgatgtgcctaacagcgtctaagattaataaaattgacactttagtttttttaacaccgttaatttcctagtactccgtatgatctaagagtagttggcaatgtattaagaacctcttcagctctaaataagaactgcaacttcaaatcctagcactttgcctaatggataactacatccctgcaaaacatccacctaaaatcgctccattcttcattcttgaccaatttagcatggtggcatctagatcctggttaaatgcgattaaattgatactcctacttgtgaggcttgtcccatatagttcactggctagaacgttgctgcaaatttcatgtccagtaccacaccaatcaatggctacatccaagtcatacccacgctagcttccaaatcttgcattgcgatgctgcggtgtcaaatcaaacaatccaaagcg

SEQ ID NO: 55872 - DNA, 7443 bp, Oryza sativa
tttgtgagtgtctatgatttttactttttaaagaaccaaatagaaaacgatgaaggagtataagtcgagtgtgatctaagacatatcagttgacgatgaaaaaggttgtcataaaatacgtttaaaacaaaatgtccgattcgcagttaaccgacccctggtaccacagaatttgtgacccttcacattgccaaggctcaagaaataaaaggtgatctttcaaaaagaaataaaaggtggctaaaacaaatgtctgactcttcattcgaaactaaaaaatcgttgactagtagtagctctttgcaccggatctagcctaacagaatttgacccttcaaattagcaaggctcaccttaatcctcttgcgataatccatcatgaattcatgattacgaagcgcacctttgtattttaaatttcagaattgttacagcctcctctgcattgatcaggctgttgacaaatgtaaagctggagccatggcaagttgctgcagatgcgcgcgcacatcagaaaaatttgctaagaaaccacacactcctccagtggaagcataggcagccagcactgcgcgtctttgcctgatgcaaagttaggcagcacaaagcaagcaatgctgatgatcttgcggggattcgccctccggagagatgacttcgcttccacaactcccggaacatatcccacccaaccgttacattagctgatactgattccactgacaagtgaagtgacaacatgcgggcagccaccaccaaattaaaactgttcgattgttcatcatccattcctggctgcttgcttgctagctgctgccgatccattgtcgtgtccttctcaaattcacaagttgtgtcattcgatcagaattgctcgtgtgacgcatgcgtatcccttcaaagacggctctcactgtccacaagattagatccttgttgcctaggcaggcaggcatgcgagcggtgaacatggattggggaggctagttgaatgaatccccagtctattggacgtttccatgcatgcgcaagaatcccaataattcggggaattttctcaccggccggaacggactccgtgtcacgctgcaattgcgccgaaaggctctttccagtttttctcgctgcatttcgtaggggcttagtataatcgattgcgaaggtggattccacgaagcgagctgaggtagctatagctagtgggatctttgattaatccacaggccactagcaaagcgatcgatcgatcgattgagcttgttgagcccttgctacgaacatatgcgacgagacacttgctcatatatgctttctgattcttctcctagctcttgaggatctattaggccgccaccaccgggatctgggacatgtgctgatgcttattccgatactacttcggaagtcgtcgcactggttgccgttctcccgttgcttggaaatcaactcactaaatggaaccttaaaatttgggacaagttgggggtagatatactgtggagggatcggaatacatggccttcatgttgatcagatgtgtttgcagccgtagcatgcagtagcatatatattccagattctgaaaccgaccgggaacttagcaatttagtactagcatgttattataacaagacgatcactgtgcatggcgtgtctggactgattcgtactgaaaaattgatagcacaaataacgtggatagaacatcatgaggaatacagatccatttttgttaggttgcatttcactaaccaatttagtaaaacatgctgcacaaatggttatttcgtctgtcccataaaaaaaataggatgtgacacatcctaatactataaatctgaacaaacatatcatgtattaggtttgtgtttttatgagacaggaaatattgctagcctactctatattgggcaaaactcccgacccagcgactccttccactgcctcgctcctgacccctcgtttcctctctccgctaccttgccgctgtcccaagcggctacaagaaaggcggggttgttccttagtagggacctagcttgcgccttgtgttgcgacggaggaggggggcatcgggtctaggattcctgcccccagatctggcggcataggagacgttggggaggggcgtagcggtggtggctaggcctacgcctggccaaacgggttggtgacgacaacgggtagcggtaaggcatcggtgggtgcattagaggacaacggcgggctaagcgtcgatggctagtccttggtagggagaaggtggatcaggcggaggtggtcccgtaggcagttgacactagggatggtggcggcctaggagttcgggctaaagactccttggtggcggcggcttgagcaccggtgcaaggttctcagtgaggggacggtggtacaggcagaggcagatctcgttggtagtggaggcctggaagtcctggcgtaagaggatatcctcggcgacggtgggctaggaatccgagaggcggaggagggtctgacgacgacggtggccctatgggcggcggaggcctaggaatccagcgaagcggaagcggatcatgttggcttgcgtttggtgatcagctaattctgactggacaatgacatatgaaggtggggctaaccggtggcacatggcgttagcttacttgaagcggatgaagatggcaccagcggaggttcgcagtgacgacacactaggggcggctgtgactagacgacttccacttgtcaaatctggccatttcaggagaggatgtcaggaagcaagtttgtgctaaggtagtagttttttttttctgttgttatgtgttctcctacttgttgaggtatgagtgtaagtactcttgtattattttggctgtgtatatcctttgtggaaatagagaccggattaacgaaaatccattaatcgagaagcggatggcgaggcctagcaaaaatcgagaagcggatcctaagaccagaaatttgcaagatttttgccttaaatttatgtcaaatattatttggcaattccgcatgttgacttaaacttgacctttcaacattgatagtatgatcttagttatacactagcaagttcacgtaaaagtttaggttgttacacaaaggaggcactatgcctatgctttaacactcccttttacccttctttagaaatgagccgggagcttttgccagttacagtcacagtggagaaaaggatacggtccatcttgacgagtaaatgagcggaaattgttttaaacactcaggtggacatccacctatttcttgcatgtcatctaaatggttatgaaaaattttcaaaaaaatgacatgataggataatatgtaatatatcatctcacaaacatgcaagtttaaattcgacttctacaagctgtaacaaaaataacaaatttgactgtgaatatacacatgctagttagagtttaatttgttatttttgttacagcttgtagatgtcgaatttaaaattgcatgtttgtgaaatgatatattacatattaacctatcttatatatatatttagaattttttcataatcatttaggtgacatgcaagaaacgggtggacatctacccgagagattagaatcaatctccgttaatgagctgattcatgatgttcgaaagctccttcctttccaaccaaagagtgctagaatttgatgggggcgtagaaatgagagatcattcacatctaacaacattcagcatcttttatgtttcacagtctgacgacatagcacactattttttttcttttgagaccactatcaatttgaattgggaatcgacctgttagcttagctcctaaagtctgaaatttgttttttctgacaaagaagccaaataattttagtgatgcttttgtggaatgcgttcagagactttggtcgggtggttagttaaatgttgatttaaccgatgcttagtgtgctgtaattatgagcttctactttacgtcttgtgatttttccccgttgtgctagatctgtcagaatgaaaggtacaggactgtaccagttgggcaactaacactggagtaataataaaaaggcatgcctcatcactggttcgtctagcgttagtttaaatttcaaaagaggtcgaagaaacagaatacaaatataaacaacacaattgcagttgagtggctctattcagaagctttgttaggttttgaaaaattctctaaagtttggtagcaacagcgtcaatacaaaaattcaagacggacggaatttgtctgctctgtccaaggaaaaataagtttttggcagtctgtattactgcacacaatgacacaaaccagcattctccaaggtgtttttatctcgtgaacaattgcatgatccaatcgagatagcaacactgaatctgaatcgaaacattctcggagaatctcgggtgaatgctcgatgaatcacccgtcagttgaatccaccatatctgcacatatcttgaaagcttcagtagatgcctcaactcggatatgtaattaactagtgtgacagtgtcccaggatcaccgtagctagttgcaacgaataatgtcagattcttgctggtcctggtctagtagtgctgctgctcaagtatggaatgatgcagagaaggcgacgctgatgcatctggaggaatacgagcgtggcatccggttctgggttctttgattcggcagcctgagaaaacaagtgcggtgtatgcagagctggccaaaaggaacaaactttggtggccacaccccagcatcccagattcacaggaatcctttgttccttccttgtcaagcagcactaatcgcctattactactctactaggatgctctgtttgccagattctggactttgatgatcgactcttttcttcattctgtttcagggaacccaactagtagacattcttccaccggctgccataagtgagtgcgttgtaattgaatagtctagatagatcgtttgctagctggcttatccgtaactagaatttaaattttaaaacttaattttaaagttgattttgagaatttatcatatatatatttcaatattgtcttttaaatttactcctacaacagactcttggactaacactcccactctcagaaccgaactcgcaaagggggtctatcgattccccattgcagaagctccgttctccgatacacgtaaacattacgtcattcaaaactggtcattatactattttgggactatttagggcctgttcactttgatgccaaaaaaaaccttaccaaattttggtatagttgccaaaattttggcaaattttgacatgatttcttatatagttacctaaatttggtagcaaactaaatgtagccactttttttggcaacgttaccaaaatttggtaaggttgaaaatgacatcaaagtgaacaggctcttacaccgatttaaaaagctgagaatgtgttgtacttagttttaccgtagaaaaaaaatccaaaacgaagaaggaattttttttcctatcttgcttgttttgctgggccgatattatcttcttctatcaatcatagacggaataagttcatctgaggtctcttaacttgtcaacgtcgtgtaaaatgtggggcccaccatttttaaattaattttttggtgtaaactgatatgtgggcccacaatttttaatattttccaattacattgccacataagcgccacgtcatgtgaagaccgagtcaaaatagccacgtaggcgttacgtcagtgaaaaccgctatccaaaccaccatgggacctatattgcaccggttttaaaagttgagggacccattgtatctgtttttcggttgaaggacgaaaatcggatttgttgacaagttaagggacctcaaacgaacttattccatcacagactccgtaccccgggagtcagagttggcccataactgacactggcccgtaggccgtagtagcttatcggttaacaatctcatgggctcagttttcaacagatcctaacatccccgtactatacgagtctacgacgatgactatgctgcaaagcaaaggaaaaggccagtaaaccatatctttcgctttcgtccgtataagcacgaagaaaatgccaccaaacacgcccctcgcgtttgacgagatttctgaagcaatgaaaccgtcacgcttcctagaaatcttcccgaaacgcacggcacgtcgaatccgtgatgaatcgctcgcaccctacccaacccaaccctccccgactcgccgctccacgccgcaggcccccgcgcgcgcagaggcgtaggcgagcgagcaaacgacacggcacgacagtacggcaccaaaccccaaccccaacaccggtcgcgctcgcgtcgcaccgccccggcagccaagagagagaagcccaggaaaggccaaggtgatcgacgagcgcacgcacgcacgcacgcggcgccgtcagaaggccagagcggggggagaggggaggaggggctaaatcggggagaggtctccgtcatctccgactcgcggcgcggccccctcgccgagaccgacgggccgacgcaaccgaggcgagccagcgatcgagcgggcggggggcaacgcgtacaaaaaaaccccctccccttcccttcccttccctctcggtcgcgtcgtcgcgtggtcggcgaatattcgagcggcaacggcataacaccattgtcgcccgggacgcgcgctctttctctctctctctctcttcctggcgatggcggcggcggcgggggaggaggtggaggcggcgcggtgggcggaggcggaggacgagaggaaggaggggctgcggcggcggcggaggtacgggcttgtggagtaccgggcgctgccgggctacatgcgggacaacgagtacatcctgcgccactaccgctgcgagtggccgctcccgcaggtgctcctctccgccttctccatccacaacgagaccctcaacgtctggacgtacgttccctcgttcctttctccgtctctcctccccccctctcgattgattgtgcggttgaatttcctgtcatgtgagaaggaggttaagttgttcattgcacgggtaatgcggtggaaaggagatgtgacatcgatttctttcatggatggatctgttatacggagcaaagaaattggtctatagatcgggcgttcgaaacatctcttgtctgcttgtggatgctatagctttatgtttcaggctggataaatcccatacaacatatttcttctggcattgggtatttgaagtctgaatcttgaaatattaggctgccctcaaaatatctagccattctgtagatttttgctcttgtgcttatttactaatttatttatttattttatttgaatattctcaatagtgcatagttttgtagttgtgtaaattagggaggccaaggcttacagggggatccactag

SEQ ID NO: 55873 - DNA, 2367 bp, Oryza sativa
caactagaatgcaatagaggggacgactcccagctggaaaagccttcgttttgtacttgactgttcatatcatgcaacaggtcacaggaccacctaacttattgaaagaagtcccctgtggatgatttaatgcgtttaattgtagtagttaatggaggacagtggtctagcagtatttcttttatcgggattgctatatgtcattcgaatgaaatttggggatgaaatcttacagattttggaccattggatccatgccaagattcgtgcaccaccttctctcctccaactccggcgggctccccttcttctccggcgccggcgacaccccaactccggcagggagcatacgggttagggtctggggttggggtgagggtaggaggggggttgggggagggggaagaggggggtttcctcggagcttagagggatggccgtgggcggtgtacttcggcgaggcggtggcggcgccgccgaagccgcaggatggaggagggtggtgggccggcatcggcggcgggggcaaagcaagcgtgtggttaggaggcggcgggcggtggttgcggatccggcggtagggagccgccggagacggggaagacggcggggcgggggcacctcgtcgtcgccgcctcgaggagaaagagaggagggaagggggagggggcctcgccggcgccgttgaccccttccggccagccggcgaggcgggcagcggcgcggtggggcgatggcggtggcagtggtgggggatcgcgcgaggacgaggagtggcggcagcgtgcgatctgaattgggggaagaggagaggagttagggttagagtggtctacacaaatcttgaagcatatccaatggtccaaaattcgaataataggaggtggcattttttgtcacatgatatatagacagccccttcttttattgtattcgttgcatatatatatcgagctcgaatggagatcaagcaatttgattggcatcatacaacgtttatttggttactgttatttaaaagttatgtgctcgtatggagatgtatgcattctggaaaattatgactgtggcaagtgcaactcctaggcgacatttttttatgtaaaaaagttatcaatgtgattaatgcaggaatacgtctgctaagttacttttcctgatatactaaagctgttttttaatttgtgaactcaggcacttgataggatttttcatctttcttgttcttaccatatacaccgcaacacaagttccaaatgtagtagatcttcaaagtctgcagcatttacctgatgtgctgagaaacgctgatcttcataagattcagacagaacttgtggcatgccttccttcgttacctcacctttctgacttgcaaaagctgaaggatgaattgaaaagctcatggaattcaattgaggtgcttccatcattgtcccgttggcacctcttggagttactatcaagttgcttgccgcacagatttactcattccaatgaaaccagtctgtctgttcttgtaagtagtcaacaacttccctagtttattactcacttattatgctactagtatgttatttcagatatcgcaaaattaatgataatatgctggcacaattttcaaccggaaattattactagggatggaatatcaattcgcaatcgtttggtttcttagtttatgctagttcgtactgatctgatttcatctgacttatgacaaagtttaggccatgaccatgaacaaaagttgagtttatgctagtttaagctgatgctgacgaaagatttggtttctataccatgaccagtaaaaaatataaaaaccaacagattcctaggcaggtcactgctttactggaaaatcaggatcattaagaagttgcaactttatgattttgagaaccctttgtttagtcagcactcattttattgaaggtgtctagttttacaaacactggcacacaattacacatacagagaacaattgtatggtatgactagattttatctagacatttttgtcttcagagatagcaaataacattttctcacatgtgattatttgattgaaattttggagtgaaggtcattaattcagtccccgtcatcttatatacccccgttttttttttgttttatgcagcaaagcatgaaggaagatatagcaaacatgattgcgccacagttgattaggccaattccgagatggccattttatgccttcttgggaggagcaatgttttgccttcttgccagcagcacatgccatcttctctcctgccactcccgtcgccttgcatacattatgcttcgccttgattatgcaggcattgctgctcttatcgcaacatcttctaccctcca

SEQ ID NO: 55874 - DNA, 1465 bp, Oryza sativa
cgtaggtcagcggaggaaaacgcggcggctgcgacaccgggatcagcacgggctgccccgtcgcgaaggtggagttgcccgcgacgccgttcgacgcggcgatgttggcagcggaggcgttcatcagcgcgctcaccacggacacgtcgtccccgggctgccacacgtaggtgacgaggagccgtgacccggcgctgagctcctcccgcgtcgggcaccggcagaagagcggcacgacgacctcctgccacggctccagcctggtcgcctccgccgccgggttgagctcctcgacgaggacgaagtcggtgaggttctcgaacgcggtgacggcgagcccgaagaaggtgtcgcgaggccggatggggtacgtgacgttggcgaaggagcgcgcgcccgtgcagccgcacttgaccggcacgagcagcggctgccccggcaggagcaccccgtcctcggtggtcagcttgttggcgctggcgatcagcgcccggctcacgccgaacaggtccgagatgttgccgaggtcgaggaaccccggcgactgcgtccggtacacgacgaacgtgtcgcacggcgccgacacgttacaggcgaagcgacgtgcccgggcagtggcatcggtgacggcctccccgccggcgagctggaaggcgatgacgacggcgaggatgcacaaacccttgtgttccatttggagctggctgtcacggtgcttgtgaacgtactagttgtgaggagtgagagagctcggtttttcagtggagttaacgtgcagcgtggggtttttgttcgggtcaaacgccggtgcgtctgttgtcgcggctctgctgcttttgattcggtcgtgaaagtccctcctcgcggctcagatgccattccttctgtgtctgcatcacgcctgattagattagttcacaatagtacgcatcatttgatcagaaaattattgtgagggcgtcggcctgcttgtatcttgtgaacggagctttcatgagcggccgttttgcagccggaacaacggaaccggtctgccgccatcagccatctgattggaggttttcccgtcagataacaacacaagggcatcgttatcaacagaaagaaatatggattatgtaaggaaggtaatgatgttgcagccggagcggaataagggcatgtacaaagatatatagtcagatataaactctacgttatctagatattagcatcctacaacagatagaaacaatatggtctctaatcattaatgtattcaaataaatttttttactcttctttccttcctttcaccaccatgcaaaaaaatttgctctaataaatgctaagagtcgactctgagccgttgtcctacataagggcaagtacaaaggtagagaccggtatggtctctacgtcaattagaggctaccatattacaatagttaaaacaatatgatctctaatcattaatgtaccaaaa

SEQ ID NO: 55875 - DNA, 1043 bp, Oryza sativa
agtagaaaaaaacatctcgtccgtcttaaaaagaagaaaaaagtctcgccagtaaaaaaccaaaagaaagtccgtttggtttttaatttggcacgggtatttttttctgatctttttgcacacgaaagagtttttttttcgcacgcgcttaggctcttggttccgtccattttttaatctgatcgcgcctcctgtcaattcgttctgttcgccgcacgtcgcgccgctgccatatcgattgtgtgttttctactccaatttgattgcaaaaatcgattccccactcctccctcatcagttgctaatgatgacggcgatcttcccggttggttgtttttatctcgagctgattttggaaaaaaaaacagaaagaggagatcgagtggataaaaaccatcaaccaattttggtgatcgagaaagattcggatttaattgggaacaaagagttttacactctgattttggagaaaacgggaagagaagatcgactggataaaaaccatcgaccaattttaggtgatcgagaaagattcgaccatatttgatagggagatttgctccggcagctgtacgtccacgtggccacgggacagacaaccgtacggccacgggactatcttcgggaggttgaagatgatagtagactgtgcgagctacgcttatggctgtaggatcgagatgtcgactagaggggggtgaataggcgatttaaaattaaataacacctaatcaaaactaacctaagttgttaggcttggcgagggacaagtctaactaagcaactaagttatgttttgtaatcctagggtgaaagggtctcaagtatgtctctaggaatataaattgcacaaatgtaaatgcgacaaataaatgagacaagttgacaagagatttttcaccgaggttcggaaactcgccggtttcctactccccgttgaggcgagcccaactccaccgctcaaccatgaagacaccgcacgcccccttcgtcaaggggtgtatgcaattgaaatgagtgccaagagagaccccttgctgctg

SEQ ID NO: 55876 - DNA, 5725 bp, Oryza sativa
ttgcacgacacgatcatcacaaaataagcatcaaaggacagtagcgcatccgtacgtaattccgtttaccttgaaggcactcacagtaaagcttcctgcatccagacttacagcaagcgcatcccttcacttggttcctcacgctcgccaccatcctgttcatccaaagattcagaacaataacctgagcctaactgaacaagaaaacacagtgtagaatcaggtattggcacttaccacagccgaatcggctaagccatttgcactgacatcgacgatctttggtctgaatgcctaaggcttcttcagtatcagcttggagcaaaaccacatgttgctgaagcactcacagtatctgcagttcaagaaatggggggagaagaagagaaagctgtatgcctacaggtcaaacatagaaatattttcagtagtttttagagagttaattctattcgtaggatttttcacagaaaaagaaggaaatgaaattcagtgtgctcagatggtggatcaatgggcgtcagtttccttccataccattggaggcagtaactactcttgttgcaacggcagagatggcggttcctcttggcccatactgaaccgttgaagaggattagacgcagatgcagcctgccatcgaatacagaaactgacacagcttcaaatattgttttttgctgtatgtctattaatgcacaaagtagagtctatcgattgtattatacatatgatagaagtgtccatccaatttttctaatcaacaagaagacaagttaaggctacgcgcctaagcccacaaagagcagctcatgtccaaacaatatggtctgacgaacacagcacaactttcaggagcatatgaccgaattcttcaatgtagaaggaaccaaagtgcacctatatacataaatatacatcaaatttctgctttaacatgatcagattcatcaacgcagaaagaatatatttcagagatcaaattacaacgcagtgaattgaattcacccaagtcctagccgtggacatgataaatacaccaccaccattgatgtttctgtttgctacagaccttccagcaaatatattaaaaatgaaactaagacaactccacagcggttttgagcctatccctgcattgcaatttcatctcagttcttcttgcacgtaggcaggatgtcctgactacgcctaaagccaaatggaacacccccatgtttcttcccaacatgtggtcttggatgcctggtgaacccgaaagattgcttgcttgtagagcttttcagtccaggtgcacgccttggcactccctaccagctgcatcaatgtgcaggatcaccatcgacttcaccatcatgctgagaaccagccgatgcctctgttgatagcgtgacgtcgtcatcaccttcatcattttcgcgagctgtggtgtcaccatcaccactgccacttgctccccctaatggggaggattcacgaccaaaagcctccccaagcagaagaattgttcttcttctgtggtggcctgggaatgcttccctgtagtggagtatcgacctgccagtgcgcacaatgaagaccattgttatagatgggctatgtagagccctctcgctgatatcctcttccccttcactgactccgatcccgtcctccctggcacttaagcctgaacgaagcatgctgaacaagtccccaagatcacgctgctgctccattctgtgccagtctcgctgccgttcaggatccacctgagttggtctaacagtaggatggttctccctggcgtgtctcctcagttgaccgtatgcccccctgaactcgcaggactctttagtacatgctcgaaccttcacgttcaagtacttccgtgcatcataatcctttgtccaatggctgactggcccacgacacaacgggcaagacagttttatgggctgctggcactcgctgcattctggcgcagcagcagcactggcaccagaatcctttgaggactccttagaggccttgcggtactgatcaaagcaattggagtgtcggtagcttgtgtcgcacatgaaagggcggcagcccttctcatgcgacgagcagacgagcagaacagcgttgtgtgggtgatccatgcagaccgggcagcggacatcctcccattccgcagcctgcttcgcggcagcggcagcggcagcagcagcagactcctctgacctgcgagcacagcccttcccattggaggggtacggcgaaacacgagaccggcggcgctcgtatgacacggcacgggtgctcctgtcctttggcatagttacctcaagtcagtcagatgcaaaggtttgttggttttgtttgaaattctccgcaatccaaaggaaagcgctacagagaacaacaaggttgatttccaacttcaaactctgaaagagaatcaaagcgagaaagcatgagatgcttaatcagatcgcaaactagtacatctttgtagaaacaagggttatacatgacagaacacaaactaaatcatttttcctttttctttttttgcaaacatgttatatgactccggatccatcaagcaaatccccatccaaaatcagagaactcttatctatcgagagatggactcctcctttttctttttttgcaaacatgttatatgactccggatccatcaagcaaatccccatccaaaatcagagaactcttatctatcgagagatggactcctatgccgtatagaacataacgaagtactaaaagtagagatcggccatagcacaagtccttgttactccagattcacagaaagaatttgttactccagattcacagaaagaatcagaagcagcagagccacccaacaagttaacataagattcctacacctacatagctgaatcccgtcacagcaagaacaccgcaaaatccccctcactcgatccagtctaaaacgtccaaatacaacagatcctcccagtaaacgcgcgcacggggggatgcgaccgagccgaatcgggcgggtcaacggcgtccagatcggcccgcccccccgccgccgcatccgccatcataggggaggaggaggaggaggaggctttttattttttattttaccgtgccgtcgagggagccggtcggcgacgacggtgtacggcgagagaacgggcgcgccccctccgtccctcgataccgccgtcgatcggacccggcggcggcgaggggaggattcgtctcgcggcgagctgaggctaagacgaaaggggaggaggaaggaggggaaaggagacgggagactcgagagagagggaggcgctgaggcgatgggtgccgctttatattatttggtcggcgtgacgtggacagtgacgtggttggctagggttctctcgcccgcggcccggcccgcacccgcgtggaccgacctcgccgtgagccggacaccacggccggtcagtggggcccgcatgtcggtgtctccccggtgcaccgccctgtcggtgggatgacgggtggggaccaccagccagccttcctgttggtgcgagtggtatggtaaacccggacgccacgtcagcgggaggctgctcccccccagcacgagctgctggtcagtgacaggtggggccccggtgcggtgtggactcgtcctggcgtgtccccccgcccgagtgcgatgtattcgggtgggccatagggccgggagcgcgtaggtggggcccacggccatagtgctcccccctggtgtggttctttggatgctcatttgatttgagctttaacccccccccccctcgtcctcgtgctgtgtaccgcggcggatactactagtagtactacgttggaatttgaactctactcgccttcaaggttcaaaattcaaaattcaaaaagtttcgaatcgcgcacgaggtatggggcaaaaactaagcttggacttggcacggagcagtgattgctcgaggatccagcatttttttttcaataccattaatttgacattgaaaagaaaatggcattgaaaaatagagctcccttattccacggaaaaaaaaatctctctcagtagggaaaaaaaaggcattgccattaatttgggcagaattaggccgcacagggatggaaagtacagaaatggaaaacaaacacatgaatgagatgaactgtaaatgaaaaaaaactttaaaaaatgcataaaaggaatgatgaaaaattggatggttcgactacaggaaagttttagctcattagaatttattggatgcaaagacatttcctttccgtcggagagatcatgttatttcttacgaaaaagtgttggaacttccttccaagtcaacatacttgatttacactagaatatctaggaaagtaaggcttcgttcgattgcaggtggaggaggaagatttgtaccacacgtaaaacgaggaatctcattagcacataattaattaaatattaataattataaaggtgaaaaatatatttatttaaattttttaaacaacttctatatataattttttttacaaaaatcgcatcatttaatagtttgaaaagcgtcgtatcggataacaagtaagttagtttcagttgttgaatagaactgggcctaagagcaattcgaacggatactatatccagtccttcatcgatgaaatagcatagggaaaaaaaaccagctccagcagatacgctatgtgggcacgtgtgtgctatcccaaagagaaacgttaaattttagcgttcctctcccctcacgccatatcgcaaccgccacctctagaccgagctatcccgattcagattgacggagcaaccccttgtccattattgtcattgttgtcattctttttttacaatgatggtggcagtagcgggacattggctggtggagccgtggaggagtggaggtagagaggaaggagtgtaccagattaggaggtggggatgggttttgggttggcacccgctgcgccaccgattccctaggctgctacggcagccaagcgtcgccccgtgcccacactcgcaccccgctgtggagcatttgaacaggaacagaaccacatcgtagtggaggatccgactgctcatatttatcttgtgcgactattgctacagcaacgatgagttcatcgtccaacaatgaatcatccaagagaagatgcctcaaaatgtagctcattgagtgatgaaagaggatgcacaacaatgtggatggaggaaaaagatagcaaacaatgtaatggtatatgtagtgttgaaatctagccgttggaaagctatcaattctaatatagtagccgttacaactagccgctaaaaaaatatccatccgttggagatatagccattaaaaaaatacccactagtccattacaaatatatacattcaaacataataatttaaaaaatctatccgttacaaataatagcgttagaatttaatcatttaaaatatagctaataaaaataatattggaatatattactaaaatatagaatggtgtaatatggaggatgtaatttggataatctattagagcgaaaagggatacgaagagggaatatttttttgtatggtcttccaaatgggaatatggaggatcaaatttgtatgagttgttcgggatgttccatccaatttttacctgacaatgctagaaacttcaactccgtgttgtgtatacggtgaattgatgggtacaattctaaaatttgtgaaaa

SEQ ID NO: 55877 - DNA, 824 bp, Oryza sativa
tagaaggagcgaaacttcaaacccacatcgtccagctcacaccttgtggagcccctgggcgtttctctggcattgtagtattttcggaggagggttgttttgaatgttgttctctgaagaaaataacatttctatttaattatggatgaatgtgagatgaaactttaggacagctttgactagatgtgggataagtcgtatcgaaatgatagaatgagaatgcaaccgccaagtgatggaaaaatacattttcttctctaacaaaaaatagttagatgatataaaagctagaagaaatagaaaaaatacaaagaggaacatcaagtgagttttgtccgtactgatagtatgtaccttgggcttttcatctcttctatgggctcttgtcaacatcattttctactagcagaatacacgtacttctgttatgggtttggagcacacagcatacgataatgccaatgtcaccatctaatctacccatgccattccgaatttccgactactatatgctctcatctgcaactctctcatgtgttaattaactagtcagtatgaaaatggatgaaggatagtggtcctatctgtaagattgcagtcgatgaagtggtggcagattcaccattatcattggagtcttttaaagaagtacataaggtacataaggtatatatatctttgaaatatatcagcattctctatttttatttctgccataaggtacatgcttctttcttgtatttaaacaaaaatcggcataccacacattcttactttatccttaaggcacgaatactagcgcgatgtcagtgtctagagtagat

SEQ ID NO: 55878 - DNA, 788 bp, Oryza sativa
ttttttgttaatccaaattcgctgcttgccgatctaagagtaaacctaaagcacgaattaagaatgtttttaacaaacgattttcaagcgtatcaaagctcatcttacgcgtagcagctaaaatatgcggattagctgctaatttttcacgcagattattgccaggtttacgacttaaccactgcaaagaacggctatcgaggcgttgtgctaagtaaactggggtcatctcatgaactctattaatcgtttgtcgaggcataatcagaatattgttaatagcatcaacagcatgatcaattagataagtaaaacgatcctgtaattcagtattttcgagtgcatggccatcgtgacttaaccaatgactcattcgttgtggtaatgcttcacctgtgagcggatcaaaggtaagattaaccaagtagaaatgctgtccctgtaataattgctgtgcaataaattcctgtgctgtatagcgaccgtatagttgcccaaagtcgttcaacttttcatttgcaaagttgatcatttagactccttgtaccgactcttgctgaacattagttttttgatctgatgacaccgtaggggttgctagcttaaatagttcttgatagcgttcattgctctgttcattattcaaataatctgcacttacccaattaaattgcccatgtcctatacgcatcgccttatcaaaatcatcaagaatatctaacttttctttaactaaaatttcgcgaattggatctaagcaatgctgtttggcatatccacgtatctct

SEQ ID NO: 55879 - DNA, 967 bp, Oryza sativa
gaaggataataggaaaagggatggcggtggatgtgcccatcagcagggcggtggctagggttggctctttacatagcaaggtggagatgaaatctgggcggtggctagggttggctctttacatagcaaggtggagatgaaatctaggtttagatggttgatccaacggtcaagaatttgcaagatttgattgggcattttcatgtaaatgtactaaagcgtaaaacactatcgtaccccctttgtttttttaaatgtacgacgctattgatttttggtgcgacgtttaaccattcgtcttattaaaaaattatataaatgttatcggttttgttgcggtttgttttatcaataaaagaactataactttaacttatatttctacatatttaacttatatttctacatatttgtactatatttttaataagacgaacaatcaaacgttacgtgaaaaaccttcgagtcttatattaaaaatcggatctagtatatattatcatcactattctcaaaacttttcagagttaatcacaaatgaacccaacactatttacatgatgttcggggacatccccactccctgtcagcatgtagaaaatagatgggagagaattcatatagacatctatacacagaatctgcaatgcgaaactgctgataatggcagcttcaaacaagcaagcagcagcgttaattctcaggctttggaagccgcctcctgccaccgttgagggcccgtatcagctgcaggtgctcatcgctggacacgtggagctgcagccggagctgcgtcagcagctcctccttctcccacgtcagcgcgccggtggcgtggaacaccctcatcagcgcgccgtacgcgtccacctccaggcggtggatttgctcgcctaccgccgccgccgccgccgccagcggcggcggaggttgctcgttggccaggcgccgctgcattattggcgca

SEQ ID NO: 55880 - DNA, 4034 bp, Oryza sativa
  unsure (1)..(4034): unsure at all n locations
nnnnnnnnnnnnnnnnnnnnnnnnnnnnnnnnnnnnnnnnnnncaacagttcaacagtaattatcttgacgaaatgcaaggttaagagtaaatcagaaaagagatgataaatcatgcatgaagccaaacattaagagctattccagagaaagtacaaaaggcgatcggaaacattaagttaagaaataaatgtaccatatgtgaaaaagaatgaaagcaaaaaggcaatatgcactactatagaaacattatgaatttgaacagccctcactgaagtaccatttcatctgctgaacagctagcatcatctacaggataatgtttgattgtggcatcagataaatttccataacaagcaacatcacgataccgcacaccaccatcgcatggcgaggagcacttcatccatggtccagcaacccaatgatagatttctgcatatattagtatactaccaatcacttattctccaagtaatgtatcaacaattgacaactgaatcgcctgtgaacaatttcagcacaaattatgaacggtaaagaaaaactgcaaaatggtctccttgggtagtactaaatttgagtgcgactctagtgcaaagaataaaaaggtagaggaaacattttaatggtaaattgagcaagaacaattgaaggacctaagaacatgaaaagaactaggaacagccaaatatctgaaagataaatcacagaatattttgtaaacatcaaattattccatgcaaactgcaggattcacatgttcatgaacagttaaatataccgtgtggttttaactgcattgatagctcagcaccactcttacagtaacccatttttctatgcttgatcagaatggttgggtcagagcaatcagagcagcatacaaattctttgccaaaatccagcttgttcttgcaatgcccacatttgtttgttagctttggggtgcctgtccttcagaatataaacaatgtattagaacaccagagtaattcattacaatgtttctgtaatgtttgaaaaggatggtctagattctgcgcctacttatgctaaggatggatgcagaagactaatgtagaatatagtagatgattgagcaactttccaacaatacatatacccatgcacacacctgttatgcagcaatggaaatgtttgtggaatggaagacatggcgggctttttgactccgtgcaaagaccatcacaatcatctgattgagaatctaagaagtggccagcagaacacactctagaccatttgctttggcacccagtccagtagcaccctgcatgttgaatgttacacttctatcataatgcggtattgctgactttaccatgagtccatgaacatgcatgacacatatatttagcataacttaaaattttccatgccatgaccaagcaacttaaaaattcccaagaaatgccctgaaaggatattttaatagcataactgtcactaaataaagtgaccgttttttgttcaatttaccaatcaagtgagtcatgcagggtttataagtattccaatcatttcgatttcgttagctggacataatctccagtctttggaattctgagttttaggactacgcatcctggtttgcgaactgtgcagttattattagctcatcagtgtcacgtaacaaagtagatcgaagaacaccgctagtccactactcttcaagcaactggacactctaagcaatttggcaaatttaagcagtcgactcgaaacctgggccaattcgtccaggaaccaaattattcatttcctgaaaaataatactactaacgtaaagtcgaatctcgaaaagccccaaatccaaatccaagtgcccaactagagtcctccagtccccctagtcctcctaacaccacatttcgacttctcgagctctccggagcaagccagttcctggctgggcttccgaggcagatgcattcggttaccgtgggacgggacgtcgaggcaggcggcgacggcgaggaaggggagcgccagcgcgcacagccgcggcagcgccgccgccatctccggcggccgccccgccgtcgaggaggatggccaagccacggcctcgtttcgttccggggtggcgcgagaggtggccggtgggggttggtgactcggtgcggtggcgcgtgccggcccgcgccgcggtggggaggggaagggttagcgagtcgctcgttcgctcgctcgccgtgcgccccccgtgtcggtgtcggtgtcggcgccgggcaggcagctgttttcggggggggctacgggtgggttgggcggtcgccgcgtcgcgcggtgatcctcctgcttcgggccttcaacgcgaagccggcgagcttgggcgagtacttctttgcctgggccagaacagcactgcacggaaattcggccatgcttgatgggctgggaatggactgagacatacgtgcggcccatgtatattcgggccggaacggtattaccgcgtacgtgaggccgaacaggtttcggaaaagctaattcgtgtgtacgtgttggcggcgcgcacgccggcccactaaggcccatgcacgcacgagctgcgcttctctctttttttttctttcttttttagccgccgtttctttttttttttgctgttttttttcctgccgtacggataggagaaaaaaatcgtaattagtttagattagtttcatatttttactagggattagtttactagtaattttaaatattaactttaaaattttcaaatttagatatgaaaattttcaaatatcgagttgaaagtttttaaatatcaagttaaaagtttcaaaattttcaaatctagacttgaaagtttttgaatcgagttaaaacttttcaaatcttgagttgaaaagtttcaaatctcaagttgaaagttttcaaaattttcaaatatagacctgaaagttttcgaatctgagttgaatctcaaattgaaagttttcaaatctcaagttaaaagttttcaaaactttcaaatctggacttgaaagttttcgaatctgagttgaaagttttcaaatatgagttgaatgtcttcaaaatttgaatttaaaatttaaatctttaatcaaaagtttctaaatctaacttaaaaaatcgaaaagaacacgtaaatgaattaaaacatgccgaggagaagggacgtgaaaataggagaaaaatcaaggaaaaaaagagagaaacgtataagggggaagggcgtgggccgtgcgcacacgcgcaagtcaagaagccccaacaggtttggtccggaacgggaggccgacacgcgtgcggccatgtactatggcctgtgggcgtgtagctggctgtagccggttgcgacaactagctgttaacgaccaaatttggtaatcgtcatcggagatgaagattagactgaagcagaatccaaaacagagatcgtcctggaaacagagcgggaatcagctagatcagaatcggctgcggctttaattggcagagttcgagtcggacaaggttagcgattgagccgaatccgacaatgtgacacggtatacgttgtcaggttgagttaatgtgcttcatgaagattgccgtgcacggattgagtcctgagaaggcaactgtatctattaattaggatattttatgtaatttccttagagatatgtttgggcaaaagtctgccgcaaagacttgtggtatcttagagtttgttagagataagagtcgtgtccgacatggacgtattttgtaatctcgggtataaatagaccccgagccccatttaatcaatcgaacacacgttcaatacaatctcgacgcatcgccaccctttattttcgttttgtttcgacgagttcttactttcgggttgagctacatcggtttcgatcttcaactagaggtaaaacttattatggcggcttgcgttctcgggattagtgcttccatctttatgacactctaatattgtttatgtaattcgtcgaattatcatatatccaatatatctccggcaataggggatccactagt

SEQ ID NO: 55881 - DNA, 1915 bp, Oryza sativa
agctgcatcagttgagtttgaccttataagtcgtgattagaatctcaatctctagtctgcttttggttgctgattagggtagcatcggggtttcagccgatcttatctgatttaactacttttatcttatatacttgattgatatattaaatctgccctttatgttaaaatctcgttgcatttaaatatattaggcttttgtttggtatattccacttgctttgatatcttaatatggagtggtatcggagtattagccgatacatgctatatctatctgatcggctatgctatgaacatatataatcttgttgttaatatatatttcgatctaagtgatttatactatctcggcatggcgaccgatctaactcaatcacttgatttaagtatatatcgacataagaattatatattgctaatatctacagccgatcgagtagatttagttctttcttacttattcatgactgccgatcgatctacatatgacatcggctcaaagataaatgatacgtcatcggcaactagccaatcggctatcgtttatgaatttaaccgcggtttctttgtctttgtttattgttgattgcaggatcaaatcaactagcatgctcacacacctaaaggcaagcttttggacctgcattggagttaagcagatctcctaggcctcgtgtttttacatcaacactagcgcacagccaatcaacttcgagcatgtgcaatgggtatccctgatccgtgcccctactcatgccgtcggggttttactccggagctgtctcccagcagaggggcacaacccagctgcgaggcgccacgcgcctccctcctctcttggccccttttcgtcgagccacggaaccgggctccgcgttgggcgcaccgtggctaggggagtagctcgtgggcactgctcccaccctggatttttctcttccacccctcgccctagtagatccggcggtgaagaggagcatcatcggcgacggtgaagagagagaaagaggcagcgacgggcggagggagagaggcaactttgtttgtttagagggtgtttagattcaggggtgtaaagttttggcgtgtcacatcgggtattatatagggtgtcgcagggggtgttcagacactaataaaaaaataattacagtttccgtcagtaaaccgcgagacaaatttattaagcctaattaatccatcattagcataggtttactgtagcacccgtattgtcaaatcatagagcaattatgcttaaaagattcgtctcgcaaagtagtcgcaatctgtgcaattagttaatttttagtctatatttaatacttcatatatgtattcaaacgttcgatatgacagggtgtaaaattttaggttagggtctaaacaggcccttagactgtttgaggtaacttctctttaaacggtgtacttttttaacagaaaattttcaatatcatttggatcgaactaaacctaacgtcgtgtttggcagatcaggttgtgaacttctcttccacgtacgtaaaacggagtgattcattagcgtatgattaattaaatattagcttaaaatttttttaaatagattaatatatttttaaagcaactttgtagaaacttttctaaaaacacgttatttaaataattcaagaaccgtgtgtgtgcggaaaacaagacattaaaagttaggaagttacacttaaaacacagctttttaaactgctaaacggtacgttttttacaaaaagtttatatacgaaagttgcttaaaaaaccatattgatccatttttaaaaataaattagcaaataattaattaatcacgcactaatggattgcttcgttttccgtgccggaaggatgtattcccaacccaaacaaaagaaccgagccttagccatgatcaaga

SEQ ID NO: 55882 - DNA, 9697 bp, Oryza sativa
agctgatcatatctcagcgtcattgtttgactggctcttcgagactctctgtccacgccatgcgagtatgcgacgaggggcgacccggtgagatcgaagcttgagtctgttaccctgtaatgcccgaggcgccaagtgcccgattgagacgaatggtgatatatgggttcttgttctcacatctggtcgccgtaacacgacaccaaccatgcatccactctgccatcggtcgagccgagcatgagttctccctaatagtacattattgcttgtgaccggctccttaattcccaaatcatggctttgttcccgggtaaaaagcaccattccagtaggtaaaaaatattctaaactcttaagggacattcactccttgtttcactccttgtttgtacgtcatctaaatgattataatgaaactttaaaaaaatcaacaaaagatattaatatgtgataaatcactctagaaacatacaatgtcagatttaacttatacaagtaaaaaaccaattttgattgtgaatatgtgttaactagccatagtttaatttttttttcacagcgtgtagaatgaattttatcttgcatgtttgtggagtgatctatcacatattaatttatcttgttgaataattttttataactatttaaattacatataaataacgagtaaatgtttacttgaggtattagaattccctcctcgttcaagtatcgatattcgtttttagcgttattgtacatccgtgttagcttcttttatctcaggccttatttagttcgtgaaaagagaatttttaagtgtcaagtctgacgtttgaccggatgtcggaatgggttttcggacacaaatgaaaaaactaatttcataactcgcgctggaaaccgtgagacaaatttattaagcctaattaatccatcattagcacatgtagattactgtagcacttatggctaatcatgaaataattagactaaaaagattcatctcacgattttcatataaactgtgcaattagtatttttattttatctatatttaatgtttcatggatatgttcaaagattcgatataacgtttttgggaaaaaaaaattaaaaactaaacaaggcatcagtaggtcccccaattggctctattcgtcagatgagaaaaaggctaatcttgagctggcacggccatccatatcggaatcgccctgacctttcaagggcaatcagtagtactacctccatcccaaaataggtgtagccatgagtttctgcgtccaactttaatcatctgtcttatttaaaattttttataattagtatttttgttgttataatatgataaaatatgaatagtactttattcgtgatttatgtttttatttttttttaaaaaaataaataagacgaatgattaaagttaagtaaaaaaactatggctgcacttattttagggcagagggagtacttccagtagactactactcgtagcacaattacatgtaacatggtggatcgatctcggagaggggtccctactttggggtgatgatgacggactctttccatgcatcttcccttctagatctgacagtgacaccggtacactacaggtgcggggagagtgagacaaagacagcgaccggtgacaccgatcaatatctaacacacgcccgtccatcctccagtgccaatgccaacatttgcacacaagaaaaatgcaagtgtccacgcaccgcgtcaccgcgcgatggggcgcgcagagcggacatcagagcaaggataatggtgaactataagcaagctaaatacttacgtggaagagagagataaataaaagtggagagtgttggctctcatgtaagagctagctccacacaagttctaagaaatatatattaaattcatagagagataaagagagaggatgaaaaaataaagctaacctattatatatgttagctttaacattggcttataataagtagtgggctatactactaaacttgctctcagcgcactggcgcgatgatagcccgaccatttcgatccccgcgagtcacgccgcccctcgccaccgccggggctcgctcgctgcttggctcccgtcggtggtgcattggcgcgtgcgtgcgtgttcgtgcttcaaaaacgcaaggcgaagagaggtaggcaccgcgcgacggctttgcactgccttgtgtgtcggttgctgcacgtctcgctcacgctgcatgcgccacgccggatcagatcgcgcgcggggcgggacacggaccgggggggggggggggtgggtttggcgcgcgcggcgcccatcggggtcaggcacacatgcccggtgtcgatcaggcgcctagctaggcccccacctggcagagcaaccgacattgagctggccggcctagcttctcctctctctctctctctctcgccgggggccctcggccaccgcatcacgcacgcggccacacatcgatccgcagccggccggcagggcccgccaggaacgttcctgcactgcaggcgatcgatcatggccctgtacaattcctccctcccatcaccatttttttgaattatgagatgcagcaacaacttgtccatctgcactgcagcagcaacttgtaaaaacaattcgattgcacgcgcgtacagccaaattaagacagcgagtgcgaggtgtgcagcgtttctgttcttccatgccgtaaatccgaagcgagacgtgccgatcgacaaagatacgacgcgctatacacgtaccagcgctatctcttgtcttatgaccggcatacaggcacttcgatggacggacgcatccatccaaaactgacgaaggattcaatcaagtgagcaagtccaaagcacacacagaagacggacagaacagaccacagcatgaaagccggacgacgcgcgcggccttggattttttttttttgttttgcacacgcgtcgatcgacgcatcgaggaacggaaagctttaatccccagacagttctgcatgtgcttcggtttggtcgatgaaacaagcagggctactgcggaattttgcctgtcggtacgttagagcaagtttaataatatagctaactactagcttaaattcatttatagccaatctaactactatcacacttcgtcttagagtccgtgttataactggctacaaatctatagttcgctgtccttctcttttctcatttatctgcttaaaatatatttacagctggcttatagtctgtgctattgtacctgctcttatgcggcgcgcgctcgccaatactcctacatgcgtgatcgcgtggtttttcctggcgcgcgcgcccttcccggtgccgtttttactcgcggcgccgcgggtgatcgatccgccagctccgggcggtcactttcacatcaagaaacggagggggaaatagccagataggagtgcacggacggcagctagcttagcttctcgatcgatcgtcttctcgagcaatgccttatcttgggtgccataccatgtcgacacactcgcatcgaattattttcgccactgaccgtcactgacatgtgggccaacgcattaagttagaccgccgacagcacatgcaggcgacgacgaccgttttcctgacggttgattgaaacggatcgtccgtttccgttcgttaattggtactactacctacgcgtagcgtgttgctccctaaacaactcccagatcaggcaaaggaagcatcgtctcgtctgcacgtactctaccaagaaaatgatcagcgccatggaggccagaacatgcacacatgcggtgcgacccctcacatggggcaacagggcatgctgcaaactgaagagtcgaagaccacggttccctccccatggataaaagatctggtcttttcagttatcagtgtccggcatatgtatggggatcaagtggtgggggcaaaaaaaaaaaaaaaccagtggcatgatcgggcacagctcgcgtcggaacaaggcatcgtgtcacatggaagaaacccatcgcttgttttatggaccgcgcggcgcgcgcgcgcatgcggaccgcgcggtgactcctgtccctgtgcaggttgacggcgagcacatgcctagctacgtcgtggtagccccctgcaacgtcccacgtacgcgcatgcaaattgcagcatcacgattggtctggaattgtacatttgtactctctgcaccagggaaaaattttgtccagattgcaggggagagatacggttggtgctgtgcgccgtgctgcgaatactgcgtccagtcaggcagactcgagctcggtcggtcacacgaacaggcgtgcatgcatgaggcacgcaggccggtcaatcgccttgcacgcacacacacatcctcgggtcgatctggccatctgggtcgcgtgctggtttgggtggaatcgagtttctagttttgtcttgcgttacgatttcccctgttcgggtgtgttgtaatcttgttgcggactcgcggagtcgcggtatatactcggtacatgtatattgcaatttgcgaggggggtttgggtttcctcgcgcaatcaagtgcgtatatacttaagacgcgcgcacacatgggcgccatgtgtcggttgagtatccttgtcagggtttgatccagatacatgatgctgtccggccttccagcctacaacatgatcctggaaatgatgtgatgacatgatgacacgatctgaacctacgatttccatgattaaactgagcttcacaacctcgggccacaagaattttcacgtgaagccgttcgaattgcatgcgagtatgcaacttactcctacatcacgaaaaatggtccataccgcaaagggaaaaaagaaagttccaagtgccatggtaaccagctcactcagtgacaaaagtggtgaaagattcctaaacaccggcacgccacagcgtccagccggtgcccggttgtgcgactacgatgcttgtcccctcgcaaaatcccatgatgaacgctaaccattaaccaacttgattacatacggcggcatctgtgttatcacgggaaccgcagaggcatacgtaaccgacgaaaaaaacgcggacgagatggcgaaactgcccctcgtcgtgcaccgcctcaccgggccgaaagccagtcgcgtgcgcgtgcagagagacggcgcgccgcacgtactgtacacgagccggtgcgcgcggtaggaaacggaagcggatcagggggccatgtgaccgcacgcagggcgtgtctcctacgaggccacgagggcagagggagcccatcatccgctcagccgaatcgccgatcggggacacgcgtacggcggaagatcccgtggcatttcgtggtagtaatcgaccaaccctaggcccgtttcgccggcagcttggtctataagttgctgctctgccctgctcggcctcatcatcccaagcggcacagcagcctcgagctgaactgaagcaggggaggggaggagaggagaggagagagcaacgcgttcaccgttgagagaagagaaggaagtaagacgagcgcaatgcgtcgcgtcacggtgctcgttctgctcctcgcctgcgcggcggcgcgcgccgccgccgccgtcgtcaccgacggtgagtgcctagcttgctcgctaactctgctcgataatcactgcgcaggctcagctctaatttcacttcaagcatccatttatgtagcatactgttaggaagttactgcggtttctgtataagctgttttgctgttctgatcgatcctatctatcagcggcaatgcggcatgtgccattagtgtctaaaagctcgtaatcaagctaagctgcctgccccgtgatgatttacgatcttggagtcatggagtgaatagtaggatagatcacccgggtccctccattatccatatactgacgaaatgtttcccccggtcgctgtcatagcatgaagccacgaactcgatcatgcgttgatcattggagtaccatatacagggtatactgtagtttggttaaccccacacggccaaatcgcattggggcatgcatgcataatcacaatctacatgttgcatggctggcaaagtaaactgaagtacacgtatagttaatctcctattaaggtgtcgtggtgtgcagcaccagatgccgaccgagcaaaagtagtagtagtacaactatacaagcattaaagcatatgcagctgcagcccatttgcaagaaactattcttgctttttagtactagtcgtgaacgtgttagatgcataatcagatatgttctctggtccagtgttctggactagtagtatgcaataatcagatctggagtatcatcgtctgccagcattaggcaacgtttgatgcgagagtgcttttgtgcgctctcttgatttggtttctcgtttgttttgccggccgcggccctggttgcgttgcatgtggtagatgggatggtagtgaatgcacctgggccctggccgagccagaggaactgacacggtcatacagccctactagctgccggagcccagaacatgcatgttacactaacatggaccctgtcagcttagcagtataccggtcgcagttccattaattaacagaacacgagatcagacagacagcctgcgtgcctgatctgatgctctgaatcgatctctgctaaccgcagcatcacctccaacaactttcttcagttgcaggctcgcagtgcagcggccgatttgaatatctgatttagtggattaatctgattaaattaatggtgactaaaaaaattaacgacgtgtgttgtgcagggctgttgccgaacggcaacttcgaggagggcccacccaagtcggacctggtgaacggcacggtggtgcgcggcgcgaacgccatcccgcggtgggagacgtccgggttcgtggagtacatcgagtccgggcacaagcagggggacatgctgctggtggtgccgcagggcgcgcacgccgtgcgcctcggcaacgaggcgtccatccggcagcggctcgccgtgaccaggggcgcctactacgccgtcacgtttagcgcggcgcgcacctgcgcccaggcggagcagctcaacgtgtcggtgagccccgagtggggggtgctccccatgcagaccatctacggcagcaacgggtgggactcgtacgcgtgggcgttcaaggcgaagatggacgaggtggcgctcgtcatccacaacccgggcgtggaggaggacccggcgtgcggcccgctcatcgacggcgtcgccatcagggcgctgtacccgccgacgctggccaaggggaacatgctcaagaacggcgggttcgaggagggcccctacttcctccccaacgcgtcgtggggggtgctcgtcccgcccaacatcgaggacgaccactcgccgctcccggcgtggatgatcatgtcgtccaaggccgtcaagtacgtcgacgccgcgcacttcgccgtgccgcagggcgcccgcgccgtggagctggtggggggcaaggagtcggcgctggtgcaggaggtgcgcaccgtgcccgggtggacgtaccgcctgtcgttcgccgtgggcgacgcgcgcgacgggtgcgcgggctccatggtcgccgaggcgtacgcggcgagggcctccatcaaggtgccgtacgagtccaagggcaccggcgggtacaagcgcgccgtcctcgagttcgccgccatcgccaaccgcacccgcgtcgtgttccagagcacgttctaccacaccatgaccgacggctcgctctgcgggccggtcatcgacgacgcctccctcgtcggcctccgcaagaagacggccggccggcggctgctcctgtaagacgaacggccgcgtggcatcgaacgccgtcgcattccctccattctatgaatatatgaatacaaggcgcggttaaacttgggggcagttggcacgaccaaagttgggtgctaaaatgggtagtattgctaggctcgtttttttggttttggtgtgtactctggtatatgtacgcgtgtgcgcgcgttgcatggttatactttggagctgcgctcgtttggtgttttgttgtgaagaggagaggtgatacgtggtgcaaggtctgtcacaaggggtttggttgatcaacttaaccggaggtgccaacctaaacgcaccatcagacattatgaatgggaagcattactagtgctcacttttttataagtcaattgtgtatttttaattctgttctaaaaagccagatcctttttgaaagttgagtcatacatttgagctatgctcgaaaatcaatcggaaacgaacttaaacatgtgtaaatgatgtatgaaagtaagagtaagttttatatttagccacattttcttattagaaaagttttaatttggatcgcttgtttagctatacttttacttcggaccagataacattttctttgtttgcatcttggaccaccttcactatacatctatttcatccccacccaaaacccgggtaactggaaacaagaggggacacacgccactggcgccgagtggcttgagttcagactttgcgcaagctccatccatgttgcactgtggtcaagcttggcttgctcggtttggttcggctctgcttggctccatcataagtggtgtcgatttttctatctcttcttatatgtaccggtttatcgtaaaagcaggtacaaatatttactacaccgttttgtcatagattttttttaataaaccggcacctataaagagctacatgtattggtttttaattttaaacccacatgtggtgttaggagttcggggaaggcttataggtgttgggtctagagttcccgacacctatagggccgtcccctatttgttgtttgtagtaatagatacatgaataacagaagtaggctaagtccctgtttgattcagcttaggattattataatctagtttattaggagtaagctgagacaaacaagtagattattataatctataagtcagattattataatctgataagctactctagaggagcttttttcagattattaagtggctaaagacccactacccctacatacttgagaaaaattacccacctatgccatcaaccgaacagatagctgagggcattatagactttagccattcaaacccaataatccatgccttcaataatccagacaaataaacaactcacagcttattctatgccagcttattataatccagcttatagtaatctggcttaataatctagattataataatcataagttgaaacaaacagggcctaagaaactttggattgtattatggagtaccagtttgctaaatttatcacaattgatttggtcctaagattttttttttttacttttgagacaattggtttccttttccgtaaaaaagagaaagaactatgattttctttagagagaatccactcattaccactgagttcggcatagttcaacaatatgccactgactttgtcgacatccataatataccatcgcctttcacttaacctctacactttaccatcaccgtcacacactgttagtttgcaacgaggaaaagacaagtatgcccttaggaacgtgaaaaccattagcactgagactatgccatgtagggcactgagagtgataataactatacaaagaataatctacaacatgaataaacatgtaaaaa

SEQ ID NO: 55883 - DNA, 1555 bp, Oryza sativa
agtagtgtatcagtgaggggtttggaaggaaaatcatccatggaaggtgcatagcacaatttgacagaacagtgcataaaatccaatgtccaagtttggcataaccaagttcgaccacaacatgttccaggacagaaaccaacacatggctaaataaacaagttaagtggcacagcaatcggcacgacctctttcgatgacgacgacggcaacaccagctcttcagaagggaagccgtcccttagttgcgagttgcgacggcggcgctgatgacgacggcagcaccaacggctgctctccacaaggggcgtcttctcccatctgcgacgacggctcttcagcagggggcggcactgctgggaacggtgctgggggcgtcgctggggacagtgggttgtggcgacgctggggatgatggtgggggcgacgctgaggacggaagtcgaggcgctgctgggaatggtgctgggggcgccgctggggacagtggtcggggcgatgctggggatgacagtgggggcggcgctgaggacggcaggggcggcgctgaggaaggctgtcaaggcgacactggcgacgacgaccgcgccgacgatggggacggcggtcggggtgacgctggggacggtggccgcgccgacgatgcggacggtggtcggggcgacgctggggacggcggccgcgccgacgatggggagggaggcggctgtcccgtaggattagggctggccatagcggcgaggggtcggtgggggcagccagcggatggggcgtcgcggtgggcgctgatgcggcatggcggcgggcggagaaaagccgcggcgtcgctgggaagatggcggcgctcgagaatggttgattggggcggcctggtcagtgctagggttagatggctcaaagggtatttcggtcattacgggaaaaaaataacagtacaaacggcgtataactgacagactgtggacggcgatgataaagtgtagaggttaagtgaaaggcaatggtatattatgaatgttgataaaatcagtggcatattgttgaactatgctgaactcagtggtagtgagtggattctctcttttctttatcctactatctctgtttaccttttctcatagatttttattcgcgcatacttagatcattcatagtgcaacaacatgacgagatcctcacaccccatctatgttgtcgctccacataggctaggcccatgtcccttagaggatcctcgcatcttgcagaggacacacgtgcctcatcaggggattaatgagcaacatgatattcacccacatcaaaccatcatccatggaaatttccttagttaccttattattagtggatgtacattagtttgtttatcttttttaagaacttatgtactttatttgatagcaagaagtttaaaataacatattatataagtgatggtaacttctcccatagaaagattagaaagatcgcctaaagtcaggcgactagggaaataacaagcatgcatattagtttagcccgatataatctcttaggtatttcgtatcaccaaaaa

SEQ ID NO: 55884 - DNA, 1111 bp, Oryza sativa
actagtggatcccctttcatgacaagtcttgtgtgttcaaaggtttttgatatggaaatctttatttggttgatttcaattctagtgaagcaaatttgaaaacttgtttagttgcaaaaacatcattgggttggctttggcataggaggctagcccatgttggcatgaatcaattgagcaaactttcaaaacgtgatctagttgtgggcttgaaagatgtgaagtttgagaaggataagctttgtagtgctagtcaagccggcaagcaagttgcatgctcttatcctactaagagtatcatgtccatatctagaccattggagctcttgcatatggatttgtttggcctaacaacctataagagcattggtggtaatagtcattgtcttgtgattgttgatgattattctcgttatatttgtgtgttctttttgcatgataagtctattgttgccgagcttttcaaaaagtttgcaaaaagggcccaaaatgaatttagttgcactcttgtgaaaattagaagtgacaatggttccgagtttaagaatgccaatatcgaggactattgtgatgatcatgtattaagcacgagctttccgctacctacttacctcgacaaaatggtgtagtggagaggaaaaatcgtacattgattgagatggcaaggactatgcttgttgaatatgatgtttctgattctttttggacggaagccataaacatcgcttgccatgcaaccaataggctttatttgcatcgtctcttgaaaaagacttcctatgagctaattgttgggaggaagtcaaatgttgcctattttcgagtttttggttgcaagtgttatatttaccgaaagggtgttagactaaccaaatttgaaagtcaatgtgatgaagggtttcttctaggttatggctcaaatagcaaggcataccgggtctacaacaagaacaaaggtattgtgtaagaaactaccgatgttcaatttgatgagactaatggctcccaagagggacacgagaatttggatgatgtaggtgatgaaggcttgatgagagctatgaagaacatgtctattggaaatgtcagcctatgaagtggagacagccat

SEQ ID NO: 55885 - DNA, 970 bp, Oryza sativa
acttgtgctctcggtctgaccggccgacacccgtcggtctgaccggccacctgtgggcggtctgaccggcctgatgccgtcggtctgaccgccctacaagctgcagtctgaccacccctccgcaggatataggcaaaattttcaccgcttccaaaattgcttctaaaattcttgctaatatcctatcctctttgctctttgtcatctatgcctccccacactcgccatggtcgtcatacgcccactctgaatcctgtgagtgagcatgaggagtcgagcggagaggaatatgcttaaagtgatgaagaagtcgaggaacatgttgagggggccagtgaggaggaaagtggagatgatgacagtggtagtggggaggatgaggaggaagaagatgatgagttgcaagttgatccctctattcagtttgtagtcaacatgagaaatcctgctcagtataccatattacggcataatgatcagttcttgagacctagagacaccacggatccccggttccacaccgcttttcagaagacagtgtatgagtagatttatgtggggaaagcttttgcggatcacaagtggatctcttggagggatatcaatgagaccccagaatttcaaagtttgcatgatctcttcaagatagttggcattgaccggattatgaccctcaagcaagattacaatgaagacttgatccgccaattctacgatacagtgtgggtggctggagatttcagtgagatgaagtggatgtctgacaccctccagtgctctatctctcggaggcagttccggaggcagctcaacattcactttgattttgaagatgatttgcatgaggagcacactcacaacccgctctccattgactatctctctcagttctctgaggatggagtgcggtacacccatgggaaggttgccggcttgaggactatccctggtgtggtaaacataattgtga

SEQ ID NO: 55886 - DNA, 2918 bp, Oryza sativa
tgctatgtgtacgtttttttagcctggattagttaaaagaaatattgttattcgctaaacatgtttcacctgatagttactaattaatctctcacgtatatcaatataaaactaccacgtttattattaaatcaaagaagaaaaaactaaaattaaaaaaaaagaaaagaacaaataaacatcgttccccgagaccccaaccccagccgaacagataaacgatgcggtcgggtgggcaaagagcgcgggcatagcgaagcagcatggcatggaggtggagcggcggtggaaagcgcgtgttgaagcagaggcggtggtcggcaggcgcggacgtggaggtaacagccgaggggcacagaggcggaggcggaggaggaggccagcgggcgcggaagtagtggtggcggccgaggggcggaggtaggcgacgggcacggaggggtggaagggagcatgattgccactagcgacactgtacttctggatctggtatgcctctttctctccatcctccccttccgtccggtgacgacgacgacggaggggaggtcacggaactctggatgagggcgggagctgcaaccgttgtgatatggcttttggagagagaaacgctatatttggccttactctctccgttttggcgcatcctctatttttggatggctcgatggcgtgtccgctggagccccgtttttcactttcgtacgctaaatctcggatggagttctgaatggaggatctcctagggatgctcttagttagtgctccctcagttgcaaaatagtactatggatttcttgagttttgcactggtatatatttaaaaaagtgagtaaattttattttgcacagggtatattcaacagttttactttgcatcatgtataagttgaaccattttactttgcaccacgtatgttagtgtgtactccttatgtcccataaaaaatttaattctagagatgaatctagatatggtgtatgtctagatttatctttggaattggattttttttttcaagacggggagtaccaattagttttcgcttaccactaacccgtacggttcgattcgatcgatgcaactcatgggcctggcctcaggcctagtcgaagatccacggtggcttcgccacgatggtagggcctcccacgttgcccaggtggttgctttatccatcgccttagctgaagtcatgtgacaatagaccttgtttagatggagaaaaattttaggtttgattgtcatatcggatatacggataagtatttgaagtattaaatatagtctaataaaaaaataaattatagattctgccaggaaactgcgagatgaatttattaagcctaattaatccgctattagcaaatgttcactgtagcaccacattgtcaaatcatggtgcaatttaggcttaaaaaatttgtcacgcaatttgcacgcaatatgtgtaattgattttttttcatgcatttaatactcaatgcatgtgtccaaacattcgatgttagagcgtgaatttttgtcttgggaactaaacagggccataatctcaccaaatatactccctccgtcctaaaataagcacaacacatgagtttccgtgctcaactgaaaaacataagtcacgcataaagtactattcatattttataatctaatatcaataaaaatactaattattaaaaaattttaaaataagatggacgattaaagttgtatatggaaattaatagttgtacttattttgggagggagggagtatgcagtcagatgttgccactgaaggtttatcccgtgcatattagcaacaaaatttaatgagcatcaccaacggtttaccaataatctatccctaaaatttaatttttggtggtttcctaaactgaaaatagatggtgaaaaaaccccttcctccaagagatagcctaaattcaatcctcaaaaactaaaaaaactaaaagtgggcccttctattaaactaccaacagaaattctatttttttttcctttcccgtgcgcagaaggagatcccttacgcgggaaggacaggagaaacgcggaaggaggggagaaacgcgcggaaggaggggattgggagtcgttctctcgccctcaaatacacgtaccgagaaaattggagatgggaactccaaggaaaaaaattgaaaatatacttttatttttcatattttgcatttatatacctgtctgagattaatttgcaaaaatatatctgatccgcagaatggttgtgcgggagcgaggacgaaccgcagaattcgagtcggtcacgtagaacccgagtcggtcacgcggaaccgagatgcgcgaccgaaccggtcccgcacggctagactgcaggaccgagtcagtaccgcggcaccgatacgcgggagcgatggggacgtcagctccgcaggtgagcgcggcggtaccgcataacagcggcgcgggacctgcgcggtcccgtggttccagcgcgcggtaccgagcgagtctcgtgttattcggtattaatcccctaattttttccaactcatcttcttcattttccacgcgcacgcttttcaaactgctaaacggtgtattttttgcaaaaagtttctatactaaagttgctcgaaaaatcatattaatccatttttgaaaaaaaaaactaataattaatttatcacgtgctaatgtactgctccgttttccgtgcgggacatgtattcacaatttggaaaggacggagtggcagtctcgcgcatccgccatgcgggagagaggggccggtcccacgcatccaatatgcggagcgatccggttctgtattattcccctaatttttccaactcatctccttccttttccacacgcacgcttttcaaactactaaacggtgcattttaggggatccactagttgg

SEQ ID NO: 55887 - DNA, 4826 bp, Oryza sativa
gatgtcacagttaattgatcttgccattctgtgtgaaatttacatcatacaagttttcttttttaaacgtagcgttgatacaaatcatacaatgaaccatatgcagttaagactgttttcggtttatatgataagttcaatgtaccttattacggaattgcatctttcctagtgaccatgcatatagaactcatataataattaacataaactgtctacttttcgggctggcggaaaatcttgctgacaaatcaccatgggaagcttttcaaaatctcagaagaccctccatccaaaattctagtgcatgatttttcgccttttctggaacctaaacggcccccattgtttggtttattcgtagaatggtatatttacaaatgaaaagtaatttgtgaataaaacttttatgtacgtgttcttagcgatataaaagtaaaggctgaaaaataaattttgatgagaaaaaaatcgcaaagtttcaaatttaaagttgaaaatttaaattttggttgataaatataagtataaacgaaaagatgagaccgattatcttgtgcatgttagcgacaaatttaatgcttttaacacctacctactgtcagttttgatgcactccagatgtccggatgctgtctaccagatctaacacagttgattgacttgccattctgtgaaatttttacatcatagaagttgtctttaaatgtagcgttcataccatgaagcatgcagttaagactgtttacggtttatatgataacttcgatgtaccttattatagaattttcgcttatgcttatgcttatcagctaaaatttaaatttttaatcttaaatttgaagatgatttggggtattttcatcaaagtttgttttccagccttactttgagattgataagaacatgtatataaaagttttattcacaaattattttttatttgcaaatgtgccgttctccttattccacgaatatgtaaaacaatggggccgctaatctgttgtgcgttcgacttgcaaggaaataaacacaatacattagttgaggcaagaagcaaagaagggaacttgctcacaagacgtttcatttcattcacgttgggtcttccccccaccccccaaaaaaaatatatcagttcatttctgttgataaaatttggtcgaattttatatgcttcaatttttctcaatttaaataaactgataatatattaattgactgctaattatttatagaccaattgttgccatagtatttatacgtgtgatcctatgttttttaatgtttaagacacacggtcatgatataactacctttccaatgcttccttttgaagtaattaaactaatgaaaaacacttgacctatgtaaactaagcgctaaatgaaattacttttgcactcaatgttaacgacgccgcgcgggcctttatcctgatgattgtgagatgaataaaaaaagaagcttcaatgcgcgatttaaatacttttatttccgaatccgacggatccctccacacgcgcactagccagcccaatatatcatatcaattcgtttcacttggtcgagaaacaacagaagtcttccggctagcttcacaaagtagcgagctggacgatctggtttgaagtcttaccccttctaattatttaatattaggtcattcttttttttttcacttggtctctcatcgactctttgagatcgatctgtgggggatgaccgcagcgatcgagaagcacgtacgatcattccaggaatccaggtatacacacgctggtcggcaggtgctcgacataagcttagtcctctcacactgagaacgaagcaaaggattagcgtgagattaattattctctccatctcaaaatataagagcccagaatcaaataagatattttctagtactataatcattccaggtgagagggggtgcttcctttcccccacgcgtgcgtctcttactctccctcacgcatctcttcctctctcccagccagatatagccccgccgccgccagagctgaccggcgtctgcgcggcggctaggacggtggcagtggggaggtgggaggcggaggtgcggaagtggtggccagaggcagccgggcctgcgcctggccgtgtgggttagggatggctggaggtggtcgggagggcggtggggagcggcaaggcgtcagcgatggagtctctccggatagcggtaggggcggtgaagcacggcggtggcccagtggcggcggcagccctaggggcagtggtggcccagcggctcccgtcggcattggcaacccttggggcggcggcagttcccatcggcgctggcggcactaggagatgcggcggaggacggcggctcccgtcggcgccagtggccctaggggctgcggcggtccaagaggacgacggctcctaccggtgtcgacagccctaggggctgcggcggcctaggacagcggtagtctgagcactgtgaatccgatgaagtggaagccgatcccgtcggttcgtgtgtggttggctatttccggctaaacggcgaatgccgacagttgaaagtaggctaactggcggcgtgtggcgtcagcttacctgaaacagataaagatggcaccaacggaggtttgcatcgacggcgcactaggggcggcggcgactagacaacttccacttgtaatatctggccgtttcaggagaatatggcaggacgcagagaagcagggatgtcacgaggttgtttggttttctttttgttttttggttgtgtgttttcctctttgttgaggtgggagtgtaagtactcatgtatccttttagctgtgtatatccttcgtggatatagagaccggattaatgaaaatccattatctaaaaatgatcattccaggaatccagtacaccgtacacacattggtcggcagatgctcgacataggcttagtcctctcacacggagaacaaagcaaaggattaggagattaattctctccgtcccaaaatataagaatctagaatcagagaagatattttgcagtactatgaatctagatagataggaaatgtctcattcggttataagttattatattttgggacggatttagtaagtattagttaaacaaaacttaaaaaaatggattagtattattttttaaagcaactttcctatagacaaattttgtaaataacacaccgccgcctagtagtttgaaaaacgtgtacgcgaaaaactcagccatagacgcctctccgaagtgaagctgacgagatgaagaaaagcgactactcacctacaacggattataaaatgtaatgcttgttaacgataaaagaaatagataaaaacttttatatttgttctcttagtaacataaaagtaaatgctagaaaataaactacattaaaaacattaaaatcaatttgaaatttaaactcaaaatttaagaacatatattagagctcaaaattaatggagcagttatgtactccctccgtcctataaaaaccaaatctaatgtgacataagttggtactacgaatctggatatactccctccgtctcataaaaaataaatctaggaccagatgtgatacatcctactacgatgaatctagacatatccggtactaggttggttttctgtagaacagagagagtatatttgttcagattcgtagtagtaggatgcgtcacatccgattatagattcgttttttataggacggagtgactgagtgagcatttttcctgagtgagtatgtatgtattgtactgcacagtatatatcttgatctgatcagtgtgcagtggcctgttgaacaaagaaaagttgtcagctatcttaggactttattaccactagttgtatgaatatgatcagcgaagtgtagaagcacgtgtactttgtgttaatcacatttgtgcgtttcaacaaacaagaatccaagctgaagctggccggcataagtcgtcggtcaagtataccagaggtgtgatttccacagttacaaacgaaagcttctgttgctatcggatccggctacattggggacatcaacaatctctgtttggacccaaaaagaaacacacgcaagcgctccagaaaacgaaggataatgtcatcttcaagaattttcaagtcaaattatcaaaaatatgacattagaatcattaatttatcaggttttctaaaaatccttataataaaaattagtgatcaaagttagattttccaatatccaaaacgacgtgttttcataattagaacaaaagtaggtccatgattatgtaacaccagaattttcctgagctaaaatcgaaccgtgggcgaaaaaaccgaacacagcacactagagaaaaaaaaaatcaaactccaaaaaggagaacgatatgcatactaatttgttttacgaactttttacaaacacgtatgagtcatattgtggttggatcttaactttttataattttcaattaacttaatcaaacagttgagatttttgttagtaataaatttttagtatgttacacgggaggataacacgggtgattgaaatattattttttttacatgggacctagatgtgaaacgttactgaaccaaagaacgcgccttaagaagaaccaatattttttactaaaaatatattttctttattacctggttgatataccagatagaattcgttactgcaccacagtagtataagcctgtaacagaaattcactgtactaacgatagaaacaacctacacatcaaaaaaagctcacgagtacgaacggtacaataccgcaggagccgcataaaactgacatgttaa

SEQ ID NO: 55888 - DNA, 873 bp, Oryza sativa
tttgaactggcagcggctgcagcccaaccactgccagatgatgacgatgacctgatcgagtagatttgcaatgtgctactttacatcgtcttgcgaggagccctgtttttaagcacagttatatcctaagagatcttttttgcctcggagaaattttcgtggtgtccaaggttaaatatgggagttttgtcggatatttgaccagttcagacaagttttggttatcgttgattgatgctataaggttacttcgggttaacatatttgcgcttatagctgtcgtatgatcaatgtgtatgatccgctctcgatatttggaggaaggtctgcgtgatgcgttagttttgagcaaatatttatcttcctttgccttcgaagcaaatattttatcctgtaaattcgggcgtcgcttatttatgctgtatggatcgcgcttaatctctgaagtataatcaaattctacgtggatagacggcacgattactgctagtctgctactactaattctgttcgaaggagttaacctgatgagaaactaatttgggatttctttacaaccgcacgtgtttgatgagtttgggggattcccttgcaatataggcgggagatgatcgatatcgagtgagaggtgtgtggactctggacgggagcccaacttggcaaaaccttttgggctttcaaagctgctcgacgggccactgccatcctctacaagtgatgaagtgaacacgataagagagaaaaaaaacatgataaccccccttaattaagtctcaaaacgtttatgcaatgaagtgcgatacgggcttcagcgagcttctcctccaaacccaataaccttgatatcttcgataatgctatcccaataagtta

SEQ ID NO: 55889 - DNA, 7546 bp, Oryza sativa
cccaggttgatcctcatggccgccgcctccgcctcctccgccgccgccgctccaccaccggcttggttgggatcaagaagaagaagaagaagcccttgtcccttaccaacgcaagaacacgagaagaatcgatctcacgacgagtcgacgacgtccgactagtatataacgacgaatcggcgaggagacgggcgcggctcgatccgtcgagttcatcggcgagtcggattcgcgcccgcgtcgagtgcgtagatggaaacagattcgtgttcgagttcacggactagaactcgatcagggcacgacgaccgatcggtcgaggcggattcggcggcatcagcacagcatgaatccgagccgaggccaccccccgtctctcacatgttttttctttttttttccttcttttctttctgggccctaagcccaactagcagcgtgttgggccggtccaaaatttgttatgcacacaaaaaaaacttagggatacgtatgtacaaattttatagtgcaaactagcaaaattcccgtgcattgtaatggttattgtaatgggtgaagaaaattgtttcaatgagcatggtggctacgatagcgcaaatttcttgggagtatacattgtatattttgtaatattcatagtgtaggtggaattagagctaaaaatggttaagagcatgtccattcgataatcctctccagtctataataaaaatgtcatccgtatggtcaatatgataagcgtaacgttggggagagcagccaaccagccacgcctcgctctcgactcttgtggctcatgtagtaacggagctcgaagatcgggtcgcgggtcgatttacatggatgattataagaaaactattaataccactttaaaataaaattatttatcatagactaaagtttgaaaccatatatagtatttaattttatcatgtattattatgagtcggttgtaatgcatggttatttttttaattgatattaataaacagttttttcatatcgtaaagagtagccatagtagaagaaatgtttttcgctagctatcacagcaagctcactgcactcaaatagcagaatcgctttcactaaaaaaaatcagaagtaaattgtatgatgaatagaaaaaaaaggtgatcaggttaggtgtcctacgacaaatgagaaattgacgaggaaaacaatcttgatgcaaacacaattcgttttgttgatgattgtatttttctttaaaaaagaaaagcatgcttgttttattttttgaaaaagtaattcattttgtcggtgaatagcgtctacttttatctgatccctgtatgtgacctcctatttaagctttagtctataataaaaatgtcatctatgttgagtaaaccatttcgcatgcatgtataagaaccaacacgtgtatacagtatacgtgtagagtttgactggtcgtgtgatgtgtggacaatatatagcgtgcggactctaatataacatgtctcgtgaaaaaaatctattttttttcacaattattattctttatttcaaataaatattaaagtagaagtttaggctattttgatgccaacaataaaaagtcttaataaaagaaaatatttttgagcggaactgaatcccattgattagcacattctagatcacagtggcacttgacagtaattaattccagtctgaagctcctatttttttttttcaaaaaagaaacaaaaaagattgtactgttgtacattacgggacctatgtggtggttgagatccttatcctctcgctctcacggtctctctcccattttatccgtttacggggaatttaactatttgccactattagatttgttaattatttaaataacttcttatattttcgaagagagaacttctccactttttaccacttttgtatacttggtgcactaactaggctgccccgtcatcttcttcctcccgacgatgatgaaccggatggtgctctgcgttgacggtgggctctgtgtgcgggttcctgatgatgacgctcgtcggtgttgtgtaggtcaagctcgtctacatcggctgcggcgccggcaacgccaccgcgtggggcgccgtcgtgcctctctttacgctcgtgcccaccgccatgttgatctacatcagcattgtcttatacgccttcacccactagctcaaccaccggatcttcaacaagcacaccaatgctagtagtctatactaatataaaaaacatcagttgtttcttttctacatccacccagaaaagtgtacccagaagtttcctaaccattggatccctcgatctaacgtctcacattgtaagttggattagcacttggattaatagatagattggattagcgcacgccgtcccccacacccatgtcccaatctcccacggtccaggcaagttcgatattttttggggccactccttttccatcgcgctaactcccgtcggctccccatcgccgccgcggaacaatcgcatcgctaccgccgtctccaccgcaccctcgccctcaccgccggctcaaacctccgcctcgtcgcccgcttcgcccatcgccatcgcgccgccgcctctcccctccaccccctaaccctaaccgcacctcaaattgcgtgaatattgcccgtctcgctgcagaatgatcctcttgaacgttgtcgcccgccgtttcccgccgctgtctcccgccggagccgcccctgcttccctgctcgcgccgcgatgaacaggaaggagagctggggtcggctcacaccgccaccacctctccctacggtgagcatactgtcacttttagtttttcattcattcatcagattcatttttcatccatctcatttagtttctccatctatatcagtccatgttcagctggtcacattcaacattgacacaaacaccttaactgatcgacatagtaatatagtatggatcaagacagtgttattttcaggaaattggtatgtcgagaggtggttctctcacctgaccatgcagacatgcagtacacattgaatccttcctctaaattatacgctgtgtgattctgatctgttaactttatacaggtcaattattcctgacagcagttgcttgaatgcttcaaagacttctggatccaacctgaagcccttattgtttgaggtcaacaagttcagggaacaatgaagaatcgttaaatacttcttttcaaaaagaatagttaaatactaaaagcaggaaggtttcatgaaaggtttcaacgagaggggaaccatgaatgagctttggttgcttatatcagattgctccttctgacgtaaattttgttacagcctttccacaacgtattatgcagctatcaaatttgtagctataaattcgatgttgtattatatacaagtattgaaatgaggtatgccctcatcttgtttcttggggaggaatagaggcaaatggcaaagggcgaaaaattggccatcagtacgtcaaatatcattaatttgattcttttcataaggaaagttgttgcttcagttgaaagtttatgattggccgttatggcctccacactagactgcttgttggatcttttctataggtttttcatattctggtttactgcacatgctacgagaaaacccaataagtatagctatccatatgtttcttgacgaattcagccaatagtaataactcagtcttaactggataaaactatgttctcactcttgcatgataactatagggctaactgaataacctgaaattttcagggcataatagtatgttgcatgccggtaaccctaaagtagcaatgaagaaactcatatgttacatactacaaatcccaaattcacgaatacgacaactttgggtaactttgagaatttaatcaagaataagtaccgttaatgctatcctgtgtttgtcaacgacaattatatttctgaatattttttaacctctgagtatatatacaggttatgtaaaaccctctgctactctgcttttttaggatttatttgtggcttgttttccccattgcccacaaagatcctgatttcactgttgaaaaaccatggccctgtttagattctaactgttttcttcaaacttctaacttttccgtcacatcgaactttcttacacacacaaacctccaacttttccgtcacatcgtttcaattttgacgtggaactaaggctgtgtttagatccaaagtttggatccaaacttcagtccttttccatcacatcaacctgtcatacacacacaacttttcaatcacatcatcttcaatttcaaccaaaatccaaactttggatctaactaaacatagcctaaacacagcccatgttttccagccttacacctgcatgatctggctagaatggaaaaaaacgaaaaagggttaattggaatgataaattaacatggatctatgggcctcgttgacatcgggcctggtcacgcataacctcgctctccctgaccgttaaactgaccgttactctcgctcgcacccgcccttgcttctcgggcggatccggcggcctccagtctagtccagaccacgcctccctcctcgagttggaacgccgccgccgactcccctctctccaagccagcacgtggcagccggcgaggagggccacgggcggagcgaagcggcggcgacctcctcccctcccgcacgcatatccttcaccaaaacttttgcaaaatcaatgtaatttgaaaactatcacttggaaaatgtttcaaaaggtttcctatatgttttccaagcctcacattgcaagaaaaatgatatttttgaatgaaaatgcccttttggctctcttttgaagaaactagattcttagttttggccaaaatgagattgagaaggaatttgagaaatgtttcaaaacaaagttggtagagaagaaagtttgtaatgtttttggtattcaaacctatttcaaaaatcaaatatttcaaaagttgtttgaaaatcaaattcgaccaaaaacccctatagaccataaaaggtcacctcctagcacttgagtgagttttgttgcaaatcatcataatcttcaaatattatgggtggttagcaatatttaaaaactcacacatttcaaaaattgctccaaaaatcaagtttttattgaattttattgtgtgggttgccggcttgtgcaaggactgtgcacagccagcagggggcctggcggtctgaccggcgctatatgcgcggtctgaccgaccaggtacggcggtctgaccggccacatagggccggtctgaccggccgaggtgggcctaggcagcttttgtcctttttcttgtcctttttcttctcccttcttcccctacccgactccatctcctcccattcagttttttccttccccaactcgaaaactctctctctcacctcccctcaaaccctaactccttcctccaccaaatcccctcggtttgaccgtggatttctcttcggttacaccgtaagtgattctcctccgcttcctctctctattccatggattggtttgtgtttttgttgagtttttgatccatggcttggaaccctaggtgaagcacgaggtgttcttccatttgcaccaatagatggtagtttcttggtgtgattcatctcctccaaccggtaaatcactctccctcttgtgcattcactcaaatcgatctatttcaccctagggctatgggtagttgttccaatcttgatgaaataggttcaaccctttgatgttcatgttccaatcctgtgctatattgttctagcaaattttagactcaaatgtgtagatgtgaaaatttttggatgcttgaacttatgggaggaggtttgcccggagccacaggccttctgaccgtgggtcagccgccggtctgaccggccggcaaccgtcggtctgaccggccaccagtgggcggtctaacttggctgatgccgtcggtctgtccggccaccatgggtggtctgaccggcctgatgccgtcggtctgaccggccaccatgggtggtctgacttactggctgcggtctaaccacccctccactggatataggcaaattttcacctctccaaattgtttctagaattattgctaatatcctatcatcctttgctctttttacaatgatgcctccccgcacttgccatggtcgtcgtgcgcccactccggatcccgtgagtgagcctaaggaatcgagcggagaggattacgctcacaatgatgaagaggttgaggcaaatgttgagggggctagtgaggtggcaagtggagatgatgtcagtcgtagtggggaggatgaggatgaagaaagtgatgatatgcactttgatcccttcatccagtttgtggtgaacatgaggaatccagtacagtataccatcttgaggcatcatgatcagttcttgaggcttcgggacactccggatccccgttttcacaccgctttccagaagactgtgtatgagcaggtttatgcagggaaagcatttgcagagcataagtggatttcttggagagacatcaatgagactccagagtttgagagcttgcattatctcttcaagactgttggcattgaccggattgtgacccttaagcaagactacaatgaagaattgattcgacagttttatgctacagtgtgggtggctggagactatagtgagatgaagtggatgtctgacaccctctagtgttctatctctcggaggtagttccggcggctcctcaatattcgcttggattttggagatgatttgcatgaggagcacactcacaattcattctccatagactatctctctcagttctatgaagatggagcacggtacacacatgggaaggttgccggcttgaggactatccccagtgtggttaacatgattgtgagagccattatcctccctcgcattggcaacaatgatgacattaggggggtggcttggcacgtcatcgatgcaatcattcagggtcgtcagttcgacattgtgtctctcatgatgcgagagattgctatctccaaagggacattcactcagggaatgtattatgccccttacatcatgaggttgattcaagacaagcttggggctacttggcaaaatttgaagaagcacaagcagtacaagccctatcttcatcttggagctccccgtgctcctagggagctagctcaagctcagcacctcctcctcctcatgggtatgatccaaatgctttcttccatccatagtatgcttactttggaatgcaacccaatgaatacttctacccggtacttggggctattaataccctaagtgaaagcattcaacgcttgtctaccgggcatgaagcattgcatgaggatgttcgtggcttgcgcaccgatgttagagacttgaatgctttcgtgggaagattgcacactagagtgggtgcattggattctcgactacaaatgttggagagcacccaagcttttgtatatcatcgtcttcagctcgtcctccttctcctccataagaatga

SEQ ID NO: 55890 - DNA, 6132 bp, Oryza sativa
  unsure (1)..(6132): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacaaaagcttgggtgctctccaacacttggatgtgaaaagtgcttttctaaatggtgaaattgtcgaactcgtctttgttgaacaacctcccggttttgaagatcctaaaaatcctaaccatgtttataaactttcaaaagctctttatggtttaaaacaagctcctaaggcttggtatgaaagattgagagattctctttcatcaaaggatttcaaaattggaaaagttgacaccacccttttcacaaaaatcattggtgatgatttctttattgaaaaggattctaatatattcaaagcattcctctactattggcttgtggtacccaaaaggtgttaagtctaagtttgttggctattccaattcggattatactggtcgcaaagtggatagaaagagcacatccggtagctgccaaatgcctggctagatcccttgtgccatggtcatccaagaaacaaaacttcgtagccctctctaccgctgatgcggcatatgtcacggcgggtagtggttttgcccaatgcctttggatgaaacaaaccttgttagactatgacatatcctttaccaaaacctcactcctatgtgacaatgatagtgccataaagatagccaataacctggtccaacattctagaaccaagcatattgacattcgccatcacttcctaagagaccatgttgccaagtgtgacatagtcattagccacataagaaccgaggatcaactagccaacatctttaccaagcctcttgataaaacccgcttttgcaagttgaggaatgagttaaatgtcatagatttctctaatgtggcttgagatggtgcaccatggttgcttcttttgcattgtgtatatttgctcctatttgctcttatgctttagatttattgtcatttggttcttcattgcgaaaatagagcatatcacattacggggaggtttgcactcttgcatgtgcactacttccttttatatatgagcaaatcaactaaaagtgctagtagtgtttttaaaatgcccaagtcaacataagtcaaaacatttgcaagttaaatgtaatttgaaaactatctctgggaaaatgtttcaaaaggttccctatatgttttccaagcctcacattgcaagcaaaatgatttttgaatgaaaatgcctttttggccctcttttgaagaaactagattcttagttttggccaaaaagaaatttatccccaaattgagattgagaaggaatttgagaaaagtttcaaaacaaaattggtagagaggaggatttgaaatgtttttggtattcaaacctatttcaaaaaccaaatatttcaaaagttatttgaaaatcaaattcgcccaaaaacccctatagaccataaaaggtcacctcctagcagttatgtgagttttgttgcaaatcatcatagtcttcaaatattatggatggttagcaatatttaaactcatatattttaaaattgctccaaaaatcaaatttttattgaattttattgtgggggggttaccggcttatgcaagggctgtgcacagccggcagggggcctggcggtctgaccggtgctataagcgcggtttgaccggccaggtgcggcggtctgaccggccacatagggccggtctgaccggccggtaggtggtcccaggacttttgtcctttttcttctcccttcttcccctacccgactccatctcctcccattcagttttttccttccccaactcgaaaactctctctctctcacctcccctcaaaccctaactccttcctccaccaaatcccctcggtttgatcgcggatttctctccggttacaccgtaagtgattctcctctgcttcctctctctattccatggattgatttgtgtttttgttgagtttttgatccatggcatggaaccctaggtgaagcagttctttgatttacaccaaaagaggtagtttcttggtgtgattcatctccccaaccggtaaatcactctccctcttatgcattctctcaaatcgatctatttcaacctctagggttaagggtagtttcctcttttgttccaatcttgatgaaataggtccaaccctttgatattcatgttccaatcttgtgcaatattgctctagcaattttttagactcatttgtgtaattgtgaaattgttgtggatgcttaggccaatgtcagtagtggtctaactggagccaaccgacggtctgatcgcggccttgccgtcggtctaatcggccgatgcgcgcggtccgaccgccgcatgcacgtggtctgaccggacgttggccgttagtctgaccggcaggtgtaggcggtctgacgggactgatgccgtcagtctgaccggcctgcagtctacggtattggatgtgagcacaatttcacttcaatcaagtggcttctaaaattcttgtaatatcctttcatcctttgctctttgacagtgatgcctccccgcactcgccatggtcgtcgtgcgcccactccggatcccgtgagtgagcctgaggagtaaagcggagaggattatgctcaaagtgatgaagaggttgaggcaaatgttgaggggactagtgaggaggcaagtggagatgatgtcagtggtagtggggaggatgaggatgaagaaagtgatgatatgcacattaatccctccagtttgtggtgaacatgaggaatccagcgcagtataccatcttgaggcatcatgatcagttcttaaggcctcgggacatcccggatccccagtttcacaccgctttccagaagactgtttatgagcaggtttatgcagggaaagcatttgcagagcataagtggatttcttggagagacatcaatgagactccagagtttgagagcttgtatgatctcttcaagactgttggcattgaccggattgtgaccctcaagcaacactacaatgaagatttgatccggcagttctatgctacagtgtgggtggctggagactatagtgagatgaagtggatgtctgacaccctctagtgttctatctctcggaggcagtttcgacggctcctcaatattcgcttagattttggagatgatttgcatgaggagcacacttacaatccgctctccatagactatctctctcagttctatgaagatggagtgcggtacacacatgggaaggttgccggcttgaggactatccccagtgtggttaatagtattgtgagagctactatcctccctcgccttggcaacaatgatgacattaggggggtggcttggcacgtcatcgatgcaatcattcagggacgtcagttcgacattgtgtctctcatgatgcaagatattgctatcaccaaggggacattcactcagggaatctattatgccccttacatcatgaggttgattcaagacaagcttggggctgctgggtaaaatttgaagaagcaagcagtaaaagccccaccttcagcatggagctccccgtgctcctaggacggtgccttcttctcaccctggagctagctaaagctcagcacctcctcctcctcatgggtatgatccaaatgctttcttccatccacaatatgcttactttgaaatgcaacccaatgaatacttctacccggtacttggggctattaataccctaagtgaaagcattcaacgcttgtctaccgggcataaagcattgcatgaggatgttcgtggcttgtgcaccgatgttggagacttgaatgcttccgtgggaagattgcacactagagtgggtgcattggattctcgagtccaaatgttggagagcacccaagcttttgtatatcatcgccgccgtgatgctcctcatccttcatcttcggcacgtccttcttctcctccacaagaatgaagacatttttggtacttgatgctaaaagggggagaaaactgtccttaggtgtgctttatgtcttgtgggttgggactagtggtagtgaggttagtcacctcaaatctaataggttaagttgctttgggctatattttgtatgggtctgggctattactctatattgtgtgttctttatcgttttgttgaactctatgtcatttggtctattcgtggtcttgttagcctatgtttgtttgtgagcccttttaggatgatttgtgacttatgtgatttgaatggttaagtgatgtgaacttgtgcgatgatggatggtgtatgtgatattgatatatgtgaccatcttatgcttatggatgaatatttcttgaagttcacattgaaatattgcttatgtgtttgtgcttgttgaaatgtgaaattgaaatttgcattggctccatatttgttgtctatgattgatatgcacatgtttaggggagcttttgatttcctttgcaatatatgtccatatgttccttctttgtttatatatatttgttgtgtttgtcatcaattaccaaaaagggggagattgaagcatctaggcccccgttgttaattttggtaattaatgacaaacgctaattgtggactaactgttgctattgagatatattttaagttaggaccatgtcatgtatgcgcatggatgactatcaatggattaaaatttgatggcgcgaagcgaaaaaaagaaaacggtaaaactagtgctttagttttaaaattgatcgaggtgaagggcgatcaaatttgctagtttattttttagtttcgccgtactatcaagggggtaatgacctagcaatgagatgattttaattgccacattaggtcattatgcatttagacttgtgctcacattttatctcacacacacaatcactttgtatttcactgggttcggcctgaccaggggcggtcagaccggccgctgtctaaccacatagtggcggtctgaccggcgtgccccggccggtctgactggccacaaaacggtggtctgaccggcgcataaggccggtctgaccggcggcacatgcgcgatcagaccggccccttggaggccgggatggtgctgctcggggtggccgatacagagccgacggagccgtattcggtcagaccgagctgatggcggtctgaccgagccgaggccggtctgacccgccactcaacgtcggtctgaccggtcaggcctatggggccctctgacagagttacaatggctagttttctagccgttgcagagtagcacggtctgactgcccacatacctccggtcagaccggcagagcacagaggtgggggatttcgccctccatcagcaagggggctctcttggcacccaattcaattgcatacaccccttgcacctctctcacacccacttgagctttgtgttcatccatctagtgtgttagagggttaattagccaagagtcaagtgcattgcttccatttgtagagctagtgtggcacttgattgatcatctccacgccgggtcattgcttgttactcttggaggttgccgcctcctagatggcttgtggagaagttgcccagtgacctctccgagaagattgtggaggagggccggcgctggttgtgagtggtttggagttcaccaccttcggagtgaaggaagaactaccctagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctccttgtctcatttacttgttgcatctacatttgtgcaatttacatttctagagacatactagagatcatttcaccctaggattgctaaacattgacataggagtgtga

SEQ ID NO: 55891 - DNA, 1175 bp, Oryza sativa
cctatgtcaatgtttagtaatcctagggtgatatgatctcaagtatgtctctaggaatgtaaattgcataaatgtaaatgtgacaatcaaatgaaacaagaagacaagagatttttcaccgaggtttggaaactcggcggtttcctactccctgttgaggcgagcccaactccaccgctcaaccacgaagccaccgcacgcccccttcgttaaggggtgggcaaggcggaaccggcccccggagaggactacccaaacctcgatcactcggggtagtttttccttcactccgaaggtggtgaactccaaaccactcacaaaccggcaccgggcctcctccacaatcttctcggagaggtcaccgggcaactcctccacaagccttctaggaggcggcaccctctaagagtaaaaagcaatgacgcggcgtagagatgatcaatcaagtgctacactagctctacaatggaagcaaatgcacttgactcttggctagaacaacctcaaccagtacaatggatgaacactaagctcaaaggtgtgtgagagcaaggggtgtatgcaattgaattaggagccaagagagaccccttgctgctggagggggagtatttatactcctaccaaccaaaactagccgttgggggcgaaatcccccaactctgtgctctgccggtccgaccggaggtatgtggacggtcagaccgtgctactctgcaacggctagaaaactagccgttgtagccctgtcagagggccccatcagcttggccggtcagaccgacgttgagtggccggtcagaccggcctcggctcggtcagaccgccatcagctcggtctgaccgaatacagctccgtcggctctgtatcggccaccccgagcagcaccatctcggccactagagggccggtcagaccggccttatgcgccgttcagaccgccgtcttgtggccggccagaccggccagggcacgccagtcagaccgccactatgtggtcggtctgaccgcccctggtcaggccgaacaagtgaaatacaaggtgattgtgtgtgtgagatgaaatgtgagcacaagtctaaatgcataatgatctaatgtggcaattaatctccattgctaggtcattacccccttgatagtacggcgaaactaaaaaaaactagcaaatttg

SEQ ID NO: 55892 - DNA, 717 bp, Oryza sativa
tgacataaccgtagcatgtaacagatgtggctatttatattattattgctacagataatgcatttaaagataatggctacagtaatatacaacagattttttttgttgcgataaaattcttaatcatgaatcaagatatatagactcattaatgttatagttacacatcaaaatatgttaaaaatatatttcctgtttgtagggatacctaggctagatattgagtttagcatgacaaccagtggcgtagctaggattttagattagggtggtccaacttaacataaattttctaaacactacaataggattatgcattgttttaatttatcaatccaattctaatcggaatttctaaaatcgaaccgaaactgacatagtgacatagctgcttgctgaacgctgctctcgatcctagtcgccagacgccgattgcccccgttggacacgggtccccaatcccaatcgttgagtcgtcgagttacgaaagaagcactcgcacgatcaatggtgtagtcaggatgggaactgggaaggacggaagctgaaacaacaactcgataaggcaaatcaactaatgaaacaaaagcatcgttcttttctacgtttgcatcagaacaggggtaataggcatttgggctagattttactgtgttccatggcccacacggaccaccatgtggctccgcccctgtaccacaggggccagggcacaac

SEQ ID NO: 55893 - DNA, 1897 bp, Oryza sativa
atatatacatatatttgacatatccccgtatgcgtgtttttcaaaaaatgtcgtactccccgtatctgggtaacatagactgtaaccatccaacctcgttgttgccttggcatgccaaataagaaatccaatataaaacccaaagcaccgagtagggaacaaaggagatcttcgatggaatagtttgccagtcaacttcaacctaagatgtacctgccagaccgcacgaaggcggcgactaaatgtgttacacatctcaggggacttgactgaaagtgctaaattccacgatcatcgcaattgctcaaaactcttactcgtgatcagctagcctcaggaagttgctagcttcacactttcatcttagctagaccaccaaaacacaaaggcctaagttaaacttaggaacaattaaagacatagaactaaatcataaatataaggccgaccagccaatagtagaagtttagcagaaagcttgtctacccttccacacaagcaaaccgactaggggtaggcccctagttagaatcatgctgaaaccctcaacctaagcaacaaaataatcaacaagcaagagtcggtacattatataaataatgtattggcaaagccacgatcaaacctatgcaagctctaaatcaaaggagggctatttgtggtttcattttcagcacaaagcaaattttgtttcataaacattttgcaacggaacttataacacaagttaaagcatgtacatgatataaaacattgtgatccacgtaagtaatttcaacaatataaatatcatatccacacttgcaccatcatgccatcataatcatcataagtatcataaactcccaatcccatggcctatttcacacatttaaaagaacaaaactatacttatggcgcacacactatgccgctcatgaccatgagcatggctaatcgattattttagactctcaagagtttgtaaaaaaccacatgatgtgaatcgctctaatttatctggtacccgtcggtatcaccacaccttgcctattgaatgcggcctagaggtcacaatgagggcattacatttcccaccagcacagatcctggtcttcacctgcggcatgacggattcgcaaccagttagtgccccagatcaagccgccatcatacttgcacagctcagctgccactgggcgagggatcggcagatctgcagagccatcattttcatcttctagtgaagtcatccctccaaggtgttagaaccctagctcacgattcacacaagcacacaagaacaagatgatacgaggaactcgattgatagatttctctctcgcgtccaaccggaccgagccaccgtcgccaacgccgccgccgagttccaagccaagttattacaactgttgttttgcgtatttataggatgttctctcctcaccaactctctctctctctctctctctctctctctcttacatggccaagatgggccgatacacagagatggttcatacagcccagtcaggtcccatgtacttcttgttccttcgccggatgcgttttccccttggtaaggcgtcttcctccaactcgccttcagactatacgtcgtcagccttgttgtcgtcttccccttcaggtccttccttctcttgggacttccagctggtacttccttgagctctaacacaaggtgagctggacaacaagctgaaactctgatccattgttgttgcggcggcacagtagtatcccagcgttcctgctcccgtggatgttgatgacgacgccatgagagcaagcggggagcctcctgagatcagccgcagcggcgccagcagctgctgcagggtggttgtagcggtagacgaacagctcttcgcagagaaagcaatgtatggccttgggg

SEQ ID NO: 55894 - DNA, 5194 bp, Oryza sativa
aaactttttttaatcttgccgtgtactgtagtaggaagagaaggaagggaggaggaaagggagatccgagtgtataggggaaggttgggaattgggatcggacgatttcttagagcaagtttaataagagagccaactatgagcttatagcttatattagagttaacatgtatagtaaatgggctataaggttatctcttttttttcttctcctctctctatctctcacctatgtatttaatgtatctatcttaaagtatgtgaatagctagctcttgcatgaaagccaatcctctccatttttcaaattctctttcctccacataagcttatagttggcttatagcctactattatacttttttttgaaactaaaccggcaggagaactgccaattatattttcaataagcaggagtaaaaaccctagacgggttacaagaaaagaaaaaacaaccaccggctggctgaacagctgcacagcacacgccagaactcactagcaactgaaaccattgacggagcccaacatagaacgtcgttaccaagcttgaccaagacaacaaaggggttccgaccttgcaaccgtgtcatcgttgccgagcttgtcgcctagcgacacagcagctccgacttcaaattggttgcatcatccatacctaactcgctgtcaatggtcaagtggcttcaacttcccacgaagaacttcagccaaagccatctaaacgccacatcctatccacggccaacagcaaaacccctagaaagagaatgcaacatgtcatcgttgcctagcttcgtcaccctacaaagcagctccgacttcacctagcaaacacaaacaaggagcgaaggtcgcccgccgcaaaacaaaaagtgggactagacagtgaaggcctcgtcaaaaccaagtactgaaaagcttcgaagccaatgcatagaccattaatgacatccttgcatgaaaaagtttctccaaagcggtgcctccaaggaggacacgacgtggatcgccgccaccgctcgtccggaagccagagccaggttttcacccggagaacggtagggaaaggagagagatcaacgccaaaatgacgcctccaaggaggtgaatgacgccaaaaggcgccgccgtcgacagccggccaattgcacagcgaggctttcgccagcgatttcccgtccaaacccacacaaccagtccgcgcaagatgatcgtcgccggtcggctacatcgtccctttagcaatcagtcctaggctaccgcccgcagctccggcagactcgccagaccagccgcagcactggccctcctgccgcggccacccacgcctcctgctgccctctaaccgccgcccttgtcgacgcgtcgtccactgccgaggagccaccggaggggatccggcctccctcgccggagaggccagatccggactgggggtgccggtgccgaactagggggaaccatagccggcggcgccgtgtgcagctaggcccatgcctctcccaccgttagcgccgcccccgccgtcccgtcgccgccgccgccgcctcctctgccccgccaccccggagccggcctccttcgctgcgggcgttggatccggcctggagggagccagatccggcggcggccaggctctctgcctcgtccccgccgccagcgacgtcgcctcctccgcccgcgccgcgactgccgcagccggcggccttctctgccggcacctcgctaatgcggcgtggccgacgccgcttcgtctcgatctggccgcgggggggccagatccgctaacggcgacgccggcactactacctctggccgtcggcgtcgccggagccgcctcaacgcgtcgccgcccctccgcctgtttcccgtcggggccccaaccaccgggtgttggagggggtagaatgccccgccgccaccgtccttgccgctgcccggctttgccggcggctgctcaggcggcggcgaggtgggggaggcgagggagagaaggccggcggcggggcggcttcaggtcgcctcctgtgtcaccctggagcggagcgacacgggggtcctctctcaaagagagactattatacttgctcttagggtttgccaaggtaggcgcttcgagtggtgaaaggaattgaattttaaatatatattgtttatttatttattttttttcccagaaaaatccgggatgtaattttttggcataaatatatcatcgtcgctgagtgggagttgcacaatgatggttgcgcaggagctgctcgaggaccgtgctgaggaatctctatgtaaaaagaatcgatgttgctaataagctgcaagtttacttgtaactttgtttatgatacccttaattttttttatttaacaaaatgaagtgtgcatttgcttgcaggctaaaatatggccttcttcgccaataccgatgggtggagtggcaattagcttcaatatctgatttgagatctcacatggcaatataatagatgtgctttgtgctatattttgggtttgagacatggtgatagatgtgctgacgtgctgtgagtgtgaggtatattttgggttcaatatctgagttgagacatagcaatagaggtgtttctgtggtatatatttgggttgcaatgttttagggccattgtaacggtatatttggaaaaaaaataatttgtgaataaaatttttatatacacgttcttagcaatctaaaggctaaaaaataaactatgataaaaaccaaatcaactttaaatttaaagttgaaaattcaaattttagcttattagcgtataagcgaaaagatgagaccgtttgatagctgctaggttgcatctgtagcctattgttttgggttgtgttattctaacactgtcaatcttaggttgaaatgtttgatatatactcactcgatcttgacattggaatgaaatatgcgactccactgcatcttctttgtgagctattcaatgcatcaaatttataattgtgttttacattgctcgtacacgatatctcaattttgtgttttttttaatgtttgtacatatgtctaaaactcttcccccgtccttaaaaaaaaaacctagagaaagatgagacataacataaaacaatgaatctaaaccagattcgttccgtccttgcctagtttagcttagggaatatttttttcaaaagatccttgaaataaataataaggttttagcattttctgtacttttcagtgtcggcgctgtgaaatgtaagggtaaaaagtctaaaaagtaggttagttgtacacatgctccagtagtctttccggtgaaatttggcatgttatcttactgtttatcgtcgctgtgctgacatctgtaagtaagttcatgaagacatgacaagcacttccataactgtcacattatgaggaaattggggactatgagacgatcgttaaagatttagtggctgcttgcaaacagggactcactgagcactgaaaataaactgttgcatgatctgaatagaacaggtccatcacaccagatggccattaggatacacaagaaaaacgcagctgatgcagtcatcttttattcgatgatgctccgaaggaaatgcacaggtcaagcctcgatgagttttttgtttggacaaaatccctaaggaaaaaactaccacctgcttgatggccaaatgtgtgcattcataaacaaggacgccgtagagcagtctggtgctaaaaaggtttaaatgaaatcatctgcctcatcaaattcttattatcagaaccacgaggcatgggcgtccttagtggtgatgctcgtcgtcatcatcatgtccatctggatcaccaccatcaccaatgaccttaagctgcaaaaggcgagcaacaaagatccattaaagaacaatagaacattacagaatcaaaacagcttggaactgtgagctacattcaataaaaacagttactaaatacataaattaaagtaatatgtcaaacaacgaattccaattaccacaaaatattgtgaacagactgggcactcatgcggttcatcttttttcaaccagaaccatacaacatcatgctcatcctctgtaaatgaaagaagtgaaaaaatgttgataccagtattgcataatatttggcagtttagagttttcgctgagccaagtcaacactgactgacctccttcaccaccaggacaaccaactatcctcttgttatagtaggattcaatgacagctggggcctcctgcaggtaacaccatagcaaattgatgaataacatgacatggtgctcaaatgatgctgcaagataataaatgaagagactaatgtgccatggttcagatccagcatcatccttacagccaatttaaaagaatagctccaaagttgaaatttcatcattttaaagcaatcgcaaatcacaatcagtgcaaatcatccccctcaggccctcactctaaaccacccatgtttaatcaacaagacatcaacatggataggctaccccccaacccacacacacacaaacaaaaaggtgtaacatgctgcaacagattcaaaagacttaatcgtagcagaagtagaagtacaggaaaggtcatggtgagccaggacaggctaaaatcagcagggaatacttgggattgtgcaatctatcgccacctcttgcagcaccctgctgcccattgtggctgtgtttgcagaggtcaaaggaccatgttcacacacagcgtcaaggtaattaaggaaaggacttaaggcttgatgtacaggcaagaaagaaaccgtcaataagaataaatcaaggtcccgcctctaatgttcttcattactctcctgtctcctctgcatctgtatctcaacaaaaagaaatccaggttctcatcggcaataattttctcactaccatattctacgtcttagaattgaaaaaaaaaataattttcagttgcacttccattgcacgctgctaaaccagagtctctgtcatcatggcttgcctcctgactcctacatttgggatgtggagcgtggcaggtgatcaggattgggcatgatgcaggtggctactactttgtacacagaagagattgagtaactgataggatataaactgggctggattgattgaagcggtggactggtattgctagctgaagggcataaaacaaagttgctaagagttgagtagt

SEQ ID NO: 55895 - DNA, 1191 bp, Oryza sativa
tatgttaaagactggctacaggaagaggaaaatcatccaaagaacaggtgggtgtggtgagggcacagcagcggatgtatgctggttcttgttgagccacttcacacattagtgtgtcgttatttttttctggtatacatcaagaggtaagcgaaacacctttgcaggaacagaagggcacagttcaccacctagtggttaccctaataaatttggcacgaacactaatgttcttgggatagtaaaaaaaaatttaaaaaaaagatctcaccactcttagaacagaatagtcaatcagatgatttgcagttaggtgatgtacaaagacattctacaacaggtcaccaaatatccctgctgacatcaagaggtaagcgaaacacctttgcaggaacacaagggcacagttcaccacctagcggttaccgtaataacctactaaatttggcacgaacactaatgtttttgggatagtccaaatttaaaaaaaaaacgatctcaccactcttagaacagaataatcaatcaggtgatttgcagttaggtgatgtacaaagacattctacaacaggtcaccaaatacccctgcttcaaaaacaggttttcatagttcctattcaatctgagacatagattgccaacttaacaaaaaatctaagtatcaggactaaaagtccttgcattgcatagctcaagcatttaaccacagtaagtttgtagtccactaccatatcacaaatgcaacaacaaaatgaagttaacatactctcaccgccaaacaatacttataaacagttcccagttacaggtaccggtttgctagatagctatagaaaaacagattaatgcaacattcccaagataatgttcaccattcagtctctaatttcgacttcgacaattgtttcaacacaaaaaaaatgcatattaaacttgatatttctcagcaactaatgtttatttaggtgttccagctagtcaaaagaatgtaacttaatggcatatccaaaaaacagtttcaatgaagaaaaggcaccccaccaatatgcatattaatcaataggattgggtcagccatattagtttatatgaaaggagcgctgcgtttctgatcaaataagatagcacacactgtgtaaacattattgtgtatcctgcaccaactactcatagaagtttggagaaagcata

SEQ ID NO: 55896 - DNA, 720 bp, Oryza sativa
gttgaacctggccctgcacgcattgctgaagagatcaccgatggatggcacgtgcgagccatcagccatgcgtgcatggctggctgagcgacaggtaacctacggggaatgaaacttttttccgatgaatagtgtggctactatcctctttagtcagtgccggaatcctattcctatccgatccgagcgtcgagcgatggatcgagccgtgtttttgtcatgttggtaaagaggggtgcttgtgcgtgtacgggcacgggctggacccggcctgactttcaagtttgtgagacacttcatccgtagggaaaaccccatcaggccttgttcgtttaattcctcccataaaaaaattaagagggatttgaagccttggaggagatttatttcacataatatattatgatgtagaattattcccctctcttgagaattaaaggacaaaatctcaggaatattggtgtcttgatggccacccgtcataataaaggccccattcctaacactccattcatgtcggtttccgtgaggatcggtttcagacgtcaggagaagactgctttctggtgcgcatgatccctcaaggtggatcaaccgtacatgtgttgcttgtgtatttgtgtatggtacggtcatatattctaagctatatgagcgtaagactatgaacaatatataggcttttcattcggtctccttgatttgaaaaaacgggatccc

SEQ ID NO: 55897 - DNA, 767 bp, Oryza sativa
ttcatatataagttataaacccaagagtgagcgatctagctggcatacatgcatgcatattagtactagtaagtattaattaattagtacctgtgatacagccaaatcatccatgaaacgtgacacctctccaaaggccctgccagcatcagcgtaagacaaggcccaatcaaaggcatccttggtagctatgtcacccatgcctacgattatactgacaggtaattctatagcacctccggttacgagggacacggtcgcatgctctgtaaagcttggaatgtatttttgatggaaccactcagcttcctggaggtaattgttggataatatttgaaactgcatgtggcaaaaaaaacagagtataattaagataaatacatatttttgaagatgtatgtattaattcttaaagttgctagttcagatttttatacgtaggagttgattgaaaaaacaatttcttttttgtccatttctgttatggacgattatctatttatccatttctaaattataagctgtacataactttgttgaaaagttgtatacgacgcttcgtaccgctttaatgttgtaagcattacgatatttctcatgtggttccaactcatcttcaaagtccctaaagttgctcataatactgagaaagaacctcttcagcccctccggtacaagtgaaacagcattcttatcccatctgcattgtcaatttgagaaaatatgagaaaaccatgatgattttatcaaaacgggggatccactag

SEQ ID NO: 55898 - DNA, 1039 bp, Oryza sativa
aacagcagaatgccatcaagataagaagtcttctcacaaatttagtagtactaaagttgtataaaatgcatggcatatgatgctcaaatccagcattcatgcatattatgagtcaaagctaaactgaattctctccataagcatatatcagcatcgtgtgcatcacaaattgttatagaacacaagaactaaacaaagaactatatatatctttctaattcacccactaaggcactatcaacaaaatccaggattcacataaagtgtcatgagaatacaatagttaaatacaggattggaaaggatcaactaaaatcacagaaatagtctcacacaatagtaaaattctaacagtgcttatattcctcatacaaattacaatgtactaggctaggcatagcaaagaatgacaaaatggctgaagatcctaaataactaatgagacaaacttcaaattcaatcgatgtaataatacttactagtaaccatccctgagtccaccaaatttctcctgaccagctgtatcccagcagtagaagcggatcttgccgcagttagtgaagaaatccaaggggtggacctccacaccgatagtagctgcagcaaccacagtcaaattaacacgaaaaacacaatgatccaccataagaatacatgataatgcaaaataggagcagatactcacgctcatacttcttctcgaactcgccagtcaaatgcctcttcacaaaggtggttttgcctgcaaatcaaaaagattgcctggtttcagaacagacagaaattttcgagcctggcaatttcgagcacaggaaacaagaaatttttaatcctataaattttcgaaaataaaaaccagagagttcacattcatccgtgacaaatcaaatctaacacagtcctcccttccccaccatccccttcccgagtcccaatgctatgtactcgaagaggagcgagtctgccagattaatcggtgccagatcaaaactataataacacagccttatttctctatctctaactataataacgatct

SEQ ID NO: 55899 - DNA, 2883 bp, Oryza sativa
acctcatttactcacgtgattactcttgttctgcaccctcgctccctagcccgaacttacatggagaggagaggagggtctatcgattccgtgctcgaggtgatctttctgcgacaaattccattatctatccactttgcctataaccctggcgatggaagcgccggtgttgtcgacctcccatggtctgtcaccatggaggccatatccaagtgatccgagtcatcttcatcatggtggtggctagcttagctactgctactgaagaggagaacgtctaaagaaatggggatcatgattaggggtattttaatccataaaaatatacggtagaaaagacgattcaaagcatatctcatacgtataatgtgacgtggatctaattttagatttgtcacggtggtacggttttaattatgtgaatagcatagattttaaaagttatatgacatatctattttttttattaaaaagatcagccgtcctgtccatgtgagcaacaaaaaaaaaaaaaaacttcagcgcaaaggatgaacggccgagatttgacttgggctaaaccccagtagaaacacccccattttattgcttctctctttgctccgctaccgttttccctttcccggtgaccgccgccgtcgcggcgccaccccctcacccatggcgagcttgccggaggcacccgtaccaccggagagcgcacgcatgggttcacccccgccatcccattccccttctcctcctcctctccaaggagacccctccctaccaaccgacgctcctccaccggagccatccccccaaccccaccatgccaccccgatcccgccgccgtctccaggtcaggccaccgaggggtggcccagggcggaagaaccgcaacctccgatcggtgggacccccggtgcggcgggcccgccggcgccgccttcgttcttcccctcgctggagctgggtacctcggcggcgccacctgcgctcgaagccgcggcggcgggggcggggcagcccggctccccttcgccgtgtcctcccgctgagccggcggccgagttctaccccgggtcggcggcgtcatccccttcttcctcctcgtacgaaaccgcggaggatgactcgccggcgtcgccgccgcccactcctccgccactggtcttatgcgcctcgccggattcatcctacaccgagtcctcccctacgcgcgatcgcttcggcgacgaggagggctcgcacgccgcgcccgagccgccgccgccgccgacgccattggagggcgggccagatgcatcctccgccgagcccgcggcaatggcgtcccgtgcgcgcgaacccatgggctcgcgcaccgcacctgaaccgccgacgccgccattggagagcgggcaggaggggtttcagcagcagcagccgcatccaccgcctacaactcatccggagtgtgatagctcggagcctgcggagctgccgcttcctcccactagtccggctgaaatcgcatacacatcgccagattcagtcgaggtcgatgtagtagcggtgtcgccagaggaagctcctggttcaacggttgcaatggaggtaatgtacggggagactgatacctcagctgtcagtgtgtctccggtattggggagtgcggagacagatgcagccgagatcgatgtaatagcagggatgcaagaagaagctcctggttcaacggttgcaatggaggttatgtacagggagaatgataccgcagcagtcagcgtgtctccggtattggagagtagggaaccagatgtggccgagggcgatgtagtatcaggtgtgcaagaagctcatggttcaaagttttccatggaagtaatgtacagggaaactgatgccgcagcagtcagtgtgtctcctgtattggagagtggggaaccagataaagccgagaacgatgcagtagaagagatgcaagaagaagctcatggttcaaggtttgccatggaggcaacgtacggggagcctgatgcctcagcagttagtgtgtctccagtattggagagtgtggagccagatgtaactgagattgatgtagtatcagagatacaagaagaagctcctggttcagcgcttgccatgttggtaacttacggggagactgatacctcagcagtcagtgtatctccagtactggagagtggggagccagatgcagcccagattgatgtagtagcagggatgcaagaagaagctcctggttcaaagcttgccatggaggtaatgtacggggagactggtaccgcagcagtcagtgtgcctctggtattggagagtagggaagaggggtcacttcaagaatcaatgcagagaccatcttctcccacaatgaacattgagcaagagtcaatgcagagaccattttctcccacaattggcactgagacaagttcgccagagatggctcctgctggatctgagaactgtaaagtatcatggttgccgttgccccctcctacaccacttggcgaatcaatgccctccttgccagtcgcagctgcccccaaggttttattggtgatgccggaggaagcggttgagtcagtcccttcatcggaagctctggatgttgaaaaacctgcctccatcacacaggctgagcccagctcacctaatacgccaccgccaggatttgagaattttaagtcgtcatggttgccgctacccacgactcctcccccagttgaaaccactgatgtcttgccagatgtggtggttaccaaggcagtggaagcacccattgaggaagtgtctaggccattgccagctttggaggtgacaaacatggagtcagacactgtcctcagtatcttgcccacaacagtcttgccaacaggggatccactagtggag

SEQ ID NO: 55900 - DNA, 891 bp, Oryza sativa
gcccctgctaccatctccatctttggcacaaaccacaaatgtgcgacaagatcaatcggtaactgaacctgtgtctgtgatagaggaagcccctcagctactgcactcagtggaggtaatgggtgtacatatggatgcagtacctccattgctaccatcatctgaaagtggagcagatgggctatctccgcagcaattcgcgcaacctcctcctgcagaaaaggatacaacaacctgtttgccagatatggtgcattcaggatgtgacaattcagagccctctcagcttctgtcactgcctgctgttatttctccagttcagaccccagatggcttggctgatgttcctgccattgacagggttgcagtggcattggaagaatcgcctcagcgaccgcttgtatcaggggaaatggaagctggcacagtgcccattcggtcatcaccactgaagaatatttctgaggggtcactgccacaactagaatcagagtcacattctcctacatcacaggctgcagatagcttactagatgcatctgactcaaagtctgtggctgtggcctcagaggagatgtctcagctaccacttgcatcgcaggcaactactacagaccttgtcagtacaactgcaatgcagccacaatctgagggtatagtggatgagtcattgcagcctcagcatccaccctcttctaccgcacatgattcaccttgtttacaggactctgtgccattggtgccaccaccaccttccccttacctaaataaaggttagtatattgcatctcacttcctctaattccatgtctatataactgctattgtttgtgttgacttagtatttgtgatgagtttgggggtgtttggaaggtaaaaatgagtcagtgt

SEQ ID NO: 55901 - DNA, 3631 bp, Oryza sativa
ggggctagtatataagtaatccggtgtaattctctctctctctctctgagcataagtaacctctgttgctaacttgtacagaagtaggtcaaatggtatgtggaagctgccgtattcttcttgcttattttagaggtgctggttatgttcactgtacttgttgccagacaatgaactatgtattggaaggtgcgtactatttctcatttgcccaacagtgttttacttttgttatgccccatataatttttattttgtctttcaacacctatagatatcagccatcttgtatcttacttctgtggaaatacttactgaatactgaacatgctttttctcaaaaatttgccttctgctactgtctaaattatgtgtaagaagtatggttggttacatatttcaacattggaccactcaatagagaactggagaattttgcccttgcctttataatactatttgttcatgcacaccctctaaagctttttcatgcaacacttctgcaaaatatggatgccatttgcgcaaaatttatctcgtctttgtctttccttttgaagcacggctgtccttaatatttccatgtattatagcttttaccaaatactgatgtaccgatgtgtgtatatatgcatcttcttacccttgcatgggttttccccctatgtttgttgcagctcatgaagttggtaaggtgcattgtggacactgtgcgacattattgatgtatccttttggtgcgcctgctgttaagtgctcgttgtgcctctttgtcactgaaattggagtaagtgaactatggcttgtgataaatttacttgctatatgtgcttatttgtgataaatatgttgaaaaagaaggtaatgctacattgaaaaaaagagagagagaactgattatgtactgtgcatgttggtcgagttggtttactttctaatgaatatgactgccttagattctagatttcccatgcatccggttggctatatgagctaaatcactaatcctgacaggcattatttgctatgtaagcatgttgtactgagacctattgtttatcaaatattaaggtgatactacataaacttcaatatttgctctaaaaggctagaaatccccatattaatcagatagagggagggaggttaaccagatagatatatggtagatggaaaggagggatctgaagtctgaagcatgttctgagcatgactcaatatgctcctttaataaaatgtcgtggctcaggtgcttcatatataatagacatggtttgctttatctgaatcccagtcaacacatgaagcttttatcttcctccttgtctcagataatcatgccgtgcactatgatagatctgaagcactacgaactgtctttgactgtgactccactttgatgccttcagctttggttgcctgcaatcctttgctgttcccacgctttcattcagtagatttcttgatacttagactgtcgttgcagtgcataattgttcagctatttgccaatacattgatctccttcaattctttgttccttttgttccaggagcggaatgttcgccgtcggttatcaatcgagcaacccacaagaactaactcatcagggctagctgaagcctgatcagttctggtcccatgtacccatcggattccaagaaagcttcaaatgctaatgtggatgaaaggaacagaatgttcgcccttcgtcatgaggtgtgggcatgaaagttcaagatggtatggacaagccaaagtgtacaaagatagcgttttttttttcattgatgtagacaggaaaggtgaccttgttagtacgactagatctcctttgaaagggaaaataaaagaaaaatagttcgattcaatctggaggtgatatgcgtatgtcatatgaatgataacagagtagttttcagatggttctttcgcggtgaccatcatgttgccccctgacgtgttgaggcttgagaattagccatgctgctaatcgtgctttaggccatcattgctgtagacacttttgcagggattgctcagacttagtttcagagtccggtctgtggtatgggcaagaattgagctgcgaaattttttttgaaaacatctggaaatatactcaatgtggataatggaaagtttcagcttaaccaaagctctctctagaacaatttgatattttatttgattcctgcaaatgggcacaaccctcagtttctgacttgatattaaggtaaaatctcatctaaacagtaattttgtcctcggttaagctttttttagtttagcataaaacaaagtagtttatcgcatactctagctaaacgcgaaaaccatgcgagcataattaattgagttttaattatttcaaacttaagaaaatagatttatatgatattttaaagcaacctccatcagtttagcagcttgaaaaacttgctaacacaaaccaagataaaatcggtaatcagagaattagattgagaagactatggctcctcagttctcaacatgtgggccgaattctttactgtgcctaactaaatgggccgattgcgcaatcggctaaggaaaacgaaggctcacgtctcgtcccgacgacgtgcggccgggaagcgagcgagcgagcggagaccccctctcggctcgcccatggagttcggcagcggcggacgcgacgcccgcgcgcggcggcagctgcaggcggccgggcgcgccgcggcgtacctcggcggcggcttcctcctcctctccgccgcgtcctccgccgccgtccgctccctccgctccctctccgacgccaaccaggtaccacactacaacacacccaaacccttgtcgctcagtttgccgcctccgcctccgccgccgtcgctgccctgacctgaactgggctgcgctgctgttgcgcgcagaggaaattcgcggcgccgtgtggcgcctgcgaggggaaggggacctacgcgtgcaggctctgcaggggcagctcgacgatcgagtggtctccgctccacgacccggtgttcgtcaacccgtgcctctgccctacctgtgacgggactaggttggccgtcctttgcggagatttccttgacctttggtcacgcccctttgaattgctgtgctgctgtgaccatgctgctatggatgtttgttgatttttttttaaacatgttttcagggtgcagcgctgcttgaactgccttggaaaaggctacgcttgaaggggcaatgcgtccttgcgtttggcttatcgttggccactgggatttccgcacggtcagtctctgttcttgctaaagtttggtgaggacgtttcaagtgtttacagatgtggcttggtcttgtgctgatgaaatgcaaatgataggtgattgaattggatggtttgtgtcgaggaattaggcctttttaggggaagttgagaaattaggcttgtaaggaggaatttctggccaaaaactaaaaccaaagaccaacgtgtataataaaatgtgactttgattttccctaccatttttgtttgtatagaagaaatataattatgctttctgaatgtatgcagaatattcagatgatagacataagatgcttgagattgtcttttgataaaaatgggttttcttgt

SEQ ID NO: 55902 - DNA, 8381 bp, Oryza sativa
ttctaaaacacttatttttatattcaaatatggatatacactatatctatatttggcaaaattggttatgtttagatttaaacctagccgtgtttagctccttcaaaagttgaaagtttgggttgaaattggtacgatatgactaaaaggtgtgtgtatgacaggttgatgttatgaaaaaagttggaagtttgaatctaaacacagccctataaatgttttttttttccggagggagtatagctttgctactgtactcgctctgaccggacggcacgctggctgacgctaccaccacaaggatattctcgcgatcacatcacatcgtcgcgttggtggggaccggccggcggacaacggcagaaacgccatccccaatatccccccatatcccttctggtgggcaagtacggtggatgtggatgctctccgcttccgctcgcccggtcaacgatcccacgcatcctacggtgcgcgcccgcgtcggcgtgacggtctctgccgcgtctcgtcgtcgcccacccaaagccgcccgcccgtgcgccgcgcgcgtctcgcgcgtttccgtcgcacggcgcgcctgggcgtggggcggcagcctcacgctgatccccgacggcgaccggagcggccgctgcgattctcaaaagtccaatctcatatcgtctcatcttgtgtgtgtgcgcgcgcgcgcgcatgctgcgtatcatcgccatcaccgtccactcaagttcgtggacgccagaggcgaaaaaaaaaaaagagcacagaagaccagtctctctggtctctctctcgatcgatgagcagttgcccccacaacattgggaggtagagattccaagtaggtgcaccccgtgctgttggtccgaaatgccgcgtgcatgatcctacaaaagcgcgtgcgtcgcatcctcgcaggggcggggcggagcgtgtggcgatgagcgacgcagcctgtcgattagtggctttctcggtggcatgtgggcaaatgggcgatggtctacccgtatctgcaagttgtgcgtctccatataaagttgggctcacctataattcattgagtcttgtaccttgggcatacccttagagaattatactgatggagatgattaaaagcaagactaataatacagccagctgcttactgtatagatccctatagtttatctctcagctcactcatacagtggctaactctttactatgaatatatggttcacctatctgtctcatagatttttttgattcctgtgcctaagccaactataaacttatatcctgcttcttatctctctcctttcctctcttatccacctcagcatttagcttttttatagccctctattatacttgctctaatatttgttcgcacctataattcatatatcttttcaaaattgtaattaacaaactgaatttgaaatacaaatactatagttgactaccaaaagaccactatcacccgttgcctcaaaaggctcaaagcctcaaaccggtcatggggttgaaaaaaaaaaagaaagaaacatgagaagtaatctcttatttttcttcttttctggagaggaacatgaggcgcaatatatttatctctctagcgttgaaacctagcccttggaacaatttgtttatgttgtcaggctagctgtttttgcatctccacggaagtgattatacgatgatttcctgtattttgcagtttggatcacgtcatgcttctgtcgacggggatacccgtagaccggatatagagggtattggggtacgctggtacgaggatctacataatacgacatcaagcagacagaaaacaaaaattatactggttaaaaccccttgataggtaatagcactaatccagttgatatgggattatatgatggaaaccacatattataaagggaaagcggaacttgatgataccgccgagatcgtaatcgagcaggtccgattagatctcccggcgacttggctcctgcaggcttcaactccgtagatggtggtggatgtattggctatgagattcgatgccttaggtcctcccgggggtcccttttatatcgcaggccaactggtctccaagtaggacacggaggcatcggacccggcacgatacaatgacgacccagttccgtccgagtaggactcctttcatctgtgaactccatgataaatttccttaacgtatgcaaaaaacgtccgtatacgtgcaaaggtaccatatcgatatgtgacgtatatcgaagggtagagggtatcccttacccgtaaccctgacagcttcggcaaggcatgatgcccttttctaaccttttgacaactcgaggtattagactagttagagcatcccatcctagcagctcatctaaatttaatcctccatattctcatatggatggccatccaaaaaagattccttcttcatataccttcctactccaatagatcattcatattacatcctccatatcacaacctcctatattttactaatatcttccaactaaccatatatttgtgttattttttaagggctatatcttgaacaactaaattttaacggtgttatttatcacgataatgtaaataagtgtattttaacctatatatttttaatggataatttaatgcattaaattgtgactttctcccagactatattctctttttctctccttttctattcctccttctctctgcttctttctacactcttctccattctttccccttctctcttctgccgactgccgcaactctcctctcctctcctctcggcgtgggagacggcggcagcggggcaaccgagctggcagaaagcggcggcaggcgtgtagcctagggacggcggcggccgggcgggcgagtgacgggggcggcggcggaggcgagtggccgggcgagcgaggggcgggggcggccacggaggcaagcgaccgggcaggtgagggccgtggatggtcggggaggaggcagccggcggcaggcgagcgaggggcggaggaggccgcgcatcttgacggcggcaggcgacgcgagcaaggagcagcagcgcgggcgcaatcccgataggggcggcacggatggcggggcctccactccgacgaactccaacgacagacccggtatgtccatcctctctattccccatggtacaatccagatggtggcacgagttcatctgagctgagtagttgggggatagcgtgaggagagagaaacaccaaatttggcatagggagggctcggtttgaaggacctctaaaaatgacgtgtgtgatggaggctttggtggagcgtgttttttcatctccatacgctaaaaatgggatggatggctagatggaagagctgctcttaggctgtgttcttgcgttatgattggaacttcttccctagaaacgtaaaacgaaacaaacttattattgcatattagcttaaaaaactttgaagtggattaatataaatttttaaagtaacttttctatagaaaaattttataaaaaaacatatcgtccaaaaacatgtgcgcggaaaacgagccagtcgaaaaacacagcctgatgcttcggcccggtttagttccccacttttttttctcaaaataccacatcgaatctttaaacacatgcatggagtattaaatatagataaaaacaaaaactaattgcatagttagggagaaaatcgcgagacgaatcttttgagcctaattagtccatgattagtcataagtgctacagtaacttacatgtgctaatgatatattaattaggctcaaaagattcgtctcacggtttccaggcgatttataaaattagttttttcattcacgtccgaaatctcctttcgacatccgattaaatatccgatgtgacacctaaaaattttcttttagcgaaataaacatgcccttctacctttctcccttgctacgagtactagctagtactcgtactttatttgccggttccgtgatgcttcattggtcacaaaaaatactcgacatattgcataagcatgtgatgaaattctttaaaactttgtaatcatatttagatagttgtacgcgtgaggctacctaggcctccaatatctctctagacgagtgttagccacgcacgtggatgtgtgcgtccttgagtttgcctaacttgtactcgaaaagaatatttatatatttttttctcagaacatatttttcatgatagtatagtgtaatattagtttttaatttctcatttattttttgtatgagagagtagattgttcaagaggtcgtcttgatctctggacttaattgtggagctaacctttacccagatatacacctggctcaaccaggtattaatgccaaaaaaaaaagttattttctgctaaatggatgaatgtgcgtgtaacctgaactcctaaaccatgcgattgttgcaaactttttccatatatgatttgttgtaatattgtttcaaatccatttttaaactttaaaatgattgatttattcatttgtgctattgaataacttttgtacaaatcttccatcgaattaatcattcagcccaaaagaacaccggaatgggtagtacgaaaaatattaatggaaaactatatatgcttcacaagttggaaaagtcatattcatcattatatagttagaatctttcccccaaaaaaacggaggcagacaaactgtagttgaatattgcaaaaatagagggagcgttattgttgctagttgtgtatgcctgtgcgtcaataaacaaaatcaatacgtttcgtgagcttgtaaaataagattcattgattctcggtagcgtgacactgcagataggctgtggagtattatgcatttattatgttccgttcatctcaaaattagcacagcacgaaaattaattaattaacgaacccgatttaatccatggcacttgacaccattcgatccctatctggagggattcactgatactgaacgctgaccattcgatccctatctggatggattcactcatacagcacgaaaattaagtagtaagaatgattaattataatacttctaaagataagtatgagatttgatttccccgggtgtaattatcaaataattttgtccagttttggaacagatgtgagtgtagtaggtaaggtgtgtgcggtgtatgaattgggacgacggagcgatgtaaagaattagataagttagaaagggaaatgctgtattacaaatttacgagccctctcatccacgtaaaaaaaaattatactactagctctgtcacctggcacgtaaatgatagtgacgtgcaattagttgatactgtgatttttctcattggttagatcgcacgtgcacggtaagaaaaacgtaaagaaaatgtggttgtgcattcgttgacacttgggtgtgttcttctgggctgaaggaaataaaatgcaatgctgaataaaatgattcaagggcacgacaaaatgaagtatttagtataaagttaaagaaaggatatagaataatattttgagaaaactatatgtagaaagttttctgaaagctcaagaagcatgtgtacttattattatatccaattccattaggtggaaaagaagttcaaaattctaggtttaacacctgtggccgattatattttataactttatatgcatgtatatacatgtatgtaatgatacgtgtatcaatgctcttaaagcatgatgagcttgtttagttcagtaccataccaatattggtagtgctaagatttagcattactacttttttaaagtagggtgcaattgtatttggtttgatgtcaatttagagtcaaactttgagtagaatcaaaaatttttggggagtagctatatttatgacgccatattttttattaaaaaatagtcggcatgtgtttacattgtaagtccctaaattacatatgtaattttagtgtatttacaatgtaagtctcaaaattacatatgtaagtcctaaaattatatatgtaaatttcaaaattacatatgtaagtggtgtgtaagtgggatgtaattactatgtaaatttgtataaatatatgagaagtgtcttttttttttaagaaaagatgtttgctaagctggtatgagcgtgctatgctgtactcccggccttagcatactgctgttttagcaccaatcttgacatcaattcaatgcaccacaaatcgacatatttttaagggaaaaactgtcaccactttttatagcgtttctgaatttaaattagacattaacaacaccaatgattcgacttgaaacaaaaaccattatccagactacccaaatattaatagggcatgttttgacattacggatgtctcaaacaatatttaaagcacgtgtgcacggtacacgtgtcccagatggagtagtttacccaggggaaagggacgccgccgcaccggacgaagctgctgccataccactgccagatggaggtggcggagcaccgaactaacgacgaggccgtccccgttcctgttggattggactggaccttcgcgtaggagcgcgccgatacagacaacgagacaagccgccgtcgcgtatctcatctcgtgtcatcgagtggtgtgtgacgctcgccgaacggcgtctcccccaccccaaatctcacttggttttggacctcccgactttggtacacatcacacaacacaacacaacacccggaaccaacagagaacaaggcgccaaaccaaaccgccgcgcatcctcctctcgccgagcagcagccagccgcggcgcacggccgcacgcacgcgcgcgcggcctcacccgtaaaaacgacgcgggagcacggcggaaatcgctgtcgacgacgatgggcggagagcccccccgaaccgaaccccaccgatcagtttcttccatccaccacgtcgcggccgcccgcccaaccgcctcccgccacacacacacgacacaacccgcgcgcggtcggagaggccattctcgccgtatgccagttggggccgatctcccgggggaaaaaaagaaaaaaaaattaaaggacacgaaacgtttcccagtcgacggacggagcaaagcgagtcgtccggatccgctttaaaaccgcgaccacctctgcttctccccttctctctcctccctcctcccatgtcaacggcggccacccccctcctcctccacctccacctctagagagagaaagccctcggccgccgccgccgtgttcttcgtcgtcgtcgtcttcttcttctgcggattgtggtgctcggtttggtcggtgagtttgggtggctggcgatggcattcgcgggggacgcgcggatcgtcgtcgtggcggtggcggcgttcgtcctcgttggcgtggcggtggaggggaagggggaggggggaggaggaggaggggtgggggtgtgcttcgagaggatattcagcttcggggactcgctgacggacaccggcaacttcctgctctccgtgccggaggacttcccggaccccgcccgcagcctcccctacggccagaccttcttcggccgcccctccggccgctactccgacggccgcaacctcctcgacttcttcggtatcacccccctcctcctcctcctcttcatttcatttttcttcagatttttttttctctcatcctgccatccgggaccgggacccccttcggcttccctgtttgttttgtttattctgttggtgtcgggtccccctctggtaaaatctcctacgttttggtggtatgaatggatcaatcgatgcagcaatctacttgaagattagtagtagccgggtaattggattgattagttactactttttggttcttggtttctctccttgatgaatactccacgcgtttgatttttcttcaagtaataaattcatcatcgtttcttcttgtgagccggcataagcggtgtggcgatgatatagtatgataatttccactgtttttgtatgcctgcaatgcatcgaacaagaataagccacaaatttacttgtgtctgcaaatttatcaattggcctcactgatcataacaatttgaaatgcgcgtgtggttcagagatgtgaactagttatagcaaatttcactgcaaaatacccaacttatacagggcgtatccgcaaaatctgcttaccttccccagtttcccccaaccaacagaccatgatggcatcgtcttcttgaacaagcacacaaatcggtagctccaaccaccactgaatcagcattcacatcactcacgtggtcaacacttttattgcagtcttcccaaattttgtgtcctttgctaatagtatctgttccatggggttggcttcctcatgttctgtgtatcttagcaaaaactgtcgctag

SEQ ID NO: 55903 - DNA, 746 bp, Oryza sativa
aggcgcaaatttcgcggtcggcggcgccaccgccctcaacggatcattcttccgggaccgcggcgtggagccgacatggacgccgcactccctcgatgagcagatgcagtggttcaagaagctactcactactgtctcctcgtcagagtccggtacgtcaccctcctgagacctggagttctttgctgttgctactagtatgtcggataagctgatcgatgcatgagccgttattaaccgtgttagtagacgccaaggaaacatgtgagcgtggcatcacagcatgccagtggatacagtaaatagtgtccaaacatgctgaaaaccgtgcagatgagctggccacctactggccagaatggttgttcagtacgagcaaattgctgcatttagtagagtggctcctttccctgtttgcaacttgcaagcaagcactttgtttttagttggcttgtaagctaaagttcactagttaaatggcaccgcaaaactgctacttggagccttctgattaggtgaaaacattctgtgtccttatatgtgatgagatagccggctgtgcaaatattgtaggatatttgtggaaccatgtttaaccagcaggctggtttgacaggttttaaccagcagcaacatgttagaaaatctttactgggttgtcaaagcaaaatcatactcgtctaactgttctagagtggcactgaattacatgcatggttgagacataaaagccaagtccataattc

SEQ ID NO: 55904 - DNA, 1225 bp, Oryza sativa
aagagaaggagaggagcgtattggggggggggggggggggggggggtgatcactgtgggcaatcatccgcccattagccacgccctgagtagactgctacatgtgagcaacacctatcgaattttgggagttcgatttatggaactttggggtttcgatagtccacctgcatgcttgctcttttcgtttttttttaatcaagtcaattcccatgcatgctctttttgataggatatgtcaagctacggctgtttggcagggtgctaaatttgtgatttcagtcgaccaacatttattttgcaattttctattaaagttgtattatttctaattttttcccctcatctatcctccgccgccgcgaggcgcgtccacgcgtgtccacctctcgtcatcaccagaccagctttactatggaaacatgtataatgccacatatgtaatggaaatgtacgtttgctgcatatcaatgtcaccgtaaataaaacttttacaatagtaataaagtttcattataagttttcctcatacatgaagtaaaagtttactcatactgacgtgaataaatctcatctaattttacatcctatggtccactatatatttttcctactgactgacagatctgtcgtcttcattcagattggcagatccctcgtctgcaatttagattcagctacttttgtgcttcattgggatttctagaatccttatatgtccgtcttcatatacaatgtctttgtcgtagatcgtaatgtctcgcaactatggtttttaggtagaaaattcgttctgttataaaacttgttcggattgttgatctgagccggtttagtctttaccgtttactatgatacatttatgtttcggaattgctaaccatcatttggtagaattttagggtgaattttctgtctaattctccatcattggatccacaccatgattcgtgttccaatccttcttctctagctctagcacaactccgacgagatggccacaacctgactagttagagtttcgggattgaggtttgggttggaaggggggagggagagggggagagttccccggtcttagagggatgaccgtggcccgtggaggcaacatcccaacagtgggcggtggaatgggtgagcggggaaggtggcgtcaccgttgccgctgaagccacgggggctggagtagggcggttgactggtgttggtagcgggtagcaaagcta

SEQ ID NO: 55905 - DNA, 809 bp, Oryza sativa
cctcctccccgtgcgccgcgtcgtcgccgatcatgacctgctcgtcgggcatccgcagcgggatgaacaggccgatgccaaggaggatggccgtggtgaccacgaggttccacgcgatcacaaacgcagcgccgccgagctgcttgctgatctgcttgatgccgccgccgtagaacgcgccgcggagtcccggcaccatggactcgaggcctcgagggagaagagctccggggtggccaggaggcccgtgaggatgccgccgaggagccccgccacagcgtgggtgtggcagagtggtctcgcgcgggggccggcgcgacgacgcacaggtgatgggcggcgatggcgtggcgcggccgtggcgatgcttcgtcaggcggcatcggcgcgcggcgttagtcgagggagaaggcccgcgcggtggtgtcatggaggagggaacagagagagaagagagataagagagctgacatgtgggcccaagggtatttttgacatttcacacaatttctctctcctcttcatccggaaattattattttaatcggcacggtgtccactagcaaatttccatatttatagagtgttttctctcaaaagtgagtttgggtagtgtcctggggctaaaaccacagataagcagtatcttgtagcaaaatttccctatattttaatattgtgagttactccaacatttggttacaagggatactaaaatatttgataaaaaaaatagtttgttatgaaatattataatacctttgtctcatgttcctagcaaaatatggcattttaccagtatatggaat

SEQ ID NO: 55906 - DNA, 2440 bp, Oryza sativa
aaataggggtatcagatgcaaagtgaaatgagatgagctactagtagtaacacatcccggttagttatttagttacaagctgatacttctacgatctagcaccaaggcagtaaactacagctagcatgttatcagacttacgtagctgggcgtttaagcctccttgagttgtgatttttatcttttgtaatcaaggatctgtttgtattctgttttccttcttaatcaaattccggctgagctcctgctgtcgtcttcaaaaaaaaatggagagtaattgaagtcatgactggtgctattaagctttaacaccacaaatcatacatggcatatatggcttcttttaaagaatatgtttcggtactgaactgactacaaggttacaattccactgctcaccactaaattgagaggagtcactacagataaattctcaagcgctgtgcatagaatatgtgtaaggtacagcaaatgctacagaaaaaaaaaagattaggaaaaacaacatctctaccattaaatcatacaggatgcaatgaatacatgttataaatctattatgatggcgttgcgataaattatgtttatgcagttccatcaatttattttaaacctagcgactacaggtaccattggcaaatgaaggccaatggaacgccatcttgcataaaactttcatcatccaatgagcgcaggtccatcagcattaaaatggcatcctaatttagacctctagcagttcaaaacacatagtacctacaacaatagtaaagaaatggatctttaaagagtaaagtgcattgcgatatttaaacttgtagggttgtatcatataggtccctaaactctcaaaatacatatccaggtagcataactttttaaagtgtatcatctagatccaaattagcacatcccctctaagatcctacgtggcgctgatgtgacaatgccacatggacatgacgtgtccgtttctcttttttttttctttttttttcgttttcttctcattcttctttttttttcctttttttctgcacgggtcactaataaaggagaagaaaggggaaaaagttaaagaaaaagaaaaaggaaaaaaaattaaatggatcctatttgtcagtcaaaataatgtcatgtcatgtccgtgagacatggcacatcaacgccacgtaggatcctgaagaggttttagcgatttgggacctagatgacacactatgacaacaagttctgggacttagatatacattttgaaagtttagggacctagatgacatatccctataagtttaaggaccgcccgtacactttactcatctttaaatctcacaggttcagtggtttcctaatttcaccccttcttacagctcttaccactacacacaaaatggacaactcagtggaagtaacaagtctattgatatcagcacagcgaataccataccacctccgtagagtgcacaacactaaaaaaaaaaaacatgaagcagctgatctaaacaccatgagggctaaaacataaaaagggtagcgcggcaatgccaccctgcaattctagttgctcaagctaaaaatgggcaagtgcaaactgtttcaagaaaaagggcaagggctttgctatttattgaaggagaatcaaacatatgttcctcatactccctccgtcccagaatataagttttagagttgggacacggttattaagaaaatagataaaagtgaatggtggagggttgtgattggatgagtagtggaggtaggtgggaaaagtgaatggtgaaggattgtgattagttgggaagagaatgttgatggagaagtggttatattttgggaatcccgagggctaaaaattgttatattttgggacggaggaagtaagtcataacataccataaaacggttggggttttagttcctatatgcaatttgatcaaaaagagtaagataagtcatgccgaaaccaattcaagtagcagagccaagagagacaatacatatttgtcttaggtcaaccagaccaacatcatgcagcttaaaaagagcttccacagatcacctcgaatgcttcgactcctctcaactctataggttcaattccagctcgccgagacctaaaccaggcgttgtttcgggaggcggcatccgttgtgtggaagctgggtcacatcgtggataaacaccacaggagattgctcccttactctttcaccccgaaagccttctctgaagctcaggatcactttcttcttcttattgaagaacacagttcctttcactttcatcaccacggatttcaaacccatcttcctcgcggctcgcccgacatgttctgcggttgcttcagtagcatatttggagagacgagagcgccctttcttgtcctccaaacaaccagcggatgccccggtctttgctgttccccaaaagggatcca

SEQ ID NO: 55907 - DNA, 2799 bp, Oryza sativa
ggcttctttctcgtccatgccaaccatacacacggcaaggttatcttctggagctgtctttcaacattatctgaccacttttcaaatttcactaatggatggagtatcgtgtaggactacagaagcattcagctgatgctcgagcattttcattcataaagattcttaacctaatgaaaaacatgtgctttcctccacaaatgttatttgtggaaaacgtagtcggatttgaggttggtgtaatctttggtttctttaaagcactattcttgaccgcagtattttatcaagttgtgacccctatttgtttgtgacaggtgtctgatacacatgaccagttgatagaggttctttcagatctcaatttcaacacacaagaatttatcctaagccccttgcagtttggtatcccatattctagacctcgctacttttgtctggtaagatttctggaggatctttcctgttgtttcaatgtgatctgtcacttgacgttataggacatgacatggcacaaatcttattgttactattacatatgtgcatagcttccaaagttcacaaattgtggaaatcagcaagggatgacttgggggtttgttgcttaagattggtaaaaagattgtatttgcccaagtgcttattaaaagaaaaaccataggaaattagtctggtgtcactacaaaactgagaaatcatgcaataaagttcctgataaaaaattgctggataataaactctaggttcttcaatagttcatttttgttcagctaagcaactcttcatttatttaacagtaccttgtctataggcgaaacgagaacctgtgagttttcaaaatccatcagacaacagcaagctgctccggacacctacattcctaacattggtaagggcaggtcacaacagatgtaacccggatgaagatgagctggaactagtatgcaaaccaatcagtgacttccttgaaacaataagtctgaatgtcgctgatcaggattcttcaggtacaatctctgacagtaagttcaataagcctataataattaccagtatctcatttgaacatgcaggttaaaaatattttttaatgccactctatattttgtagttaatgggtctgatggatgcaccccaagtggaataatttctcaagattatgtagtcccgctaaacttgattgagcggtgggggagtgctatgggtatcttttttttttcttagtttaagactcctgaatcaatcatttaatgatagattattatgttttactgatgcttggctgtggtgtctcctcgactgtttgcaagatattgtatgccctgaatcaaaacgatgctgttgttttaccaaaagttattatcgctatgtcaaggggacaggctccttactagctacgtccaatgtaaggctcattatattcaatctttcatctgctttgttttcaggcatccctggtgttgcctcttaatctgaacattcatgattccttttccttttatgattacctacttaaattacagaacctcaaacgaatttccaaagaggaccttgaaatttcttcactgaaggagttaggcttacgatttttcacccctcgtgaggtatgtgcttattgacaacttcacataggtccacacccttccgtatctatgttttgtctcatagcatgcaatattcatgatttttcaggttgctaatctgcattcttttccatcgagtttccactttccgaatcacataagccttaggcaacagtaagttttaatccctaccttttactctgttggaactcaatgaacttcaggaacatcataatcgcaatatatataagaacatgaatgtgactttctagttttgaaaaccagaccgcactgcctgaattgtttgttatcgctaacttacctatggtggcaggtatgctatgctgggcaatagcctgagtgtagcagttgtggggcctttgctgcgttatctgtttgctgagacatagtgatgttcaatcagttggcacatgatgctacacaggacaaacacattgaccttcctttgcccgtgttatcaccctaaagccaggttggttcgtgggtatgattcgtgtactccccgaagctgatggttgtggttcaaaccttgcaacccaattggagtgaatttcccacagtggtgcaacttcaacttcatagggcttggggacttgtcgattcatcggtgggaagaagacagcgtgcatgatggcccggcatgtatcggtgaaactctgacgcgaatcttacctagtagagtagagaagcttcctcagcattttccctttgccccaggcataagttttaataataatgttgaatgtttgaggtgttacagcatttgactcatgcgcattgtgaaacgaggttattatggtttagaactgaacttcaacttcatgagctcaccattcgactgtctcaaatcagtttgctttcttgatctttctgcaaagaggcaatattttgacgacacatttgccccgtgtacctcagttaaacagtagatctgcattcgtttagctatagccaattcttgtgaaaaggaagtttgaacatttttttcgtgagaagtttctacccttaaattgataaattgaagtttctcaatccctttattttgttctacaatatgaacaaaatgttttgagaaagggtcaggactgctcgttaacacgtggatcctcagttccacatgtcaatgtgcagtgtgtgtacagcaccgttcgctaacacaggtcccacagacactcgggcctacatgtcagcgaag

SEQ ID NO: 55908 - DNA, 2925 bp, Oryza sativa
  unsure (1)..(2925): unsure at all n locations
ggtccatcttttattttcaaacttaaatttagagcctgattttaaggttttttcatcaaaatttaattttttagcctttacttttaattgctacgaatacttatataaaaattttatttacaaattactttttatttgcaaatatgccgttcacatgttctctgcttgctgagaagtgagaattgagaactgagaagacagtctccaagatatgcattgcacagcgcgtattcgtcgcaggaaacggcggcatatgcaagcgagagcagagcagatctaaacccaaaacaacgcaaagccctctctcctcctcctcccccgcgacacgacactgtcgacacaccatgcgccagccacagctccgcgccgccacctcgcgcccgctctcatggcgctccaactgcacggctgctgcggcgtccgcctcccagccgagcgagccgctctccgcccacttcaccaacggccggcccctctcgcgcgccccggccgtggtgagggacctctcctcggtgctccgcgcgatcctcgccgcctccccgtcctcccacagccgcgcgtacccgctcctcaagtccgccgccttcgacgcccgcctcgcgccggacgcgctcgtcgacgccgtcctctccgccgtgggcggcccggggtcacggcaggccaccgcgctcctcagccgcctcctcgcctccctgtgccgcgccggccgcgctggcgcggccgccgccgcctacgccagcatggaggcgcgcggggtcaccccggacgccaagtcccgcaccgacctcctcgccgtcacggcgcggagcgcgtcggccgcggacgccctcgcgctgctcgccgagatgcgggggaaggggcgccccttggacgcgtggatgttcgacgtggtgatgcgcgcttgcttcaaggaagggatgtacgacgacgcggtcaggctgttcgacgaaatgcctgcctctgagatcgagcccgaccagcgcgtgtgctctgtcgctatcgcgtccctatgcaagctgcgtgacgccaaccgtgctctgctggtgctgaggaagatgcaggatgcggggttcgtgccgtgggacttcacgttcaactccgtggtggatgtgctcgtgaagggagggaggatggaggaggcgctgcacataaaggatgagttgcttgctacggggaagaaaatgagtgtggttctcgcaacaacgttgatgcacggctattgcttgcaacgggaggttaggaaagcgctggatatattcgaggagacactaagggacggtctggtaccaaccgatgtaacatatacggtgctgatcagaggttgtactgaagaggggatgccagagaaggcctatgagctgtgccgccagatgagagatcatggattgttgccgagcacaaatgagttcaatatggttatcaagggccttttgaatgataaattgtggaaggatgctgtaagcttgttcaaggagatggctgattctgggataccagatgccttcacatacaatatactaattcactggctctgtcagcgtcgcaaaattcgcgaagcgcttaacttgtgggaaaagatgaatgaaacaggagtgaaaccatatatcgtgacataccacagcttgttgttgtgttattgtgtgaatgggtgcatggatgaagcagtcaagctgtacactgagatgcctggaaaagggttcacacctaatgttgtcacttacacaacgctgatgaaagggcacataaataaggctgcttttgacaaggcttatgccctccttgctgaaatgaaacagaatggagtctcttgcaatgattatacatacaacactctcataaatggcctttgtgtggttggccgagtttgtgaagttggtgaaatgctgaagagatttgaaactgaaggttttgttccaactgcaatgacatacaatagtatcatcaatggatttataaaagctggcatgatgggctcagcatttgctgtgtatcagcagatgtgtgcaaaaggcatacctcccaacatagtaacatataccagtttcattgatggatactgtaagactagttgctgtgacctggcactgaagatgctaaatgatgtcaggtgcaannnnnnnnnnnnnnnnnnnnnnncatataattccttaatatttgggttttgccaagaggggaatatgtctcatgcactgcaagttcttgtccttatgctgaaagatggtcttttaccaaatatttcagtctacaacagtttcattacagggtacaagaatttgaaaatgatggaagaagctttgagattgtacgagaaaatgattaaagaaggaattgatcttgatacagcaacctacactaccttaattgatgggttctcaaaagatggcaatgtaacctttgcattgaaactatactcagagatggtggctaagggtaatattcctgatcatattactttcacagcattaacacatggtctttgccgcaacggagatatcgatgatgctagaaaattattggatgaaatgaataggttagatatacgccctaatgttttgatgtacaacatgttgataaacggatacctccgtaatggaaagctgcaagaagcgttccggttgcatgatgaaatgcttgaaaggaaaattatgccagatgatacaacatatgacatactagttggcatgaaatctttgggaagtgacagtcccattgacgcggagaatcctaatttaagttccacaggataaggatcaagagctggcttgagaagattaaactttccattgtatggccagtgtcagattatgagttttgctatatataaagtgaaatcttagctatggcaaatagaagcaaaggtaagcattgagattcagttactaacaagaattcaccttttattattaagtaatctctattttaccg

SEQ ID NO: 55909 - DNA, 1492 bp, Oryza sativa
aagagtaatttagattatatgtgtacagcatacataataatccacttcatttaggcaaaacatgcgttagaaaggttgtcatcgtcgagatcgggtcattatattgaagatgtttcaatttttcttataatatgtcttagctacaacgatcgatacgattattatcattgacacaattatgcgtggaaagcgtatattgtcatcgaaatgttttcacccgttgcaatgcacggcatttattttctagtatataccaaattagaaaataaggcttctggtagttttcttttttggtccatcttttttttcgcacgcgcgattttttcgtacgttttttgggcccggtttttcccgtccgattgttttttttcgcacgcgcttctaatagtttttttcgaccgtcgtcatttttttccacacgtggttttatttgtggggctggtttttcccatcgccacctgtccctttttttgtcagtccaattattttcctagtgggtggcaatttttttttgttgcggttttttttgggtgggcccaggtttttttccaccactgtttccgatcagttcttttgcgagcgcacgtggaaggactgaaagcccaaatagtcagatacaattacaattacatggctcaggaattacatacagagtccaagaataggaattacatggccaaggcccaagtaggataaaaaatcttctcaacctatatcgtactttggtacgtcatgagtcgatttttttaattttatgttatctttactacttaaatttctgttgtctgttaaaaaaaaaagtccgacccaaaaaggtaaaaaaataataaaaaaaaaggtccaactcaaaagcgataaaaaaaatctgtcgtcagtaaaaatctttatctatagtaaaaatctttatctttatctttatttttatctattataaaagtttaagatgtttttgtcaaataattttgtacgccgcccgctgttggcttgggtctcgagtttgtatcgcgttactccgtaactcatctgatcggttgatccacagcgcaatcggatttcgatttttttttcttccatcgtccgaacagctagcaagcccgcacaaacaatttcgttcacgtttcacccaagctttctttctttctttttttttttcgaggtcacccaagctttctgtctctattccaacctcccacatgcgccagcacgattgattaattaagcatgcaaccaaagaacgtgggagacaaaggcaaggtccagtattgttgtagccgaagtcctcgaggtagccaacgatgcatgcagccttggtatatatggcgctcacctgttgtcccttttcaccatgtccactctaacacacaatatggaacatatatatacaaggttggaaaacgtatgaattattacgacagtatgaattagtccactgaaccataaaaccagacatattaaacctcgaattgttgataccgaaaaaattaccccccct

SEQ ID NO: 55910 - DNA, 719 bp, Oryza sativa
gatcccgtttttggtaatataattattaagctgtggaagaaagaagtcatcatctcgagatcgagagagagaactctagagaagtgatgatgggttaccttgcgccattgtcgccgaggccatggagccacacaatggtggcctggtgcctccccttgggcctcaccacgtacgtcctcccgtactccacccgccgcccgcctcgcccccctgcacgcattccattcgatcgttcgtcagcacacgccggcggcggagaaagaagacacgaagaagcaaagaaagaaaaaagagaggaagtgagagagagaccagaagagctgctcccgtagctcatggccggcgaccaagaagcttgagagaactagtactgcaggtgatcgatcgatcgctggaggatggtgaatttggctgctgctgctgctgatggatatgtatagctctggatcgaggagaaagcggtggaagtacgaagagcacaggcggcccgtatttatagagcggcgacgacgaggaagacgacgtggtgaatatgtgaatcgcgcgggcgcgcacccggtaatcaacagttggcggcggctggtaggttggctcgctagctgtctgtcgctgggagaggggggaataataatccatgacctctagcatacgtaatgcgtgccggaatgagataaacgttcattcagttatttgccaacttaggatggagattttacaaa

SEQ ID NO: 55911 - DNA, 805 bp, Oryza sativa
ggaccaaggttgggatagaggggcaggggtgccacgctaatggcagccgaaggctcaaggaacaggcactatcccaagaggatacctgcaaaaaacgagcactcggctaaaaatgccccccggaaaacaaccggctctaagacgaaggaagtccaccatgactcaaagacaggacccaagaaaccaactctgctgctgcgaagcttgactgaagtaggagtactaccgctacggtcgtatatttgcatctggagatggatgacccagcacctccagcaactagttgttgttcctctaagcaaggatgtcgcaccaccagagctgcttctccagcgatgcaatgttgtggttgccaatgaagttgaactggagattgaggccctccaacgatgccgacatgctgcctaagaaaggaacactcttctgggtaaccttcaaacaaccagaaagtgagaggacacgaagtttgagctgcctcgctgacgccaacactgcaacaccgtagtcgctgaccatgcagtttgagagatcaagttcggcgagatcggtacagccctcagaaatggcaaacaggcttgcatcagtgatcctgctgcaaccttcgagactgaggcgtgcaagcgaactaccatgtgccttcaccaaggcagaaacagtagcatctgtgagattctcgcagccgttcaagtcgacatggaccagcccactttcggaactcttgatcaatggaaggagcccgttgtctgtaactgcaccgagaccactcaagtcgacattctccaactgagggcagatcatgccgacc

SEQ ID NO: 55912 - DNA, 1327 bp, Oryza sativa
cagacaaggccggagacaccctggtcaccgacatgcgcgcaattcttgatgttcaccgactgcagcttcgcgcagcaccggccaatcgccttgaggccctcgtcagcaacaccggggcatgcctcgacggtcaccaccttcaagtccgggcaaccctgagcaattgcagcgaggcccttgtcggtgatcagcgggcagccggtgatgtcaagcctcgccagcgaggggcagccggcggcgatctcggcgaggccggcatcggttacctgagggacatgccacagggcgagcgagaggagcgacgggcagccgcgcgcggcggccgagatgccggcgtcggtgacgccgcgcgtcgggtggctcccacggatgacgaggctctcgaggcttccccggagcgcgtcggcgacggccaccgccatgaggccgacgtccgtggcctcgcgcccctcgaggcacctctcggaggagcagccgccgccaagggggacctcgaactcgtcctcctcctcctcgtcctcgtcgacgaacacctggttgaggtccggcaccgccgccgccgccggctctcgcttgatctccgacgagcggatgccgccgaggagagcgagccagcggcgggagacggccgcggaggcgcaccgggcgcgggcgcccttcacgcggcggaggatctcgaagaggcactcgtcggggagagcgtcgagcgacggcgcctcccgctgctgctgctgctgcttctgcctcttggccgccgtcaacccctcctcctccaccacctccaccgcctccgcggcggcggagacgaagccgcagggcggcacggcggtgacccgcgcccgcttccgcgacctgacgccgccgaacagagccgccgacgccgccggctccatcacaagaacaccaccatctgcacaaagcaaacccaaaaacacacatcagcatgaacccaaacccaaatccattaaaattcctcatcttgtttacctacctctgtaatcgtggaacggaggcatgccgacttcttcaagaacaaatcagaccaacaaatttggccccaaaaaacaacgcaagaatcaacaagagatgaggagaacgccgaacccaatcgccaggaggcgagaggggaaaaaagatcgcagatttagtgtgaggagatcaagggaggtggaggaggtgatggaggagagggaaggaagaagagggtgggtggtttttatgtgctttgggtagagaagaaggggggaagccaaagaatggagaggatgatgaggattcctgcccaacttgcacaagttgtgtgtgtgtgtgtggagggggggggttg

SEQ ID NO: 55913 - DNA, 2722 bp, Oryza sativa
gtgctgcagtgatgcagtgtgctggacatgcctgatgcatggacctctttttttcccctctttttacagtgggatggatggggaggaggcattgtggagttttgattgtgtttgaatttgatagctttgggatgaaaaaaaaagaagaagtgttcttgttagatttttattttgaaagattataattggatgcatacggctgtataggcatgtagtagtatgcgtttgttctcttggttgttaatactacttatgttttttaatatttcatgtccttaattttttatgattcgtttgattattcatcttattaaaaggttttgtgcaaatatataaaaatatagtgaagatttaataataactcaagtcataagaaactaaattgtaataaacatatgaattttataataagttgattggtcaaatgtattactataaaacaacaacgaagttagatattaaaaatggagagagtataacctcggacattagaacatcaaagagaatcggtaattcgtgtatgatcttgcacatttctccattaccattctgaaaaataaaaatctttaaatccaacttctcaattggtttcgtcatcacaggatattcaattaaaaaaaattcaacaatttactttttttcacactagaatttcccacaatttttgcatcgtttttgtgttgattaatcggcatatgattcccaatttaaagatgctttgttctgatacataggtcatgttcttttttccaataagagttgaatgaaaattaagattttcgtggcacgcttttcgaactactaagcggtgcgtttagtgctaaaactttttatatgaaagttgctctaaaatatcagattagatttattttttaagttttataataattaaaactcaatcaaatcatatgttaataccatctcattttacgtaaaaaacttaatcttcatcttcaaaagaaaagagcaccaccacagtggtagcatggctttactaggaagctgtctagtacattaccatattcattactgaacaagtttgcatttatgcagttcacgatctgatttttactcctttcatttttcaactctccttttacaaaaccgctttcaatatttatcaatgctctctattattagtttacatttaaccaccgataaattttaaaaggttaaagcaatgatgaacgaaagctatgcagcataataacttttataaataaaatggccaaactttcaaatatatactaccagttaaagcgaattcaactaaaagctactaacttcataaattattaagtgaagtgttactgcagattaaacttggatgaattaatattttcataaatgcacttaacaaaatagcttaaaatataaacacaaggtctacgcaatgtggtagaagatttttttctagaaaatgtatttttcaaagcattgagcaaataatatgctttaaagtttggtgaataatttgaaaggaataaggctgagttattttgagcactttgggttagctactcccttgtattttgtgagaatatttcccgaagtgttaaatggtatgtgttttgcaaaactttctatatacaaattaatattctgaaaaatcaaataagtttattttaaagtttataataattaatacttaattaatcatgtcctaaaaagttttcttgttttacgtgcggttgtttagcactgctcgaacgaacggtgactaggccctgttagaggataattaattggtaatcagcttctgataatagttaagttttataacttcttttagtttttactaaattctataactcaaaatcaaatctgaatgagaatctaatttatttaaggggattttaggacaacttacagtgcccagaaactccccaacacggggcctaagcccagataaattaacaaagccagtgccccagtataccaccctcaagtttttttcttttttttttaaaaaaaaggcccctactgtggacatgcgccacgcggatcgatccgtggaaaatgccggttcgatcgcccaactctgcctgctgccaaatacgcgcccgcgcgccgcttgatcaaccgatcgatcgagactgatctccaggtgagaaacctgcgagaccgatcgatatgatcgaccgaccacgcccgcgtccaccgctcgtccatcgaacccaacccctcgcgctcgccgtcgcgcgtgcgtgcatgcacctacatcaacaccaccctccgcgcgctgccacggctgtggctggctcgcgctgcgtgttccgtgtgcgcacaagtgcaacgcacctgggctagctgggcgcacccaccacttataactaacggaaagaaagaaacagagaaagaagagagatgaaacgggaaaaagaaaaataaaatgcgatacgacatgcaacggcctgctgctgctgggtgtggtggtgtgggtggtgaggtcgtccagtcctgtccaggtgcatgcactattgcgcccctttttccttcctcccccagcttctttcgcccttatcaaatccacagcttcgtcttaattagacccctgttaatttaaaaagcttaagaggcagcttgtcagtcattagcttctgagaatccagcttaagaacccgcatgtgacttctagtttattttcttttttaataattttttagtttattttttaagtccgtagttactccatccatccctaaatataatggattaatga

SEQ ID NO: 55914 - DNA, 3875 bp, Oryza sativa
gaagcagttgtttcatagagtaaaaaaaatgcattcgttatttttcttccattttcttgtactatcagctagggttgtgtttagttcagcgcaaagtttagattttggttaaaattagagatgatgtgacagaaaaattatgtgtgtatgataggttgatgtgatggaaaagtactgaagtttaatccaaatttgaatctaaacataacctaggttgatctactacgcggtttcgtggtggcctcttgtgggggtttgattaatgactcggtgaacagaactactaataatcgagagtactgaaacttacacgtgggcccatttcagaccagtgtttgtgcgtggggcccactgtcagtggctctacgcggtcgtccctcttgttgaacgagctccggagtccaaactaccagtccaccatggaaaggtcgagctgacgtcgtgtgaattgttctttttttttccctttcaagaattatgatttgtttgaccaacgagttgactgggagaatttttattttttttataggtgagttgggttgtatacgtagaatttgagtaaaggtaggtagctcgaactgtttttctatgttttgatgctattataaacatggattttaattgtacggtttggagtttttacctgtcaatctatatattgctcttttaattctccccccccccctcctaactcctaagtggctttgtttggttaagtgaggtttaaatataaactcataaattgaagcatttctcacatatttatgcccatctcacattacacagatattaagaaatcaggtaaaattaaataaaagaatattgtgattggtcgagaaaatgaagaggtgaagaatttgaatggcaaaatattataattgattaaaaagggaatatgagtggagaaattgttacactttggagtataggacaaattttgaatggtataacattattatattttaggacgtagggagtaggtgattaattaatacatcgccaatctgtatgtaatggccaagcttagaaagcttaatcgataaaaatttcaagattatgctaccaagtatattagaagaagaagaagaagaagaagaagaagaagaagaaagtgaaagaacaataattttgtccaaaagaagtgtactccgtattctctatagaggagggaggtaaggtacatatcaaaatgagatgtattcatcggcagacggcacgcctatagttgctcctattctacctttcaatcttctcccaacaccaaaatagggtgtatttgaaaaagacatatgatttatttttagaaaaagaagataccaacgttattactatttcgtataatggactataccttattgatactactgctttcaataaaaagtttacactgtttagtgataggcatgattagctttaattatttccccagaaatcgacattgcagaaactaggtcagcttattgaataaagatcacttataagatgattattcttccagcagaaatttatttacatgtcaaaatttttatcatagtcaattatcataatcctagattatatatatacttgcaaactcatatgcttgtatgtcacatatcatttaacaatagatattccgatcaaattatcacaaaattatagatttaacgtgtaatttctcacataactatagatttaatatagagtgtcacaaaaataaaaatcaagtagcaaatttatcacataactctaagtttagtgccaatttaatcacaaaactacaattatcatagctccaatatgatggcaatgctatggatttaaactcaatagttttatgataacttcaatataaatagtagtttcgtgatattcggttttgtgataattttaacgttaaatatgtagttttatgacacataaattaaataagtatttttatgatagtttgatcaaaatattaatagttttgtgaaatttactcttaacaatattatatatgctattcaatagcaattgctgaccatacaaaaacataacacttaatttgcagtaaagaaattctctgattaattatacacagctgctaaattctctcctcacttcaatccaccgtgcaatacagctgtttttcaattcgcaacgacccccatcgctgaagatgaaagacaggtacgcatgtactattcttctactacaaatggagcttattgcagctttgtgggacagccaaacggtcagccccggcccggtggttgatctgaagatccattgcatttgcacctgacgcgctcacaacaatttgacaatttgaacctgatagtgcatgtctcaccaaactatatagtactatcaattttacatgcatgttcatcactgaattggagaaacatgcaatgaagagagatcgacatgacatatactagtacatactattccatatgcaactctagatctgaactcaacttgtgaaattgtggcctaaatagtctgtacttcagcagcacacaacactgttgaaactctctgagcttcgatctaggacaggcaaaattaattgaattagcagactggacacaccaatcaatcatcctatccaagtacatgcatcgtcgtcgtcgtcgtcgtcatcgtcatcaaccattgcagttgcagctagagagctgaatatatacacaagttgcagctctttccatgctctatcattcatcaagttgggtttaacttttaattctttctcttcacccttcttgcactggaccaagacctttattctttttcttgcattggggagctgaatccatcgatagattcgtgagagaaaggtaggagtagtaccatgatgcatgaccgaccaagggtccatccatccatccatctcgatctatactgtctactagtcttaaacaaatgaaatgtgtgagctgtttctcgacctgatcagtcgttcttgcaacttttgcaagttgcagcaataaaataacactggattgttgcttagatcacgcaaaatgcagtacaagaattcctaggaaatgaatgaattgctggctaggagtagcaatccagagtcttcttcatcatcgtcttggactgcactttctcggcctccatttgggtagttcatgtggccaggtgagctgaaccttgaatgcatgcttgtgcaatttgccgattgttttagctaaggcgtagtacgagggacggagggtgagatgacctaaagtcctgaagaccagaacgatgaaagaggaaatatgtcggttgctaattcatgcaaattattaatgcttgattaacttttcaatcaaacgcaattaatggttaattgattaattagtcccccacctacatcacttggcctgttttatatagtttgccttatggtgtcgtgtgttggtaatctgtggatcagcagatgccacggtgatctagataggaaaattagttcacagtacttcactcacatctgcatcttgagctatctatatattcatcctagctgcgacttgtgttaagtttatcatataatcgttgtttgattgctctctggttggcttctttttaatttgcagtagctagctatgcacataagaaagctagccatgcatgtatatatgaagaaattactgctattaagtaggagatcaagatttaaagttcatatatattagacaaacaaaaacacttctttttcctaaaaaaattagattaatagttctccacacagacgtggtaatagtcgtctttcaaaagtttatagcttaaaccacaatccctgtttctttttttttaacaagttctcctagcttgtttagcagccggttttctgaatctaatcccatcttgacgccttgacgtgtactagtagaattctagctcggacaccggcggca

SEQ ID NO: 55915 - DNA, 1703 bp, Oryza sativa
agaaaatcaaattaacttcagattataatcgatagatcaaaggcttaaaaagttgtggtaggcaggtttcccttttcttttccatttctgccctggaaatacatataggattatatcacaagattaattgctctcatccttgagaacggctaagtgaagaagatccgacatacacgagagcatttcgacgttcacaagtcattccagtttcatggcagcaaaataaccagcttatttactactactacacaagaaacctatctatatccatgttacatacagactgcacaattggccgctatatggactatctacagttctatattaacaatactaccaaaacatctggtgcatgaaactagaatggtacactgatctactgaagaactgactcagctatgtggtacatgcagcgcctgcaagagcaacttcggtggacgggctaggagttgacaacctgaaaacctgaaaatcccactgatgcaggagttgcagctgcgttagcgccaggctagcatgtggctgtcctcagcagtgcggatttcgctgaaacttcaatcggtctccagattatgctttccatcttgttgcacaagttcttgtagaactgcaatgagtgtaaatctgagttagcaatcgttccggatggacgaaaagttggatgttgcaccttcgaatgagcattttgacacattgtgtgaaagttatcagtgtcagtcaggcagtgtcagtcatttttttagatttatgaactagtctaggcaatcatgctactatattcgattaggatacaagacgatatgtggaaagacagaccctgtggtattccagtgtgtcaccagcaacctttcgaacatcaaccatgaacagagaaggagcaacttcgaaaacctgcgaatgatgcatttcaaagcataagacagcatgaaaaatgtagtttgtgaatgacaaacagcaaaatgttgttccccaacaaagggcaatgtaagactacctgtagaacaacagcaaacgggctcattctgtttgaagatacaccttcaagacgcaactgcagaaaagagttagcaataagtatcattacatcaagagtaagaaatgagttgcttgttgaagaaaatgttttgtaattaccttgtaattctgagagtggaccttaagacccatagtctcagcaacaacttcaattgtagctactatagtctttgctggtttccttgagacaaaacgagtttgacgtttgacaaactcctacaaatataaaacccatcattattgcaacatgagcactccatgtgatgaaagttgcatcagacaacataagttattcatgaggactgcagttaatgcataaagcaaacaccaaagttattcatgacgtgtggcacactatgacgtatggtccacgtaaaataaaaaaatacatactaaacatgtctaggaagatctaatgtaagagcacaaacattgaaaagtgggttcttctttctgctatacgagaacattgcaactagaatgaatatatggttggtgtggtcaaatacttcacaaactaaacaggtgcaatttaaaccatggagattagctaagaagcaagcaatcagatgtttttttctccttttatgcagggtttccatttccattcaaatttggcaaaaaacagaagccgtctgccaccaaccagtacactaagcgataagaaa

SEQ ID NO: 55916 - DNA, 1171 bp, Oryza sativa
tgagtagaacgattatgtaggtgttcacatcaacaatttagggaaagaaagacttatgctgcacacattagtaatgaagccaataccttatcatacagtgttggaagatcatcttcctcaaaaggaaggtatccagccatcaaaacatagagaataacaccacatgaccaaacatctgctgcagatccatcataaccattgttgctaagcacctaaaacattgacacatggtaaagcgcatatcatatatgtactaaaaaaatgcccctaatcttgtctaaggaaatggcttgaaatgcccatatcacaattttatgaactagttcagacaattaaaatcacaatagcttgaacatggtgaaataagacagctagagatatttatttagtgatgatggcagaaatatgcataaaaatgaggtttagaaccctgaagagaactaaccaaccaaataactgcgagacaggtagagaaacaaagaaataggtaatctctttctagtctaacagacatttgtatcatacatacaaatatgatctataaagaaaatctaggaaaattgaattgcatcccgagtaactcgtctaattttgcagacatatttcttgcatgtagtgtagctaatcaattagctccttgccaaaaaaaaaacatttcgtacagttcaatttaccatgcattgagagatagagagagagagagcatcatacctcaggagcaacataatttggtgttccacaagttgtgtgaagaaggcctactccctgaaatccctcaaaaaagaaatcccaatcagaacacttctaggatagaaatacagcatcattaaaagcaattactgagcttactttctgggccaaagtgctaagtccaaaatcagaaactttcaagtttccacgtgagtcaagaagcaggttttcaggctacataacatgcccaaaaaaagggtaagcatgagatattgcacctagtgaataggacaaatgatagccaagtgtctcttatcagtaacggaccttcaaatctctatgatatactcctttgctatggcaataattgatggcatcaataagctgctggaagtacttccttgcttcattttcacgaagcttcccttggcgagcctacagatatttgatcgcataggttcatattttaagaaaatgcaca

SEQ ID NO: 55917 - DNA, 1530 bp, Oryza sativa
atgctgatggtaacaatgttgcggatgatcttggtcagatgttgcaggacgccaaggaggattgcgaaagtgaaaagggggcccataaattggacaagatgttagaggaccacataacatcgttgtacccaggttgcgagcaggggcacaaaaagttggataccactctggagttcttgcaatggaaagcaaaaaatggtgttagtgacaaggcatttggtaatttattgaaactcgtcaagaacattcttccggagggaaacaagttgcccaagacaacgtacgaggctaagaagatagtctgtcctctagcactggaagttcagaagattcacgcatgtccaaatgattgtatcctatatcgtggtgaggagtacgagaacctagaagcatgccctgtttgcaaagcactacgatacaagattagacgagatgatccaggagaagttgacgggcagctaacgaagaagagaattcctgctaaggtgatgtggtatttccctataataccaaggctaaggcgtttgttcaggaacaaggggaatgctagaatgatgcgatggcacgctgaagagcgtcaacaggacgggatgctgagacaccccgccgatggttcgcagtggtgaaacatcgacagaaaatttaaagactttggaaaggacgcacgaaacatacggtttggtttaagtacggatggcatgaatccttttggagagatgagcagcggccatagcacttggcccgttacgatgtgtatctacaacctccccccgtggctatgcatgaagaggaagtacataataatgccgcttataattcaaggcccaaagcaacctggtaacgacatcgatgtgtacctaagaccactggtcgaagatcttaaactgttgtggaagaaggaaggtgtccctgtgtgggatgaggacaaacaggaggagtttaacctacgagcgctgctgttcataaccatcaacgattggcctgcacttagcaacctatccgggcagtccaacaaggggtacaaagcttgcactcactgtatggatgaaacagaaagtacgtatcttaagcactgtaggaaggttgtgtacatgggttatcgtcgattccttgcagcaaaccacccggtacggaagaaaggcaagcactttgaacataaggaggaccactgtacaaagcctaaacatcgcagcgggaaaacagtgtttgctatggttaaagatcttaaagtagtgtttggaaaggggcctggtagccagcctatagagagcgaagatggtcacgcggcgatgtggaaaaagaactctatattttgggagttaccctattgggaattcttggacgtccgccacgcaatcgacgtgattcacctcactaagaatcttgcgtaaaccttcttagcttcctaggtgtatatggaaagtcgaaagatacactggaagcacgtaatgatctgaagcatatggaacaacgcggtgaccttcacccggaaccaaaggagaaaggaagccattacttgagtccagccag

SEQ ID NO: 55918 - DNA, 2325 bp, Oryza sativa
ttttcaatataagacgcatctgcttgtcaccttgtcaaagagatcggtattctcggtccttgtacctgcacaacatgtttcctttcgagaggtacatgggcgttctgaagaagtatgttcgtaaccgtgctagtccagaggcaagcatcgctaaggggtatggaacagaggaggtcattgaattctgcgtagaatttattgaagaccttcgcccaatcggggtacctgaatcacgccatgaagggagactacggggaaaggggactctcggaaggaaagcaataatgacggtagacaacaatttattccgtaaagcccatttcacggttctgcaacaatcttcattggtggctccttacatcgaggagcacttggctctagttcgcgcaagaaacatcggtaagtctgatgcatggattactaggcatcacattgatactttctccacgtggctgcgacaacatctcatgggtaacgagacgattaaccaacaactggccttcctggcgaggagaccatctggctcgatcgcgacattccagggatatgaaatcaatgggtacacattctacacgagggcccaagacatgaagagcacgaaccagaacagtgctgttcgtatcgatgccatgggacacgatggtacaactggcacgtattacagtgccatcgaggatatatgggaacttgactatggacctctcaaggtccctctgttccggtgccaatgggttaggttggctggtggaggcgtaacgattgatgacggtgggatgacaacagttgaccttaacaaggttggatactcggacgaaccttttgtccttgccaatgatgtaacccaagttttttacgtcaaggacatgtctagcaaaggaaaaaagggcaaagggcctgacgagccgaagcgccacgtggttctcccaggaaaaagaaaaatcgtcggagtagaggacaagactgacgaggattacgatcagtttgatgggtaaccccctttcacggtgacgattgaccctagcatcctcctatcaaatgaagacaccccttactcatgtagcgatcacaaggaaggaacaatagtgaggagaaagtacgtgcggtcaaccgtcaccgccgatgtattgcagtaattgttctatacacgatgtaaactatgttggatgtactgaatatccatacaaatcaattgttgtatagcatatgttaaatatgtatgattattagaatttttatcaaattgaaatcatccatatgctagttatatatgattattagattttttgttaattatgtatgattattagaattttaatcaaattgaaatcatccatatgctagttatatatgattattagaatttttaaaggttttaaatcatgcacgtggtatttacatatgttaattataattttcaacaatttaatatcatgatatgctagttatatatgattattagattttttattaaaatcatgcatgtggtatttacatatgttaattagaattttcaacaatttaatatcatgatatgctaattatatatgattattagattttttttattaattttaaatcatgcatgtgctatttacatatgttaattagaatttttaacaatttaatatcatgatatgctaattatatatgatattagattttgtattaattttaaatcatgcatgtgctatttacatatgttaattagaatttttaacaatttaatatcatgcatatgctaattatatataattattagaatttttaataattttaaatcattcatgtgcttattatatccacgtattctactacatacaacaataatttttcgaaggttttatcattaattgttcgactttaaataattgtaatgcattatttactattttagaaacacatatgcaatgaaattcaagacacagctgctattatctttagtcccggttcctaactctaaccgggtttaaaaagaatttagaaatagcgagaaaagatctttagtcccggttggtgagaacaaccgggactaaagaatatctttactcccggttggtaacaacaaccgggactaaagatccgggggtatatatattcccggtgcgccctcgtcttctccaccaacacttagacattgttcgatctcggcttctcattcgccgccaccgtgcctagggcaaccccgcgccgacaccgccgtcgtctctcgccgtcgcttggcggtcctcgccgcctccgccgcagacgccgccgccgcatctcttgggtgagagccgtcgccgcctctctctctctatctcgatctcgatctctctctctctctcc

SEQ ID NO: 55919 - DNA, 1360 bp, Oryza sativa
gattacgaaacgtgaacgaacgtgcacgaaacgcttacgaacgtgaatgcacttgtactaaaagtgtgagaatgaacgcgtttatactaatacgatttactggtaatacatatatgattatatatgtaacttggcccgtttagactaatacattttcctggtaatgttgcagagaagacgtcgtcgtcgtccctcaagccgaagtggtagctagccatcgaaggaattcgcgcaggcaagtgatgtaaagaagtgattgttagatatttaatattagattgttagacttagcatatatgattattacaattttaatataagattgttatcgatttaatataagattagtagcgatttaatataagattgttatacttagcatatatgactattacaattttaatataagattattagagattaaatataagattgttagatatttaatataagattgttagacttagcatatatatgtatgattattacaattttaatatgagattagtagccatttaatataagattattagacttagcatatatgactattacaattttaatataagattattagagattaaatataagattgttagagatttaatataagattgttagatttagcatatatatatatatgattattacaattttaatatgagattagtagccatttaatataagattattagacttagcatatatatatatatatatatatatatatatatatatatatatatatatatatatgattattacaattttaatataagattagtagcgatttaatataagattgttatacttagcatacatatattattattacaattttaatataagattattatagattaaatataagtttgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtatgcacagatggctgatcgcgatgaggaacagatactatacgatacaatcgtagagggaagcagccagtactggaacgaaggagaggggaacgaggatccaaaccagtacttgaacgaggaggggaacgtggagagggatgcggaggggaacgaggaggggaacgatgaggaggaggctagtggaagtcatccctctgctggacagaagagggcacgcggacaacgaggtgccgcgaagaagatagagggtcagcacatcataactgaggatggacaaagacggccgacctagtgccccgacaggggcagc

SEQ ID NO: 55920 - DNA, 4260 bp, Oryza sativa
aaagaaaggaaaaggcaaaagagaaaagaaaagaaaagaaagagggagagaaaggaaaggaaaaatttagggggaaatttaaaatatttaaaaatattagaatttaatcataggcttaatgaaaatatagctagataaattcttgctatttaaatacctaaaatactagcatttaattataggatcaattatttaagaactaaacaattagatgaattcttatagattattatagattatttttagtaaactctataagagattaattcgcggtagtgatctagatgtaattaaggactagataattagataaagtcttaggacatgactttaaatcacaaaatttcttaagaaacacaaatattttaggtagaagaataattccacttcgcgaataaagtagcctatatagaattcacctcccgcgctcgtttctcaattcggtcattatttggattttgtttgaattctaatcgaattcaaattgttcttacgcacgtaactatagagaccgagggagccgcggatccggatgaagaccaagacccacaagacctagagcaaggcaagtcatcactattccttgaacatgttgatcccaattgcaaaattgttttgtttacaaataaaattgcatgcaatgatgaacatcctacttgtgattatgccatgccttgattattgtttacccttaaatccttgtaaccatgatttacgtaaaagtccctagtcaactatgataaatgcttagaaatgctactctagatttatgcatactcatatttatcaaatgctatatgcttgggcaattatctttgggaaggtaattgagatgcggcatgtggagacatgagcgccacattgccatgatattgatgacatgatttgtgaaaggaaaatgaaactaaacaaatgatttcgactggggcggatggaggatttgggtggtatccggaaaaaggctagtgccatccctggtcaattaaggaccgagccatgaagttaagcatgaaacgaccctcgtacaaccgcacttctcgtatgggtatagacctagcggaatagatagctgagcggaggcattatccatgcatagtggtttcttgatgtgtgaggcaggggctctacggtggggcagccattggtagaaccgcgaggcgggtgtctacagtggtgtcgccatcggtaggactgccatgagagaatttaaacataattataacttaatgtatgtgtgagtctttctttcccgggtgcgccagaactcctctcactgctagaaaccgtgtacgcctagagtgcaagaggatgtaaagttcatggagcgggtactgccaatgcgaggttatcaaaaagctttgtcgtgatgcgtctcatgtgttgggacgaggctcatgtgttgggcagtcacggagtgcgggtaaagtgtacatccactgcaatgtgagtaaaccaaatctattcgaatagccgtgctcgcggttattgagcaccgggacatgtattacacttggctagtctctaagttattaacttgtgtgggatgggtagttgcatgatgaatttatatgctgttggagccacttcctgagaagggggaaagtgggcgtcctcagaaaaccataacgattcaatggcgggaagctatccttgggatcacaatggatggtggacagaaccgtcattgtttgaatacaaacactggtactaaaatttgatcagtcaatgctaggtctgaggcttgtgaaaagaattacaaaactggctttacgcaaaagagccatagccatcctttgaaatacccctttcatatgcattgttgctgtggtggcttgctgagtacggttggtactcacccttgcaattataaaattaatcagaagcgggaaatgaagcttcggaggatccctatgcctactaccaggagggagatgaagacgatggcgctcagtaggtcttagtacggtcgttgcctgtggcaatggcatgccgctgcctaaattctgctgccttatctatttctgcttttggatgtattccggaccgctcggtccgatgatttaagacaatgtctaaggtcttatggtgtaataattagcactagactctcgtgtatgtgcatttggtatttcagttatgaactcgtgtgtaccagactacttgatccagggaaatggtactgtttacatgaatgattcctgttataaaaacgggggtctacacattcatcctgcaatggtcagcccatcaggcaatcatagcagctgcgcctcaatggggcaggtcggatcacagagcatggacgccatgcaaacccagggcgaaaccacctgccccgttgatgagatcacgcagcggacaccatgtgagctgcatattcccttcaagaacttatcaatcaaggtatgctcgtagtttgatgatttttgacttgtacattccgcaagttgctgcttaggttgattactaatagataacctctcatcacgtgaaggtggcgtcgggaatggccatcccaacggacccttccgggacttaccactgcaggccgattccagcaggatactcgagggtcgaagttgagctggtggaagccgcgtacgaggacctcgagttgaactacccaggaggagacggtgagacgcatctacgagacacaagccacgccatcatactatggcgcaagcggtacatcatccttcctgggtgacaagcggcgtctcgtgcaccatctcctccggctccgccatctcctcctgcaccatctcttccggttcctccgccacgtcctcctgaaccatctcatccggctcctccgccacctcctgctgcaccatttcctccgactcctccgcctcctccgcctccaccatgtcggcttgcacctcccaagacaaggtctcgccaagctccaccgcctgcccacacaagggcaacgaagaaggcgaaagttgacgccaccaaaaacaaggagccaccgtacgattgcagtcaagaggagcttgatgcttatgtggcaggagaggtgaagaggcaactcaagcctcggagtcctgaaaagaagatacctattgacccgagcgtgaagaacttcttcaagggaatgtccacaacaaacaaggaggcgttacagatatcggactatgaccgaacacttcagagagcctatcacaagaagtccaaaccagtccctcagcttggagaacaaccaaaccaagaggtcgagccattggtgaccggtgaagattttggcataacagaattcattgcagacaccggtctaactgtggatcagttggttcgaggcgcaccaatcccgaaggcggaagtggcatacaagtttgaactcggtaaaccgcttgtcaaacctgaacagctgcagtccctaccgacacagatgtacaaattccatgaacggtacatggaaatgagcgccaagggtagagagatgttcggagcgaggatcagaaaccccgacttcttgcaaggagaagatgttctctggatccatttcaaggatctcttcgatctgtaccagttggacgccctcgacgtctctcttctgagcgcatggattttgtgagtatctttgagttcgatttgtttcgttcaataattagctcctggcatatatgtaagcaataatactttcctttcatcgttgtagaatggagattcgaagggcccgacggcggagggtctacgatactgggttcatcgaccctcggaaaatcaacaccgaaatgatcgacaagtacgagaaagacacagaggacaatctcgtccatctcctaacgcagcagcatttcaagacgtacatactactgccgtacaacagagagtgagtttttattgtcgttcgaacaaatttcgttcccatacatatagcatgtacattttcgatcatatatatatatctcatctcacgcatattccagattccactgggtcctgttattcttcgacttggacgcatgcagagtcactgtgtacgactcaatgaataaagaggagaagatttttgacaaggtcttcaaactaatagacaggtaatataatgccatctattccaaagtcgcggggaatctattgctattatgttgatctcaggtaataattaatcatagcttgcaactgcatatgtagggcttgggatcggttccgttaattggtccgcgggacttggaaataaaaacttggacggaggtttcattttccagtgaatacatgcatgatccaaaattatattgaattaatctc

SEQ ID NO: 55921 - DNA, 7158 bp, Oryza sativa
atatatatatatatatatatatatatatgtatatatatatatataaccaaccatgcagcaaacagggccatgcaaaaaaaaaatggtgcaccgatctttagtcccggttggtaatataaaccgggactaaagatggatctttagtcccagttatttcacccgggactaaagatagctatctttagtcctaaattcgtagtcctggttggataaccgggactaaagggggttaccaaccgggactacagacggtttctccaccagtggatcgtcgtccttgaggccctggcgatcgtcgtccttggcgcaactcaagtcaaagacttcgcccctaatcaattaatcattgcactagaaaagagataagggacgaaattgaggactggtaaaggatttttggaggacactcagtttctttttgatttttttaggtcctttgattcatagaaaaagataaaagtttttgtataggattatattcctatggtcaattttataggaaaaataagtaagagattagatctcttcaaaactttcatttggttcatttttttcctttcgtgcagtcaaaggacatttcctcctgtttcctgtgttttcacttcatgtcggattgaataagcagttacttcaatttttacggttttttctatatccatatttttcctttcctgtggttcgaaggggctctaagactttgatttatctctagttcttcatcacaaaatgtagaggggaaaaaaagacttttgaccttagtttcttgacgtgctacttctacgagaacctaaaacacacacaggatatacaaataattactccatctaatcattgttttttttaaaaaaaaagagaagaactttgcagtatttcattgatagtgaagatagagcaacatcaacatgatcagaaaggataaatcaccgtgtccgaaaaaagatcaagaataaacaccaacccaacacacaacacctcacaaagaccggaatatccctctagtaagtattcccaatgtcatatatctatgacaagtggaggtaatatttgataatattttttaattacacgagtatatgtgggaacacacatggaaacaaacaaaaatgcagaattattttgtaccaacatttttcattttgcccctgagggattttttccatcttggctttttaccactaaggtgaaaattagtcatggtttagcctcacatttgcatttgccctttggcaaaataaatagacatagtgaatgtttatattagagtgtcatatatatgctattttttatggataagacttctgatactaatttaacagcaagcgattttcgtccaatccagatcctcagtattgcagactcaatgtggggctgaatgtggggctgagggtctgtaaggcccatatgtcagtgagcacatgcagtactgcaggagccgcatccattttcatcaccttgactcttaagacgtcaaaagcaactctacaaacaaatttaatgagctttaagatgcatttgtgaaatggggagcctaaagagtctacaactcgtccataactttagccagtaggaacagtacaactgaatggtatttctttaattttgtcttccttttctgatattaattttatcggaatatattcagggccatatagtctttgaatagtcatgtttttttatttaccaatcactttttaatatcgagattaatatcaaacattcacatatactcttttttgggtgaaacaaatagtatttaattagagctccctttaaaacatagaaataggaaaaaaaaacataggaaccaagtgacatagattttaaattcctacaggaagataaaccatatgaaagtactttaaggtcccgttcgtttctccaactcatgagttggatgaaaaagaagatttatgtgacacatttttcaaactgctaaacaatacgtttcgtacaaaaactttctatatgaaagttgttctaaaatatcagattaatccatttttcaagtttgtaataattaaaacacaattaatcacgcgttattaccaccttgttttacgtgaaatacttaatcattatcttcatcttcatcttcatgagattcaaacaccatctaaatattggtgtttgattggaacacataagaaacataggattgcaagagacaaaagattgaaaacatgaactaggacctcttggccttgtttctctgaaatcaccatataattgtccatttcatataaatttcaaagaaagtgataggatttaatcctttgtttcaaaggctctcataggaattattttataggattaagaatcctccacttcaaagcggccttcaaattgcactttgatgaatctctaccaatgttaaaaaaatctaacggcctagagaagcacaaagcatatctagatgaattgtggaatgcagaaaaaaaaactatccctagagaattattacagtgtttgtagaatgaataattatgaattacaaaattatagtttggttaaaaacaagaaaactactgagaagcacaaccttaaaaacaaaaatctccatctaaggttgatcagaggatgcataactattgtttgtaccaacatcttacaagttgtatgttgtagttatctttctcaagccataaaaatataatcttcgaaacaagtaagtaaggaagccgtgaagacgattccaggtggtggcaatagtaaaaagaatataggcatatgagaaacacaatcatatgatgctgaaggttcaatatcacattaaaaaactacatatttaacaaaactacagatttgaagtgttgtatcacaaaactacatatttaacaacaaatttatcatggaactacaaatttaaggtagagtttcacaaaactacatatttaatactatctctgttttttaatagatgacgccgttgactgtttgtcacacgttttaccattcgtcttattaaaaaaattacataattataatttattttattgtgagttgttttatcactcaaagtactttaagcatgatttatatatcttatacatttgcataaatttttgaataagacgaataatccaacatgtgtttaaaagtcaacaatgtcatttattaaaatacggagggggtattaaagttatcacaaaacttcatattgtaaagtttcaatcactagcactgtcgttctgttggacattgtagttttgtaattaaattgggactgaaactatagtattgggataaatttgctacttaatctactgttttgtgaaactttatcttaaagttgtagttctatgataattttttttttgttaaatctatagttttgtgatacaccactttaaagttttgtaaaattttctcatatcacaaattaagaagacaatttgaactagtgatatggttcacaccagtttttcacgaaccatttctggttcactttgtttgtgcactgtcgatggttatgacccctacaattatttctatttattctaaaatgtttcaaatttcagaatacggcgagaagcatccttgatatggcatggaattgtaggggtatgactttattcatcgggttatatatatacaaatataagtatggttttagcatatcaataaattcgtaactcagagatatcgctaatctcgacatggcgatcaacgtgttaagacgacgcacttgcagtttgtgagtgtgtatacatgttgagtcgtaatcgaaatcgaaaagaaaaaggaaagaaaacaattgacgcttactgtcatcacagccattactgaagtaccgatcatgctttctactcattcggagagatcacaaacttttatcgcatcaatcatcatcaaccgatcgagctaatcaccatcaagttaaaaagcgagaggacaataggaggcatcaacaccacaataacaacacaaaagaattaaaaagcgacctctcaaacatgagcaaaatctttttctgtccccttctttttcaggtcatgcaaaagtaaataaatagaatacttcttccgcattagtttaaacttgtatctttttttaagcgcagtaattataggcatacaaatttcttcaccataatataatcatctaaaaccaatttatggcaaaaggaaaaagctagaattaaccgtgccaattattagagaacgcaggtggaagccttaaataggcaagcagtcaggcatttagcagcgcgctgcgcgcagcagtgaagccatagcccaaagccacaagctaaaaattcgtagttgtttttttaataacatcactattaaatatgtattttacgatacggtattaaatatatagttttatgtatttttatgatacggtattaaatatatagttttatgataaatttaatgttaaatatataattttgcgatatatcattttcaatctatagtttctgatagtttaaatggagttcactaaaatttattaaaaaccatgagtaaattttataaaactacatatattttaaattttaaatttgtagattttaaattttaaaagtatactgtaaaatttattataaaccatgagtaaattttataaaactacaaacctacatatttaataacaaatttcgcaaaacaatagaattaaaataaagtataacaaaattcccttgtggtgaaaccagtctatccgggtttaagttttagacttaacatgggtgctcgtatttacagctaattatttttttagtggtaagtgatgtactcatcgacagcaagatgtctatggacttcatcaatctcaagatatactggtccagtcctccgaagatgcttatagaggtagggtatgtgtgtatgtgtttatagacgtgagtgtgtgtgcgttatgggcacctggatttatactacgcttctcaaaaaaataaattataacaaaattgcagatttagtaacaaaattattataaaactacaacattttataatttggagataaaattagtgctaagagtttcaactttgaaatctgtagttttgtaatagcacataattctatgatactccgcattaaatgttttgtgaaaaaaataatcttaattttatgatatgacgttttattctgtactatctccgtcccataataattgtatttctaagatttacatgtgtcacaaaataattatcataatagagtactaattgtctcataatcacttctcatttaaatttatttctattttacccttaattgtccttctattcttacctatacaccatttaatgaggggtatcgtaatctcaaatcttaatatatgctaatcaaaaccatatatcgaaaccatttattatgttaaatgtcgattactccctctggttctataataattgatgttttagataagattgaagtcaaacttttataactttgactatccataactttaaaagtatttagtttaaaaaacaagaacaacatatataaaagtatttagtttaaaagaacaagaataacatatatagatttgtctttcaaaacactaaacattcatttatttattacatatattataatagaaaaataaggtcaaatatatgttttttagatcgtgtgattatcaaaatattaattaaaataaaatcggagggagtattatagaacggagggggtggaagcccataaataggcaagcagtcaaccagatggtcggtattcaggcagcgaagcccccccaaagccgagctcgcgcgcggcggcgtcgtcgtcttcctcctcttccccccgagttggattcgtggccgcgcggcggatgggaggggaggagggaatggcggcggggaggaagaagcgggtggggaggtacgaggttgggcggaccatcgggcaggggacgttcgccaaggtcaagttcgccgtggacgccgacaccggcgccgccgtcgccatgaaggtgctcgacaaggacaccatcctcaaccaccgcatgctccaccaggtaattcccccgcttctcctttcccgctaccctccacatccgcccccgccagtgcacgagtccaaatcaaactcctcgcactcccccctttgctttgatccgggcgattctttttacacttttttttatttgggtgctctccgctgctgctttgctgtttgccaaatggtgagcagccgcgcatcgacgagggcggatggagaatttccgaatatacctcgacagcaatgcgcaccactggttaattcgtgcgagttgcgcgcagctcttgccgtttgatgattaagaataaggaattaactggagagccttaaatttcttgttctcccaaaggggaaaataccttttttttaaaaaaaaaaaagaaaagaaagaaaaacttaattcgagcggtttgtttggtgtttcatctcgtttgggctgacagaagctcagttgcagaattgaaatggttgggtgttgaaagtgattttaccaaaatttggtctgttgtagcttaattcgatttgcggtgtttgcagaaatgctacaaatagttggttcatatggttatccaacgacatcttttgaggatgcatcttgttgcaaagtgctcaagttctctaattatagtggtgtaaatcttttcctaagcttcctgatttgctagttgctatggaacttggtttctctccaattgtgtttgcaattgcaagtatatatttggtttgtttaatataactgttctataatcctaagcctactgctatgccatgaagcttggtttctctccaattgtgtttgcaattgcaagtatatatttggtttgtttaatataactgttctacaatcctaagcctactgctttgccatgaagcttagtttctccccaattgtgtttgcaatttcatgtgtataaatttggtttgtttagtttaactgttctgcaaatcaatgatgaccaccagttttacctgattttgctgtgagcacccatttcagatttccagtttatgcgagatgtactttctttgtgttgtttatgcaatatcgctaatcatgataacaaaaaaaaggactaaaccattctaattcggcattagattacgaactcacttctcatgttacttgacagatcaaaagggagatatcaataatgaagattgtaagacaccccaatatagttagactaaacgaggtatgctaaat

SEQ ID NO: 55922 - DNA, 1801 bp, Oryza sativa
aaaaaacggaaggaaaaaaccgaagaaataccgaaaagatacaaagaaaaccgaaaaaaatcccacgcgcggcgcggcttctgccgccctcctcatccgcgcggacgtcggcgaattagcaatttcgggtatttttgctagtaattaataataggtatactatatatatataatctcctagggcttagggttttaccttaatttccttctccaactcgatcgatatatatatatatacacaccctaagccccggcctgcaacaaactacaccgatcgaccaggcgggcagcgagagatgatgcgcccctccggcctcctcatcagcggcggctccgtagtcgtgcggccggcaaccatggctgcgcgcgccccctcgcggcttccgtccgtcgtcgtccacctcccgaggtgcaccgccacaggagggccgccgcactgcaggctgacagcggaggcatcgtccgtcctccccaacatgtccgtagcgtccccatgggtcaacgatgacgacctcaccgaggtgatcgatcgatctcatcttcgatcatgatctcttaattctttccttcgatcatgcaatacaaatacaatatagaaaatccatattgattattctctaaattaatttgttgtttaatttcttttgctgccgatcgattactcgattaaattagttaggcacctgctgatccatcttgctaacttcataacttaaactaaaattgttgcattttgttttcgatgttccgttgaaacaactaatatttctatttattattagtttaatagtatatccttcatcccaatttgatcatcccctaaataaaaggtgcaaagacaaggacaataaaattttcatgtttttaaattaattatcaccaatcaaggtgctccatatatccagtggatattgcatcacactttaaatgttgcatggaattgcactaacagtcgtagcatgcatatggcttcatgcatgcattccattcagcgatgcccaattaccctttgcataataaataaataaagagacacttattattatatgataattattttaggaagacctcaaaatcgttaggtgatgatcaaattgggatggagagaatatctttagatctaatttatttatttgcttgtgtgatatattttcattattaaaaaaaatctgatttactcatatagagtcgtatcaattgtatgatatctatcgaatattatttattaattactccctacgtccctaaatatttgacgtcgttgacttttttaaatatgtttgaccgtttgtcttattcaaaaaatttaagtaattattaattattttcctatcatttgattcattgttaaatatacttttatgtatacatatagtcttattacatatttcacaaaaatttttaaataagacgaatggtcaaacatattttaaaaagtcaactgcgtcaaatattttgggacggagggagtagttaattatgagcataatatttacgtttttggcagatttccatctacgaggtaattgcgtggtctgcagaagaagccatggaactcatcaagcagactccacctccaccacctcctcctcctcctcctccctctcctccggcgacgcacgacgtgggccagccacctcctcctccctcccttgcagcgccgccgccggcgcagcacgacatgggcaagctactccgcatgtacgcgcggctgctccgccgcctggagtcgcaggccatcgacatgtacgccggcagcaggaggctggtggagtaccacgtcatggcgtggggcgcctac

SEQ ID NO: 55923 - DNA, 3477 bp, Oryza sativa
atctttggctgctattgtgacttatatgttctaaactcatccaatttgttagtttggagccctttttgaaggaaattttatttatcttagacaactaataagacggtataattagtgcaagaccactctcaatctgtgcacgcatcatatgaattactttctaagaaaaggaaataaaaagacaagacaacaaatatcataccgtccgaactataaccactagggatcatcatcctcggacaatcaaaacagctcttctaaaacatcgtctctaaaaaaagaacaacgtgtgtacgtatcgacattgccatgatccaatcagtaaatataccataacataggttgtagttacactatgaagaaactcttctaactctatataataccttcaacaagctaggaagcaaataaacatgcatgccgccccaccattccaaggcggttcttccataccccgtacacttacaagcaagcaaataggcacactgctaaaattcatgctcttaacaagcacgccaataggcacatggccaaaattcatagggtccatctaaagagagagagttattgttagtgtaagtgatgcatctaaatagtggaagagttattatcagtgtaagtgatgagcaagcctataggcacatgcattcaaaatttgtagggtccatccaaagagagaaagagctagatctaaagaaacaaagagtgagtgttgtcggcataaatgatatcataatttgaaacaagatagcttcgacctacatgatgatataaaagtcagtaactagtgatgaagatgtgtcacaatgagtaactgcacctagtggagagaagggcttaggcttcactgccacctgcgcaaatacaatcactcccaccgttcatagatcaccactgcttaaaaaaaagtttgtgcggggcggtcaagaacctgtttacaatggtgttttagacccgcctacaaccaaggccttgtaaaaatcacatgatttgggcagcgaaataacgaccgctcttggaaatcaatttccatggacgactcccttaagtttaaaggacttgcccatgagaacaaatttctagtttttgaatttgttggtgaaaaattccgtaatttagtagacacagcatattaaatcatactccatccgtccaaaaaaaactcgacctagggttacatattctcttttttttagggggggggggacggagagagtatgccttagatataatggctataaccgaaatgagagagtatgccttagatataatggctataaccgaaatgtagttgcaacttgcgagatgatgcaacagcctgttaattgaatgacaagatgcagagaaatcgggcaaaaaggcacacatcagcacactcgagatgatagtactaaagaaggaagacgtatatgtgaatccgtcttcgatcatgtgaaaccggaagcccaaaaggcacacatcaaaccattttcaaagatggaactgattgtttatgtcgacaaatccttcgcacaatttataacagttgacaaatccttagctcaatttaggcatcacatagttcgttcaagagcagcattcctcatcttacccaataagttatgttcacggaacaggagcaattattagcaggtaaaacaaggagcatcgcctcgtcaggtgcaacaccaacaccagaaccggagctaccaatgtcccaagcaattagagcattcacttcccttcaagttgtaccaattgccacatgacgacaatagtctttgattaatcaaaaccaatgaatcgaatatacaatttcagcatattctagcaaacaatgtaacattaatgaatcgaataagtagccgacacaaacaatggcaacattcagttcaagggccacatttcctcggggagcaaagcatatagcacacaactccacggtaagatagtaatagcatacgcagccacaaacttattggacgatcttgaaaggcatggttattgcaaaaaggatcttcttggttctctcactggttgagatcaaaatcaataacacgcacaaactctatgcaagtcattcacttggaaaatcaggtatgtcacaggcaccgggcatgctcgcccaggggtcctcaaggtcatgttcatcgccttgacctgcagcagctagattggtctcatcagaaagacccccatgaccgaaagcgtcatctgcatctttggcaaactgctcatttgagggcggcaattcttcgttaaactggcaataaactggcaaattcggttctagtgatacatcgtgcctccagaaagtagggtccaccaagggtggaggttggctgtcaaggaataggctgcttgcattattgttgatgccaacaaaagcatgacaacctgaaaagactaacagtaagttttatgtgatattgttcatgttaaaataagagtgagtacacttactgttctcgaggagatcatcaccatgattggaaaggaagaactcagagagaaagcattcgattgaatcacttgattgcattgaacacgaggaaaacaagcatcaaaagatccttgggaatttgcaagttccccttgtccatgtcctccatgaaccaatgcatccagcagaccattgttgtttggagagagatattctgatctcagggagccaaagtcaacctggtcaataggatgtcctaaggggtcgtgatatgaccatgcattattattgttaaagtcatagttgggatattggagtgaagggagctctacattcatgggcctctgtatggtcccagaagtagagaagttgccatcaagaattggatgtccactgacaatggcactaccaaaaggtactgactgatcttgtgtggcaatggcactaccaaatggacttgtggcatcaactggaagagaatttggagtcacacaatttggccgaatataattttctggtctactatagtctaaattatcgaaaaaaacctctttgtaactttgaccatttccctgtaaaacctcatttgttcgtttcttggcacgtgattcatcagggctttcacagttcatcacttccagatctgtcaacttaaaatgattaaactccttcggatatagaggttcaccagttctctgaattctcttacatctagtgttccagaagttcttgatttcattatctgtgcggcctggcaactgcaataacaacaacagaagttcagatatgcaagttaacatatgatctaataggatttttctaggcaattagactaaagaaccttaaggcattagcctaataagcatttgcattgtacctcagatgttagaatggcaaatatagcaagatgtatcatggtgttgcaatagttggagaggatttaaacatacctaacgaaacagtgaatgatattgtctttacataaatgaaaatatgatgaagtcctattcgatgaacaaaactcataggatttcagtaggaggcaggaaaggaac

SEQ ID NO: 55924 - DNA, 1739 bp, Oryza sativa
agcatataaacttcaaatggctataacttggccatttgaactcagaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttctgaaattattttgatttaaattattgcattatcgctttatttaaattcccgcgttatcactgttttatttagccatgcctattacctttgttacgaccttattatttttattgctattattaccttgttcaccctagaataaacaaaacccccaactagtggacactctatttgtggtatcactagtatgattttaggtagatgcttcgctgattaattaggtaacattaggtggttttaaaaccctagactgtggtaatattcatatcacctggacactggaattgttggattattgtggaattggattcaccccgccccctctattcaaaactctcaaaatggttttaggctgggctcggggtgcatggttttgatagtcgcacctcggccatataaggaccggtcttcgggcctctgttgcaaagcaccaccgtacttccacatgtctaatgggtaaggcttagtttgtggctcagtctggttataaacaaaagtacacggatggagatggacgaagtcgggggattcgatggacatctctaggacaaatgaaggctacacgagctgcggcccggtagtcgagatgtcatggcacagggttggtgccctgctgctaggggctcagtcctgcctacctgtcccgggggttccggccgtaggtgggattgggtcggtactcttgtctatggctaggatgggttgggaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattttatagctctaggatcgtgtttacaacatagctttgagcaactaagtgtcttttaatgctatttactgcaactcctaacccctatattataattccattgtactcctttgcaattatgctgcacttgtgggtgtgtcttgttgagtacggtggttgtactcagtcttgctcaatttttcccaaacccagaagaggagcccctggaagatgaaggctttggtgtctagctcgtgcctgccgtcaagtgcctgtggtcgtcgccctagtcttccgctgttcttcgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacg

SEQ ID NO: 55925 - DNA, 2076 bp, Oryza sativa
acatcacgagttggagaggtacgctgaattccacgctctttgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggctcggatgttgtcgacgttcctatctccgcttcggcgggaggatccttcgacatggagtcgccctgggttgtagccactgcattctcgtttccggccattggcggaccagctgagatcggcactgtggtgtaaaccggaaagacgatttcgccgacctgagtccacaccagtgttgttgaagtaggaactccttggttgaggttggtgttgacactgttgtcgacaaagctggatgtcatagtagtagaaccttgagcaccaagtccacctacctggcacgccactgtcgacggggaatacccgtagaccggatatagagggtattggggtacgctggtacgaggatctacgtagtacgacatcaagcaaacaggaaacagagattatactggttcaggccccttggtaggtaagagccctaatccagttgatatgggattatatgatggaaaccacagattacaaagggaacagtggaactcgacgataccgacaagatcgtagtcgagttgatccgactagatctcccagcgacttggctccgataagcttcggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttctccggcgatctccggtggccatggatcttgacaagtctacctccaccagtgtgtcactgaagaaactgcaggaggatggcgcccttcccagtcgcgggaccgcggagagggaagtaggaggtactgaaccccagcctgtcctgggtcgcatggttgcggttgaggactttattctctgcggttttcttcctccgccttctgaatttctccttttggtcttaaatttctatggtctttccttgctccatttgaaccccaactccatcgccttcctgagtatttttcacctttgtgaggcctacattggggtagagccgtttcttgacctcttccgcttttactatgagttacgctggatggaatccaaaaaggtgtccgggtgtgttggtttccgacttcgggatggcctgaagtcacgatacatcccctttcagtgcccctcatctcgcagcaaatggcgggggaggtggttctatcttcaggtagaggattcggatcctgccttcgttgttcctgaggagcagccagacaaggttccatcttggaccaccaaacctgccttgaccccgtccctccaatctttcatcgatatcgttgacgacctccgagaacgggggttgtcggggtatgaagttgctgccgatttcattggtaggcggatccagccgcttcaggctcgagcccttcc

SEQ ID NO: 55926 - DNA, 1254 bp, Oryza sativa
taactaatgactcactataatttaatgatggcttaatgatagttcacgatggttaatcgtgattagttaattaattaatgtgctaactaaaacctgataatggtgggttgtgagcacatggttttgttggtcgtgctcatgacaattaaggaccggttcacgagtttcggttgtgaaacattaaccgtgccaaccacaagctagcgtgggcaacggctttatcttttgtatagcatggttcattgcagagcaccaggttgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtgcccgcggttatgggcgggtctaacaatgtttttcgtgattagtctcacatttctcaccatagtaaatgatgctttatttggttataatttgtttagctcctggtttggaatggttaattcctggtttgaagattagatctgttcagccgggaatggttgttcagaatggttgggcctatacaacagggtatgttgtatagcgttggtttaatattgtttaatacttcactgttttattaaattctcaaatgtttactaaatgctgcttttgcaaaataaaaccctattatgccatcttcgggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtccgcgccgtttattttattttccgctgcttagatctttattgattgagaggaactatctacctctgtaataatattttattcgtttaaattagagtattaattgtactctattatcaatttgttattgtgtgcctcggctgattcctggacgagggttcacacacatgtaagcgtttggaattttggatagaaattccgggcgtgacaagttggtatcagagcttccttgaccctaggttatgccaaatggttacccatagaagccctctaaaaatgttggaaaaatagaactgttc

SEQ ID NO: 55927 - DNA, 3454 bp, Oryza sativa
gcggtctccgacggcggcgaagcaacggacgaggacggcggcgacttggcgatcccgacggtggccttcccgagcgacggtgacggctggaacggcggcggcgcacggctggagcgacggcggcgacggctgagctagggcgcacggcgctagggcttctccgacgacgagaggcgaaggcgaagggggcgacgggtagaggagagctcggggggtccttttaaaggggctcggaggcggcggcgaaggcccacggcgaccggcgacgagaaggaaagatcgggctcaaagccgatccgaatcgacctcgaacccatcggtttccaaaccgatttagccgaagattccaaaggagataaggtcgaggagatcccggagatcatttcccctctattgattcggccggaaacggaaagggacggccggatttggaaaggaacggcggcggcggcggctaggggtttcgggcggaggccgacgcgaggaagacgacgacctgacaggtgggacccacctgtcagcgaccgaacgcgcgcgcgcggctgcggactgggtcggctgggccgaggagagagaaaagagaggtttttgagccgactttcggcccaaagccaaaagaagatttttaaaacctttttcaatttaaattattttttaaatgcaattccatttattaaaaatacttccttagctcaaataaatctcagaaaaatctaggaattatagaattaagcaaagtatttaatgaaattttatctggccccattttatattggaatttatttttaaaattagatcttcttttcaagacttttaaaaataaattctaaaaattccttttaaacaacaatttataaattttgaattttcaaggtgtgacacttgcccgatggtactccgaacgtgcacttctctggattgagcataaggcgatatcgtcggaggttgtcgaacgtttcccgcagatcgtcaatcaatgagtcgcttgtcttggtcttgacaacaatgtcatcgacgtaagcctcgacattgtttccgagctggtcactaagtgcaccttggaccgtgcgctggaaagtgtttcctgtggttattagtccgaatggcatcttaacgtagcagaataccccgaacggcgtgatgaatgctgtcttatcctcgtcctcttttgccatgcttatttggtggtaaccggagtaagcgtcgaggaagctcaacaactcgcaaccggctgttgagtccaccagttggtctattcgaggaagaggaaagtgatccttgggacacgccttgttgaggtggtgaaatcgacacacattctccacttcccgttggccttccgtaccatgactgggttggctagccactctggatggagtacctctctgatgaaaccggctttgagaagcttgtcgagctcttctcgtatggcttgttttcgatatggtgcaaatctccgcagtttttgctttattggcttggcatcgggtcgcaccatgagtttgtgctcaatcacctccctgggtacccccggcatgtcggacggctgccaagcgaacacgttagcattgtcgcggaggaaggtgatgagcgcgagttcctatttctcgcctagtgatgccccgatcttgacggtcttgtcggggttggcactggagagtggaacgatcttgattgcgccgtccggcttcggcgtcttgtttgttttgctcactttcttgggtggctcagctgtggcgggtaggctgggcgtgtgctcgaccatgtcgaggctccacttgtcgcattgtactgccagcttagcgttcccttgaatagtgattgttcccttcggtcctggcatcttgagcacttgatacgcgtagtgagatgcggccatgaacttcgcgagtgaagttctcccaatgatggcattgtatgctgtatcaaattcagcgacatcaaaggtgatctgttccgttcggaagtagtttgcttggccgaaagtcacaggcaacgtaattttgcccaatggtttggacgatgactgaggagtaattccatggaagggttgatcggtgggtgtcaactcgtttcgtgggatccccatcgcgtccaaggcgctggcgaagagaaggttgattgagctaccgccgtcgatcaggactcgtgcgaccttgatattatgaatagtgggttcgactacgatcagatattgccctgggatgacagcaatcttggggtggtcctcttctgagaattctatcttctgctcggaccacttcatcttgggcgcagccccctgccacgtcgaacagacttcacgttccactttcttgtattctcgctttgaggagtatgccgtggaacctccaaagatgtgtgagacatgaagatcggaatctgggtatgctgagtccgattcctgagtaggcgcctcagcatccttctcaaccacgtgtactcgcttgcctttttccgatgtcatgtgttttgcgagcgactttttgaagacgaggcaatcttctagagagtgtctgtccgacttgtgtatagggcaccatgctttcttcgtatcgctgccttgtgggtctgggcgcttgggagggtccgcgtattctgttgcgagaacttccgattgagctttccttttcctactcttgcgaattttcttcttgcttgactcaggtgcatccttggctggtttcttctctcctccagtcttcggtttgtcgttcttgcgtctcagtgcgtcatccgcatgagcgcatcgatcgacaatttcgaataatctccgagtagtcgtgacgcgcctcgttgccaactcttgagtagtatagcgatctctgacactggatttgaaagcgcgaattacagaagcgtcggtgatctcggggattgtgtttctgcactcgttaaagcgccgaacataatccctcaaggattcacccgggttctgtgtcaacgcatgtaggtcgtcttcgatcgcgtggcgcttgtaagttccttggaagttggctacgaactgctgccacaagtctgcccacgaagagatcgagtaggggggagatgcatcagccatgaacgtgcagagcctttcaatgtggttggcaagtaattcaccaacgcattgtcgtccgctccggcagcgtagagtaccgtggagtaaaccagaaggaactcttctgggttggtgctcccatcgtatttctctattgctccaggtcggaatctttcaggctatcggacatcccgaagtgaacgatcgaaagctctacacccagcgctgggggcggtgggttgtcggcgatcatacgcccttcgtggatgtctatctgatgatgaagatgaggaagatgatgacgatgacgatgggtcgctcggttccggcgtgcggttacgaggacgtcggccgggttctcgagaaccttgttgtcgtcgcccgttgttgtctcggcgccgatctccatcatcg

SEQ ID NO: 55928 - DNA, 1860 bp, Oryza sativa
gtaatgattattatgcaaccatgacaatggaaaaatataaatgatcacactatgtttgaatggtacaacacatacacctttgtacttgtttcgtagccaattttgggaacacattaaggcctccaagatatctgaagtgagtcagctgcggtgctcactaagaaccctcccactagtgctgaatgcagcctctgatgcaactgggctaactggaatggcaaatatgtcccatgctacttttctcaatgtaggatattgtgtcccagccaccttacaccaatcaaaaatcttgaagttttccatattaattgagactaactcatcctccaagtacctatctagctcagatttaactcttattgctggtggcctccttcaagcaacacgtgcactaattgaagacaatacacctgaattagcaagtgaatgagctgaagattctgtgttatcttcatcctcttccatttcatactccttcatgaggtcatacaaattgtttttaacctcttcaagtttgtctgtacactcctcacttgattggctagtaatggactcaatgaacccaaggaggtagtctgttttaaacttaggatcaagtatggtggccaatcccattggtccttggatctccttccaatacttatcaaacttcgcaatcatctcagttgacatttcctctataatattattgccacatgcagcctgtcgacgggggatacccgtagacaggatatagagggtactggggtacgctggtacaaggatctacatagtacgacatcaagcaaataggaaacagagattatactggttcaggccccttggtaggtaatagccctaatccagttgatatgggattatatgatgaaaaccacagattacaaagggaacagtggaactcgacgataccgacaagatcgtagtcgagttgatccgactagatctcccggcgacttggctccgataagctccggcttcgtaggctgtggtggagttggctctgagattcgatgccttaggtcctcctggggggtcccttttatatcgcaggtcacctgtctcccagttggactcggagagactggaccgaacacgacacaatgacgacccagttctgaccgagtaggactccttccatctgtgaactccatgatgaatttccttaacgtatgccgaaaacgtccgtatacgcgtgaacataccatatcgatacgtgacgtatatcgaagggtagagggtataccttacccgtaaccctgacacagcccactgcctaatttgctctttagccccacaaattttcaagagttggacattggcagtcacataattagttccagagaacacttctgtgatatcattgaacaacttgagcctattaactacctctacagcaaaagcacattcatctttactaggggcacaatcaaagagcttctcaacatgttttgcacgatcaaaagcatgtgcataaggtaaagcaatgctaagcatcttgtaggtggaactccacctagttttgcaatcaaggcctaacttgtgatccattttaactttaacatgcttagcaatttcatcaaatttctctactctcttaggcgtggctgtccaaaaagcaacactttcacggatttttgcaattgaatattttatcacctctataccatccttcacaattaagttaagaatatgggcagcacaacgcatatgtgttgatgtgaaaaacacgaggcctgggagatctgcttaactccagtgcaggtccaaaaatcttgcctttaggttcgtgagcgtgccagttgatttgatcatgcaatcaacaagaaataaagacaggaaaatagcggttaaatccataac

SEQ ID NO: 55929 - DNA, 2709 bp, Oryza sativa
agtgattgggatagatcggtcaccatgccgagacagtataaatcacttagatcgaaatatataataacaatgagattatagatgttcatagcatagccgattagatagatctagcatgtatcggcaacaagatcttaacataaagggcggatttaacatgtcaatcaagcatataagacatagagtagttaaatcaggtaagatcggctgaaaccccgacactaccctaatcggcaaccaaaagcaggctagaaattgagattttaataacgacttataaggtcaaactcaactgatgcagctataaatatgaaaagaaggacaatatctagacaatcaagctgttggctgtttcatagagtggtagataccctgtataatctaagtcaacatagatatttaacctgattggttgccttccaataatagatgttagccgattgaaggttagataacgatattgttgaagattatacataatatatgataattcgacgaattacataaacaagattagagtatcataaagatggaagcactaatcccgataacgcaacccgccataacaagttttacatctagttgaagatcgaaactgatgcagctcaacccgaaagcaagaacttgtcgaaaaaaaacaaaagtaaagggtggcgatgcgccgagattgtattgaacgtgtgttgttgtattacatggggctcggggtctatttatacccgagattacaaaatatgtccatgtcggacacgactctcatctctaacaaactctaagataccataagtctttgcggcagacttttgcccaaacttatctctaaggaaattacatgaaataccctaattaatagatacaattaccttttcaggactcaatccatgcatggcaatcctcatgaagcacattaactcaacccgacaacgtgtaccgaatcacattgtcggaatcggcttaatcggcaaccttgtccgactcgaactctaccgatcctgatcgtagccgattcggacttcagccgattcttgctccgcttctggaacgatctccatcttggattccgcttcgattttatcttcatctccgatacctaaataaccaaatttggtcgttaacaatatgcaacaattttccctccaacatcaacttagacttgccaatcttcttcccaagttcagtgattaccttgtcattcgtggtacaattatcaagagtcaaggttgagatcttctcatcaagattccattccaccaatgcttcataaagttgttcacatataacttcagttgtgtgtggagcaggcacatatatgaacctatacaatcaaagttaaacctagattaaattcagattgatgcaaaaatgaaatctaatgtcatgctgaattaaatatgtagcagtaggaaatgaaattaattgttcatcaagtacctcatgataatgcttctaagtgtccaagaatcatcaatgaaatgggctgtgacagccatgtaccctcttttttggttatcagatgtccacaagtctgtagtaatagccactcttgacttagttccagccatgtaggctagggctttcttattttcttccatgtaatagtccataatgtccttcctaaaaatgcataaatgttaattttttcttcttaattgcagatatttttaatagacaactgaaactaatagatatcattattacctaatagtgtttcgagtcaccatcttaaataatggctgaagtgcagtcacaaacctttgaaatccaatatgatcaacaatagataaaggatactcatgtagtacaatcatggcagcaagctctctcctagctatttgtggatcaaatgtgtacttctccacagatatttttcctccctcctgggaattgaaccttaaagaagactgtgcaagtgtcttgttttgtcccgccatcttgatctttttcaatgtgcaaattttcaaatggtcatggagatgtcttgttccattactgcttttccctccaagccgcttgtggcaatgaaggcattgagccttgactttaccacagatttttactttcttgaaatccttccaaacgatagaagtaagcttcctcttggtgccaaagtccacatcctcctcctcagcctcatcttcatcatcatcaccttgtattggctgagaatcattaacactctcatcgtgaggtggaagtgattgcgagtcttgctggcttctattcgcactacccgcagttgacttcgatgtgaatctgagaagagagaaataaattcagttcaaaatttattcaatggcctagtaacatactgaaatccctttacaaagctgtgaaagcaaatttaaagttcagaccatgttgacgcatacctgcatagcactataaatcaccaaacaataatgcatgtacataagtataaatatagaaaatatataacagtaacgtgcaaagaaatatcccttcaatttgcaaagaaaatatatgacagtaacatcaacaaatccatcatttagtacctaagagctgaaacattcagtacctaagtgcaatgcaatctcataagtcataaactccaacttacatattccaaattgttaaataaaagagctgaaacatataagaggggtagcgtgcttgaaatcgaaccccatggattttaatagacgaaggccgccggcaaaagatgacgtgtttagagtagtcggtgca

SEQ ID NO: 55930 - DNA, 5735 bp, Oryza sativa
gtcatccccgatggtgagaggtttttaaccattttattcctcatggtgagtagatattaaccatccccgtcacctaatagatgaattcatcacggggaaacggtaaacgggcccccattgccatctctaggcgtcaatgagggtttgagctaaatgccttgtttagtttcaatttttttaaaaaaaaacatcacatctaatctttgacatatgcatggagctttaaatatagataaaaaaactaattacacagtttgcatggaaatcgcgagacgaatcttttgagcctaattagtccataactagcctaatctttttaaatatagatttttttaaaaaaaagaagtacagttctcgttgaaatattagaaaaaaaaaatctcgcttctatatgaactttaaaaaagaacacaataccatcaagacttagaatgagaaaagcatgggtaaggaagtggtgggtccggcgggtgtaaggaagtggtaggtccggcgggttggctcgcttgcatccactcagtggagcagtctagaaaggaccggtcaatcaatatagacttgtcacactgggttcaggagaaatcagacttgatcagggtggagtacatagtagaaaggaccagtcaatgtatatagtactaatcagaagatgatgctgtaacagtaatgtttcacaataaacaaaacaattattggtgcagaacatgttgctgtcgtagaagcataacaatacgagataacactacaactttttttttccggaataagacactactacctttttttttcgaataagacactgctacctgtataattgggtctgtttggcattgcagatagtagaatttatgggttaaaatcattttcgaattttcatatatccagctagagttgaagctgtgttcaaacagagccatcatttttgaatttaaaagtttttacagggaaatggtatttgattttagagaggtcatattcgaaagtttgtgctatgatagtgcagaaagtctttttccctcaaattttgtggatccaaattctttgcattcatgccatggacccatgcaagtgtcatgcatattctgatataatagcagtaatactggagttgcaaaggaacagagtacccattgctagcgaatggattaatatagtgagcataaagcaaaggagaagtctggtaacacgtaaccataaagcagtgataatcaagacaccatcatatcagaaggctaaagtaacaacacctaaccataaacatactctaagataagataactaatgtctactcagttggcaaatggcaatggcatagattttgtggccggcttcgcttggaaggaggtcgtcagacgcccccaagtccgagcatgccgtcgtcatcgtcgtcgacgaagtggtcggggcgccatttgcgggggctggcctcctccgcccgaatcttggactcctcctcctgtttcccctcatctgcaatgagcctcatcctgaaaacatccagaagatgcttctcgtgtttacccacgacgaggcgggtaccctgggaagcatacatcgcgactgtgaccaaatcctgcatgcacgcgacaaatcgaacaggtcggtcaggtataccaagggtgtgtttagctccgcatcaaaattaaaagattgattgaagttaaaacgatatgatgaaaaaattaaaaatttatatgtaataaaaatttgatgtgacattttttttttcgaaactaaactcggcccaagccaacacaaggaggtctagggtcggagaaaagtcatcgggttctgttctgttctgaccttggcccacgcctccttggggagcttgtcggccttgatgccgaaaatgttgaggtagtatggcagcgcgtagccatcggggccgcaagcgaaactgatgcagctgtgcaggaaactgaggagcccgtccgggaatccccttgtgactgggtcgccgtggtagcactgccaaaggtaccaatggtacctcagcagcgtgcacgtcgccgccaggggctccatcggcacctcatcggaatcagcaagctccttgaggttcttgaacgtgccgattatttcctgcacgtcctggcttgcggcgctcccggccgatggcggcggagtctgctccaggaggtccagcgcctctgcagctgaccatgcgatggccttgtacggcgtcacctgacagcaaccacatatccaacaaaacagataaagattcagatatatatatatatcttcttcttttcatctcaaaaaacaaacttcagttgaggcacgcatgtatgtatatggaattgttttacgaaactaagttccagcccatatagcccaaacatcatcagccccaaacccctcccagcccaaagaatttgccccataaccaatttcctctcagcccaaactgcatgctcgtacttcaattaaattgcatcagcctggcctggcccagaacaactcattggcccggcacgctcccctaggaacccatctcacaactgtatccacgcccacagtatgcccagggaccaacgggctgatcagttcggcccattctcgaaccctttccgatcaggccatcctctcgtcaaacagattccatcccccaaatccccaacgtctgtcctcctagcccaacaacgatcatcaacacggctaacttatacttactaataacaacaagtactttaagcataactttttgttttttatatttgcacaaaaaatttttttgaataagacgagtggtcaaacatttacaagaaaatatgaacatcccttgtattagtggacagacatagtaaatatttttccttcgagaaaacaaatggcccaacaaccaccaaagatctaccgtttcttcctccgtagttgctactgcgtacgctttgtttattgatcagaagagaaccttttttgcgaacaagcctgcacgatttttttaaaaaaaagaaaactttcttttcagaatgaagaacctacgtacgcgagaaacagatagaccatgtatcaacacaaccaacaagaacggtaaagaagagctagcgtgtgaactcctcgggagaaaaaagccgaaaagaaaagcacaacgtaaactccatagaagatacaaacaaacacagatctagaccgagagaaagaacgttgtaagagggccttactacctgcaggccaacgtcacacatgcatcaagtacaacatatatgttctcccaagcaacaagctcgcgcgatctcatgtttttaccgcaagagcagattttctcacggcatcccagacccataatcctagatctaccgtttgttacagcacgcaagcatcaacaagaaaacgaccagtttttttttccctccacgtacagatcaatacgcgcgaccgaaaagaacatttttcttcttctttttttttttgaaacacatcgaatcaaatgcgaggaaggcagaagtcagtcgagacgcacaccgcaaacatcgatccggttccgtacgtactacacatgcatgcagatgcaggtagttggaaagaagagtgcgtgcgttttctcaccttggtggagtcgtcgtcccaggccagccatggacctgggttagcagccgcctgtgccaccgtcagcctgaggggacggccggcgccggcgaagcgcgcgaccggcggcggcaggagacggccacggccagcaccaccaccatggccggcgcctccaggcaggcacaggacggggcacccgaggatgaacaacgacgacatctcgatctctcgttctcgctgatgaggagatatggccgggggtggaggtgaagtgcactactgcagtgcagccttgcgatatttataatcaggagccaatgctagggttttttggcaactatgggttatgcattttgcgagagtgttagaaaaagcagtcaaactttagagagatcacctttggctttggagtttggaccaacgtaccgtgaaatgcatacggtgtatgtatgtaaattggagatcgatgtagacggtgtatatatgcatcaacaagaaaacgactttgttagtatactactactattccatattaccatttcattaactgcatgtatatgcatgtgtatttcgacatgcagtctgtctttgtccccccgcgcgcgtacagggaaaaagggaagaccagagctgcaggcgtagacgccgtcgtcgtggtggtagcagtagcagtacgcgctgcatgcatccacggcgccgcgagcgcgtggatctgtagttcatgaaccgcgggtagagtagacgcacagaccgtgctagcctgctaggtgtatggatctttcaagctccggtgtatgtatctttccggtagcacaggtgcacccatccacacgttctgccatgcatgaagccaaccaaccaagcacacaaattccgtgggtccccctctctccctcccctggacaattccgtggatgtttgcgtgcgaccgaacagcagcctagaagaagcagagatcgcaaacagatcgataattacatgcatttctcggctacatgcatttcctcgcttaattactgcaacgctgcaataagtgagcgtatatatgtattttttaagttcaatttagtgatgaaataagtgagcgtacgtgtatataactaacctagcctccaccggcaaaaaaaaaaaaaaaaaccgggtcacatcatatacagacacacatttgaagtaataacaaaacaaattacataatcagcatagaaaccgtgagacgaatttattaagcctaattaatccatcatcaacaaatgtttactgtagcaccacattgtcaaatcatggcacaattaggtctaaaagattcgtctcgcaatttacacgcaaactatgtaattgttttttttcaatatttaatatttcgtacatgtgttcaaacgttcgatgtgatggagaaaaaatttgccggcggaactatttattgctccttccgtcctaaaatataagtatttctagtacagtgacaagttaaacatttttagctttaactattagtagcaaaagaaaaaaaatcaatcatatgtataaaattgatgttactagatttatcattaaacaaattatcataatatgcaattctttatatttaaaacattttatttttattgatattgttggtcaaagtagaatctcggagactgtgtcagaatttaaaaatgcttatattttaagacggagggagtagtacatatctacatccgatcgatatttgttgtttggcaagatacaaattgccttgttaagttcgcgaaaagaaaatttttgggtgtcacatcggatgtttgatcggatatcggaagtggttttcagacacgaatgaaaaaactaatttcataactcgcctggaaaccgcgagacgaatctttcaagcctaattaatccttcattagcacatgtgggttactgtagcactaatcatggactaattaggctcaaaagattcgtctcgcgatttccccctaactgtgcaattattttttttatctatatttaatgttccatgtatgtgtcaaagattcgatgcgacgtttttaggaaaaaaaatttggcaaactaaacaaggcctaactataaaatccatttagttcagcaataaataaattaataaagctacattaatttctttttcacaggagtataacaccagtagcacgaaaagcatgtagccatcatgacccatctactcctgctgcttaatt

SEQ ID NO: 55931 - DNA, 2928 bp, Oryza sativa
gaatatgtatgtcgtcgaggtcgatcggctttagcttgcgtggcacgctcgcaagcttgctttacaccggagattgcgcgacgggcaccggagattgcgcgacgggcataggctgtgtgtccgtctagcctggtgcatgaactcggtccaccggcgccgtcgatacatgctagcaatacgtactcctacgtcaccttcgtttctgtttttttttctgtacccacgcgggtgacgaaaaaacaagagagaaacggatcggatcagtgcatatcacacacattaaatacggcgcgcgaagggttgcccaagcaatgggatactttttcttttcaaaaattcgaacagccagcgtactttgtgcatcgtgtggaggaagaataaagcgatgcaaaaatcttctatgcgcgcatatatatggtgccaaaagtgcctaaaaatgcaatcaacattttaatttgaaccgcgatcatacagccattaagtgcttacaatattacttccttggtctagggcgtgtagcaattaagggatagaaaaagtctacaagtctaatagtagttactaatgaccacattgccctaacaaacgattgcgaaacttttgaagacgatgttgtttttccagcaatatgcatgtcgaaagcaggatgatcacagggaaaaccgagagatgtgtagctcgttatctggtgagaactcccaaggctggagctgccaccgatcagaaagggtttttcagatgggcggagaggattttcacatgcggttggctggcccgacgaggaaatgagttcaccactaatcagaaaactaataaacatcacagcaaacataaatttcataagcctgctagtgttaaaacaagtaccttgaacaatttattatttataacaagaatggacttgctttgcttgtgaggaaatatgtgcaaagcttattgcatcataaaggcctcttggaggagaaattagaactttatgctgattgaaacaaatatacattcagcaaacttgatgcacaaatcaagcatatatttcatcacattctcgatgctggaaaacagatagtaagatctagcatcctgatttttcattttttaaaaaaaaactttcacaagttagcaggaaatcatattgttagagtatatggtagttatagttatattagaataggatttatttgtgtggactccttccatatctgtaatccttctttatctcaccctatgtactcctatatataccggtccctaaggctcaatgcaattgatccacgttacgcaatatacctctctccctatactatccaatatggtatcagagcgagcgacctagaaccgctgctcacgcttccgtcaccgtcgccccgggagggctccgatctcccgggggcggccaactttttttttctctcttcgcgtcgtcaagtcatcatcctaagagatccatctctcaggcgtttgtgttgtcatcaatcaagcagcagcagcagcgtctccgatcgtcgtcgatctcaccgaccacctggcgcactgcccccgcccgtggccatccacgagcaaccgttgacgtgtggatctccgtcggccatgctaggcctgcctcgccgctgccgctggggggggaggaaggggaggggggacggccacctcttcacctcggccggcgtcatcgggccccgtccgccgctgaggacgcccgcctgctggtggtgctcggcgctgccccgcagccatctaccctagcgtgacggggcttgcctcttcgccgcgctgaggaagccacctccatcaaccacgccgccgtccccgcactcctctacgccgctggccaccgttgacgccacctccgccagccttgccatcgatctcttgctgcccatctctctctcttatctgtatacacatgcgttcatggataggatttgggaaggtagtaattgacacacaagagggcgttgtggaataggattgatttgtgtggattccttccatatctgtaatccttccttatctcctctccatatactcctatatataccggccccctgaggttcaatacaatagatccatgttacgcaatatacctctctccatatactatccaacacatatgatggagcttgataacaatgtaattatccaaaattaacactgcatacctcaacttcacaacgatatgctgaacacattttatcaatatttatacagtccatcacagcgaaaaaaaaatcctttgctctttccgtgacatttggagcaaacttttattagaaggtgtcatatcactactacagaaaacatttttccgaacgaggacatctttaggttacgggtgaaccgtaactagtcgtgcctgcaaacatcggtctacattttcgcatacggctacttaaaagatctgcatgcaaaaatcaatttcattccagttcagcgaaaacccaccgcatgttctagttcaccacccatcacattcccattcggcgattggtctagttcgatgatgccagctgccactcagctcttgtcttgccggttaattatcgcccttctccctattgctgaccgctcgctaccacctggagggaagcctggaaaagatggggacgagagagtaagaggagggaggagtaggaaaaccgacccgttcacatgtagcgtccatgtggtcaccttgactcaatgacacgtcagctaaaaccggacataatattatcatgtgaatttagtagtatttcagtattgtaagttaaagacgtgttatatctcgtatcatgatttatggatgtgatttaaactcgaagcaaatacgagggattaaagtgaacttattccgaatgaaacaaaacacatggagcaatctgaactgcgtttggaaagtgaactgtgacaccaacggtcggcgtttggaaacatgggatcgtgcgtcca

SEQ ID NO: 55932 - DNA, 2360 bp, Oryza sativa
ggaggaggacggctccgccgccgccgccgccgcccggtgggtgtggcgcgtggccatcgatctcgagcaggtgctgccatggccggtcgggaataccaagggcaaggagcgggcgtgcttggccgcagttgccgaggaccccaacgtcatcttcgtcggcacggaagaagacggcgtcttcgccgtcgagctcgattcgctgcgcatcaagaaagtgtgcgaattgggcaaatcacaaggccgtttcttccccttcgtcagctactgcgccgagtcatttctggtatccatctcatatttctcatctgttcatgcaagtttggttgctgatttaaaatgacatggtttggtggtttttattttattctatttttatttttacagctgagcctagcaaccagcaaattgccagcaccagcggcaaattaatccaccatcttgcagtctgatcgatgttcttcggtgatttgtttcttctgcggaaagttcagggagacaagcagtttagttcgatcacttgggtcagttagcatagttcctgacgatttttttgttgtggtgttcttcttatcaaattgtgaccatggatcatcacttaagtttcaatcgatcagtttcagcatacgcgagtcattttgtttcagtcattgcctgacaccaaccatcaagtgtcctgaaaaaatgaaccgttgttgttcagtctcagtcggattcagacaaaattaccaaagcatcaagtaattgggggataattcggctcattgaattcactgtgatcatgatttgagacattcttcattttacacatttttcttttttgacatagttgagttcagagtctgtttgccccatcctgtttgaagttttcggtgttttctgaagaatggtctgtgtttcagcttaaacataaaactctaggttatctcattatcttctgaagatttgttccgaaatgctcccatgaccgtggaattgtcgcattgacacttttaatcattcagtttcagcatatacgggtcatttttttcctcatggatcgaacactaagtttcaattctgtttcagcatgtccactaaaaattcagtttcaattcagttttgcacctgagcatgaattgtcctgaaaaatgaatcgttgtgattcagtctcagtctgattcagacacaattgccaaagcatcaagtgattgtggacaattcggggatctgattgaatgcatcgtaatcatgattttagtcttccattttttatatacatttcgacatagttgggatattgttcaggtctgtttgcccccatcaatttggagccttcggtatttttcagaagaactagtctgtttcagcttaaacataaaacaagaagcagtggtctcagctcttcgagtacatccatagaaggcagctggaacttaaaaatgtacccgtttcccatattttcgttgtatgctatcgtatcctacctgtaactttacggtatgcttttgcatggacttatttttcttaatcctttctctagttcaattccaatcccaccacatttgctcaagataaattaagacgcagaacagcggggagtattcagcaaattctgctgactggaccacaatggttgctatcccgagttccacgacaatagccatgtcaaagaatgcaagcttgcatcagttacaactgtcctaacattgaagtattggcctttttctctttttttttcttaaacaaaatacaaacgcagacgctcacagtacaaatgatcatacatgcagtgagggaggcagctctcgggtaggttgggtgacggtccgggctctaccgttgccgcctccattacctactagcgtcaatgtgtataaaaattgattcatcggctgtgtttagattccaaaaaattttggctaaaaatatcacatcaattatttggacatatgcatggagctttaaatgtgaacggaaaaaaaccaattacacagtttgcatgtaaattgcgagacgaattttttgagcctaattgcgccatgatttgataatataatactacagtaaacatttgctaatgacagattaattaggcttaataaattcgtctcgcaatttacaggtggattatgtaatttgttttgttattagtctatatttaatacttcaaatatgtgtccgtatacgttaaaaaaaattggccaacgaactaaacacagccatcatcatggaatgttattaatcgcccaagactcacacgatgatgtcgactccgccactgcatacataactctacgcgagcaataatcatactccatccgtttctaaatactttgacaccattgactttttaagcacatgtttgaccgttcgtctttttt

SEQ ID NO: 55933 - DNA, 1303 bp, Oryza sativa
aaagaaaaggaaaaaggacttgttaaggtggagcagatggttagctgtgaataataaaattaaccggaaataacgctacataacggtcaggatggccgagtggtctaaggcgccagactcaagttctggtcctctaacgagggcgtgggttcaaatcccacttctgacattttgttttttgttatccgtatttattttatttagtcgagagtttcatacaaaccaaaattctccgaaacgaattcatatcgacagctcaaaaattttcaggagatttgtgcgacatttcttcatttcttttttgccctaatgggccgtaatccgaccaaacgaagcccaatcgaggcccatctttcacctgtgttgctgttgacgctctgtgagactgacctctccaatataggctgctgcttttccctccctaaaaataattcacgttgatatttttacttcctttttttcctggtatttcccttttttaaaaatcgatgaaatttgatgtgaaatcattatgacaccacaagttgacaacactagctcaaccaaaaatctgtatagttggacatgaaaattgatgataacacctatgccgcgcctcccatccatgcaacatttgccattttaaattatagagtccaatttctgatggaatctataaacgtgtcgggcctgttcactttaatgctattttcaacttttttttgttgtgataaagttgccaaaaaagtggttacatttagtttgctaccaaattttggtaactatatactaaaatttggtaaggttttttttatctaagtgaacacgtccgtcattttcaaagttcaaaaaatgccctatgaatttgcatgcacctctcaagaacaccaccaagataatgagaaggtactgtagaattctatggcgtgagctgagttggcaaaattgacgagtgacgacattgggtgggggagaaagttggagttgatcattcaagatccagaaagtccgtagaaataatcacgcaatataatacataaaagcatgctaattgctttcgtagaagtgctgcttttctctagctgaagatcttgcaaacaggtcacactaaccaaacgattgttacagaggacggatgggtacgtcactaatatttttttaaaaaatacgttgagaacactcccttaaccgcacgcttcaagagcctaagatgtgtttacgttagaataggctaatgtgttgtcaaaattcactggaacattataaatgtttggtaattaactaaatccatctgtatatttattattttttaaaatatagtatg

SEQ ID NO: 55934 - DNA, 2669 bp, Oryza sativa
tatggtggagcataaatctacacatgtattagaaaataagcaaggaatttgaattagtttctcggaccatcatcgtcgatgggtctggattgggtcttaggagattttatggtggaatgatctacctctctcattggtggagcccgccgtttcagcagtgaactcgacctgtggctgcttcaggacacagtagtgtagggattgaattcggttcgctgcagtctgtagcgtgaacactatatccgtttgatcttatttcaaagggcagagtcatccaaaaagcttcatgcagaaaatagatgtaggagtacttatgccgtgtttagttccaaaataattaattcttcaaacttctaacttttccatcacatcaaaactttcctacacacacaaactttcaacttttccgtcgcatcatttcaatttcaaccaaacttccaattttagtgtgaactaaacaaagcaatgtgcagcatgtaatgtaggagtagttatgttctttttccccttctttttcctaggtctcaagaaatatgagtcgccgaaaggatcttttctacttatatttgacggctcagatatcttctctctttttgtccttttagatccgatggttattatttgttacatgatatggcatattctagttctattttaatattaacttttcactagttaagattggaggcaaaaaaaaaatgctctgaagtgaagcgaaacgaaggatctcctatagtgtgctccctctattttaaaatatagtaatttaaaattaaatttaacatcaattagtattatgaaaagctagtatcaaatttaggttgatagtagtatactattatatattttaaataagagaggtaagagttccttaacgattgtaaacttcttcattgcgtacgtttgtgccaaactgccaagcctgtcatcaactttactaaaaaccgcctttttcattgttgaccttagaccttgctaaggtatgtgcaatcaagggtgtgttttttaagtacatttacatttactctctttttttcgtgtacggctttccaaactaccaaataatatacaattttaaaaacaattataacaaagtattattttaaaggtttttatcctagttcttaatagattctaaactaatccgtcgctctatctttcgtgttgaggtagggttcccaaaacacacacaacacaacacaccaaacccaacccgagtacccgaccgcgcgcgtgccccctttcccctgaaaacccacaccaccaccgcgacacgacacgtacgacacgacgacgccgcgagtcacgggagattagccgaagaccgcagcggcgccccccgcgcgcgcgcgcatgtgatccgccccgcctccgcgcgcccgccgatcgattccgacctgtgtcgccgccgcacgccaccaccaccacggattcctcttcttttctctcgcagccatgaataatcccccgaaccccagtatctatctatccatctatctatctgctccatcctctcacgagacaagataccaataatcctgtggcttccgtgatttctcccaaagcaacaacccgagccgtgcttcccttcccctcttccgtccgtttgttttgtccgtctctgcttgtgtttttggttggatcaggacagcaacggccgaccacaactgctgatatgatgatatatcactgctaacacccgaaaaaaaaaattgggcatcgagaggaggaaaaagaaatccggcaatcacctggcgggaaaaaagaatgaaaaaaaaaatgaatattgagagagagaaatttgatggacacagaggaagtgcaagatcggaagcttcaatggattaataattcactaatcacccagaataacaataataatgtacacgtacaacaagtacagctacaatcacctgcactgctgctgatcgctcgctcgctcgtgcatcgggatgcacgctaattacaaaacttcccgatgattagcggcggcgattagcgatcagcaagggagcaaacagaagcaacaagttccggattaagggactaatggcagattaattagctggagctagtaggagcaggcgaccctgagcatggagcggccgcggagcatgccgcggtacagcgcctcccggttcgccggcatcgccgtcgccgccgtcgccgccgcgttcctgcacgacggctcggccgccgccgggcgggacgacgcattgctgtcgttgtcgacgacgtcggcggcgaacctcacccgcttcttgctcccgcgccgcgccttctccctcttccgcttctctgcaagaaacacacgtcaggtgagaggagagtcctaaagaggagccaagaagaacagcacgcacgacggcgcgctatggccatccatggcggcgcttttgctccgctcgctcaccggaggaggagaggcaggggcggaggcgagcaggggcgtcgtcgtggtgaggcggcttgttggcgcggcagagggagaagaggacgagggtgccggagagcgccatggcggtggcggcgagggcgaggccggcgtgggagccgccggccgacgaggacgaggacgacatgggagcagctcaggtagctcgagctcggcgcgcggcggcggcgactgtttggggaggtagttggttgggtggttaaggcgagaggga

SEQ ID NO: 55935 - DNA, 2208 bp, Oryza sativa
gcattgccacatcagcgctatggagcgggttagaacccgtttggacctacatgacacaaacaagtttagagacctaaaaaatatattttagtagtttggagatctagatgacacactggcacaagtttcgggatcgcccatgtgcttcactctattctatatggataacaaatgtcttgattgattgtgcgtttgtgcgtcaagtgttatagcggctgcgataaccagcccagccgagcaggtccaaattggatgctattagaaaaaaaaagtgtaaaacgcttttgggtaaatcctacaatgaaatttatattcatgaaattcatatttgtttgaaaattcggtcggtctcaaattattgatacttttatgtgcatatatgaattcatcaccaagccagtccatctgaaatacataaattgcagcatagaagatacaaagggtcatacaagaaaccactctcactagaaaagaatagaaacatgggaggtagtagtagtaaataaaaccaataaaactagaatttcgtatttaatttaaatctgtgttcccagcattcagaacctgatgagacagagtggaattctgtggaaagctggaaataatacccctgtggaccaggtcatcagtcatcaccaggacagtttttgttttccttctttcattccccttgttttcacttgcaacacctgtaaatcctactgctggtgttatccggcacggcacgatgaattattggggggatgtctccctcttcttgctacctttgacatgaggtcagataagacggtcacccaatgttatgtctgcaaaagatttatgcttttcccccctcttttacaagtgaatggaggccaaggttatgatgaaaatactttttttaaaaaaaaatcttggatcaaattccaaattaattgaggccaagaagtaagattcagtgactgcttggcagcagggcaggtaggacaacatatgcaggctctcctgatgcttttactttgctaccagttgctttaaatgatctagtttgcctctcatttctgcagccagtatggtttttgctccaactagtaaataaaagaaaaaaaaaggcaaggtcctcgaatttgtttatgattttattacaacctctatactttcagaaaaaaaaaacaggttagagctcttactcttgctaggtgtatcatataaagcagttcaaaaaagggaggaaaaaacaataaaaaccgtttaaaaaaactaagagaaaaaaccattccaaaaaacacagaaaaatacgggggagaaaagattgaactatgtccatcagatctggttctgttgaaatgtacagtcctgtgactagtgtactggtctaaactattaactattgtaagtattattgagcggatcagcaccttacaaggtactccctccgtttcacaatgtaaatcattctcgcatttcccatattcatattgttgttaatgtatggaaaatgctaaaatgacttacattatgaaacgcaggaagtattagactttcacaagcttctcccatcaatcagaccaaatctccctagaaaaacctaaattatgtcacgttttggatcccattaattccatcgtcgtcatcacgtcggatccaatgatcgttaattgcatcagctagcttaaccaaatgaatattatttgtccagccaaatggcccttgtacctgccggaaactgctgtcctatgtagcggtttcgcgtgcaatttgcaacgaaaaaggacgcccatttggcgatgtaagctgacatcgatgcccccaaaagagcccaataggaagctaatggaggattaattaatgaaaaaaaatccttgaattcatgtttgcctctctttttttaattcaaattatacatgtatgacgtatagagcagcatgcatgatgtaggtgtactgttagctgcaactggaattatccaattccagttaaagtggaaccctaacccaattatttgagatctaggacaagcaaaccgcacttttgccactctttttctttttttcatgccgctgctagctaatggagaacacatccataatcagtatctaaaatgggtgaggtacatctatatatcctttaggataataagattttttttctaattatttctataaaactttaaaagcaaagtcgatctccttccatcccctcctcacaccacgtgtgtataaccactgg

SEQ ID NO: 55936 - DNA, 5672 bp, Oryza sativa
taagtcaaaccttaggaatataaatcatgaataactctcaagttgttgagtttgaaaatgtaaaaattatatgaatagatttgtcttgaaaaatactttcataaaagtacacatatatcacttttcaataaatatttatagaaacaagaagtcaaagttgtgttttggagaccgtgtcgctgtccaaacgacttactttacgagtacggagggagtacctttgtttcattttgaccttttttagtcaaaacaaataaactatcaaaatacattcaatattagatgtaatgaaattaaattaatgctacaaatgttattatatttttctataaacttgattaaagtttagagaagtttgatgagaaaataaaaatgacttataatatgaaacgaattataaacggagggagtaatttttaaagtaatataataattaatatgatctaaaatagctaaaaatacacaagctatccgtgcccggtgacacatcaatgattggaattgggttaactaatgatctaaaaccttagaaagaaaatttagagaaaaaataccactaaaatacaagaaattggaaaatatagaattggcatgaactcatgggaaatgtttgcacgaggtatgtcgattcagctgctgtcctggtgttcttgtgttagataatcctacaacctgcttttttttttccctggccctctctctctctctctttttttaaacacctgggccctctctctctatctctctctctctcactctgatgattacttttcccaggcgtccttgttcttatcccctatccgcccggggatttgcagtacaaaacccaacacgctgtggctccccttttgtactgcgtccctgctgcctatgatctcattggtggccgaccgcggcatcgacggcttcgtcacggaaagaggagaggagaggctctccccgtcgcctgccaagtgcgaaagcggaggagaaagcgaagcatagcaaagagagagatcgctgccgtgccgtgacgcaaatcgaagggagggtcccgcgctggctgtcacgttgggagatcctatggtaggagtacggtggtggtggtggtgacaggatccgtccttctagggcgtcccgggagacgtcgctgttgggagtttggggacacttgtcgcctctgtggtgacccggcagattgggattgggatttggatccggtgcagtacctagtgtgactgcaacataagcagtcacattaggcaccttttgatgtaaatctgagggtccaaaatctatcaagtattgttcacacgaaaaaaaaactgtaaaactagcatcaacattgtagcatcagatctagaccgttcattgaaaaaatggatggctgagatgatgtgcagttcctaacttgcagtcacagttaggacttcactaaatctcaattcatcagattgagaggtcatcgctgcttggtgtggtaaaaccgtaaaattagcagtgctaggatcctaaaacctactccttctttaaaattaaccaatctaacattagattaaaagtttctttttccagatttataatagtagatttaggtaatgtctccaatcttaaattgatttattttaagatagaagtagcacgtgtgaggtttttttttttacatcagacagatataaagaaattctctatttctagaggaccattcacatggtaacaacatgacaactgacaagtagatttgtggtttcggcttaccacatctgagccatgcctccactttagtcaagcccatgccccacaacagagctacacgtgtcttgcaaaaggaatttgtgtctagttaagacgatctacttacaaaccgtattgagtgaggccgtaccctcgagttccaagcagtgaaggccaaatctggaactagggagaggcggagtatggttagatatgtcaaatatgaaagaaggcggcggtgctcactgccagggacaagtgaagagagggtgaggaagatggctgatgatgagggagggagaaaaggggcccaccaccatggatgttgcaccgatttacctctgcgccaccctaatcttattatttcgttgctccacgtcgcctcgatctgaccaaattcaacaagtttgtagctagcattggcacgctcatgaccagatttagcgaggtctttgcttgtttgatggttgacggtgaaaaatcgacctgacgataattcctcagccctaaccagccttgatctatgctgatggctagctcgtcggccgaagaagttgaggtcatatatgaggagaaatgaagcgatgacggtgcccaagagtgcttgttggcatgtgccaaggaggagcatgtcaggagagaaaggagaatatgggaaatggtgaggagggttatgctaataccccatctttagagtgtttaatgtaaaattatggacatagtgtatataaattgagataatatcgtgaactaaaatagaaattgatatgggcaacttgtaaaattaaagccactacgtgttattggagaggagtatagtctccgtctatgtgttcttatgagtggcttccactaccgttgctaccctattaaactttagtagttttcaaaatacatccactttaaactctatcaaaatttgataagcctacaaacaaatacatccataatcactaaaatttggtaacaacataatgccaaactttactaaggttatttctggcaacaattcacgtgcctataaacactagacctcggtcagctggtcaagaaacggcgatttctaaatccaaaagggatagtggagaagcgggtggacgagagacacgagacaacgcaagaggctgtagccagcatcaccagctagcaccaggaacaggaagcttctgcccggtttctccctacgtctacatccccggttgcccagttcagctcccctccacttctcaagctcttccaaccgagtagctttcatccaactgcgagagcttctagaagaccagaacaacccagagactgtgaaacatcaacctctcgaggcactcaactcttttcatcaagaagcttccttctaatcatactgcacacatggctgctcaagagtttatctgaattgggagtatccaatctacatgccacacagcagcacaaggcctctcatgagtgaccactgatgttctgataacaacaggtaaacaacaatggcagctgacagcacaccatctccttgctctgcacaaacgttggcagctattgaaacttccacaagtttctgagaatgccagttcagaaagtatggagcaagccacagtaccactgcttatggaacaagagaagactgccatgtaagcagtccagaaagggatcaacttctaacttctaagcacatatatatacatgtacacatacaatttgaggggcattttaccgtctttacactgctcaccgggtcatttgcgtattcatttaacagggtaaccataaggaagttatattggtaaagctggcagattattacatacagtaggcattgacttttttggcatgtagccaaggggcaatacaggcatgtataaccagcaccctttctgcagggcaatttcgtcgtcagtaaaggtcaagctcctctttaatttcaggagcacaaggaatggtaaattaagttaaagagtgttttcctgtgttttacagtttgactaacaaaactcaccccaggacaggggcaaaataagccttcaggaattcacgaggaccagctaactcggagcaaacgatgccttactgaaatgtcaaaagtaaaggaaatgagtcataaagaagagaatttgtccagatctgtgagaacatgagttacaagtttaaataactgaacaaattatcatgttcataaactaactcttgaattagaacagtatcataattcaccaaggatcaggccctccgtccacatataaggtattttgactatatacatggacaagtgctcccaggtgcatagctaaaatccccttatatttgtggacagagagagtaggtaacatagttcatttggagtggaattgaaactattggcaaacaatattgcagtaatgctatgaagttggctccaataatacaattagaacctgacacatgaaaagagccagctgtatattcgacagatttcaacaagcatatttgttatcagttgcatgaattgtatgggacaatgagtacaaactaagattcgttaaactctgggcatacttagtactagtttgccacggcaatgctcccaagtcctgaaatctggaatcaaggctcataacaaagaaaagataattaaattgttgtttttattcctattattttgaagtaccagggcatctagaacagaagtaccacttatacatacggttttcaaggagacaaaatagaccacaaatctcataacgtttcaagctaactattctatacaagttaataatgtttcttcattcaaagcaaacaacatttcatttcatcaccttataaagtcatatagagatcatgcttccaaacagaactgatcccattgatattccaggacatacaaatattattaacaggaaaaaaaaatatttagtcacttccacggcaggtgattccgtgattggcacatataatgaaattgaaatgtcctaatgtttagacgctctcttgtgtgcattaatgtaatagacaagatcggaggaggaggacgagcaagcagatttagctgcaaaaacagtatggaatggatttccgtctgtacctttcaggttctttggccattaacatatttgattccagatctagtatcagtcaaattcgatcttactttggccattaatatgcacacacatttaacttatactgggtccatactcatacctctgaatatcctgcagcttaactaaataataaactaaagtattaacatagtccttttcaagtctttcactttttttgaagtctattcatgataccaaggtgtattcagctatgatacaaaaaaaaagttatgcatacgatagctgtctcttacagtatgttccacttctagaagactaaagtattatagagtattaactatccatatgagcacagttaaactgtacaccaggatcagcaaattttaggcatttagcttccagtacccactgggtttctctgtcacaggatcaagggaaaaaaaggacaaaatgctcagttttcaagcttgctgattaagcataattacataagctaactcctaagaaacatcatcagctctagtcgctgtggctgctaatataagctatgttgttcactattcacttccaagtatgtgcagcagcataaagtagttgtgtatgtacaaaaaggagttgttataaagaacagaagggcatgtcaagtataactgttgtgatataacatgacagttaggaattgtaccagtacgccagcaaagatgtctcaatgatctgatggttatcgcttcatttctgggaaatgaaaattaagagagatgccaccatagcttcaaattctgtcctgaaggcaccgtcttgcacttcaaaaaagtagctacttaaccagtaaaatcatgtatcgtcattatctctacagtcagccatgtcaataaatgatggccgatttgccaaacagctccgtaattcaatcaagggagagatttt

SEQ ID NO: 55937 - DNA, 964 bp, Oryza sativa
aagtcgacaatgcattcttaccttgtcctgataacctgtaaagggtaaacacatgttgcccccaaggctcctgatacagtcccacagcccagttgtactagaggaccaggatctacacaaccatgataaaattcaagaatcaagaaacggagttgaaaagcaaaagggtaggaaacagaaacagtttctgaatggaggctcaccactatccttcaggatatatgtcttggatacgtctttcaatgtctcatatacagcaagatcaattccggcataagggacaataccaagcaaagatggaaccagacctctatagaatgctcgaggaccctcgtgcatcaatatatcccttgacaatgcaccaagactaggtactttaccatccacacatgaataagtctgcagtcgtgttttcactaaatctacgggataaattgctgtttgtgctactgcaccagccaaaccaccagctacaagacgttcagaaggaccaacttcgctcttattttctcctttgctcttcataatatattctttcagcatttcataggcataaaatcttattgcgctttctggagcaactttcacaacattcaatccattccctctaaaaaatgctaacatgccaccctggctccatatatccttaattgaatgcatgactgtagttcgtgtagtctgtacttgcatgatcactttaaggcggtcaagaggtgcagttgcagtacgagatgcagcacctgcaatccctcctgcaatcagatatttacttgcattgaccgacttacttatgccttctggtataacagcctgttcacctatatctacaagacatactctttcccagtgatgataaatattctcaatggttacttcattaggatatagcaaaagaaagtccctccactcttcaaaagtaataattccattgttgtccttgtccacatgctcgacaaaccgtgca

SEQ ID NO: 55938 - DNA, 1089 bp, Oryza sativa
tacgtatgttgttgccagcattgttgttgaagaactgacgctgcggacgaacaacggacgaagaacttccatgtggtatggactggggtcctaaagtaagacgcggcttctgattattcccctgttgtgtcttgaattgagcaatccggcgtttcttctgctccatgcaattgtacttgttctcctggcgaatagccttatccactagcttctggaaatcaggataatctccaatcatgagtgaataagaaagctcatcattaagtccttctaagaacttctcctgacgctcttcgtcattgcgcacatcttccggagcataacgagcaagacgattgaactcgtgcagatactccgtaacagagcgtgatccctgggtgagcgacctgaattccttcttcttgagagacaccactcccgatggtatatgcgtcttccggaaagcagcggtaaattcaagccaagtgataggttcagcagtagttctgttaaggcggaaatgatcccaccattcagaggcagggccatgcaactgatgcgatgcaaatgagaccttctcctgatcagtgcattgaagcaaatccaacttcttctctatggcatgcaaccaatcacctgcttccactgggttggtagtgctagaaaaggtaggtggcctcacacgaagaaaatcagttaacctgttctgcggaggtgcatggttatttccttggttctgctgattctgaagttgctgcatcatcatgttcataagttgcacctgttgagccaggacttgggcaagagttgggttcccttcattgttattattattgggattgttggggccattcccattgctgcgagtattcaccatcttgctggacagggcacaagaagagaaaccggggggggaaactacttaggacagagaattactttaacttttattgatcttaactgagttttattacaaaactgaaaactctcacaccactaaactcaccaacttcctaacactcaaaagcaaacaaacacatgcacttacatcccatcactgatgtaaattacatgcgaagcacacacaagcaacttaaagcaagcaaacta

SEQ ID NO: 55939 - DNA, 735 bp, Oryza sativa
ggtcacatgccgccggtcggacattagtcggaaaagctttccaacaagggtttttctggccaaacgccctcaaagacgcctgcgacatggttcaacagtgtgaagcctgtcaattccacagtaaacacacaaagctgccagcgcaagcactccagactatccctttcacttggccgttatcgtgctgggggctagatatactcaggccattcccacgaggacagggcggctacaggttcctattcgtggcgatcgacaaattcaccaagtggattgaagcgacacccacgggggaaatcaaggccgacaacgccatcaaattcatcaaagggatattctgcaaattcggattgccccaccgtatcataacagacaacggctcccagttcatcagtgccgatttccaggattactgcatcaggctgggagtcaagatctgcttcgcctcggtttctcaccctcagagcaattgacaagtcgagagggcaacggcataatactacaaggaatcaagacccgcgtctacgacaggctcatgtcacacgacaagaattgggtcgaggaacttccatcagtactatgggccgtgcgtaccacaccgacaacgtccaacaaggagacacccttcttcctcgtgtacggctcagaggcgatgctccccaccgagctacgacatcaaagcacacgagtacagaagtattccgatgaggatcaggaagagcagcgatacgacga

SEQ ID NO: 55940 - DNA, 725 bp, Oryza sativa
ctttatcacaccgactttcaaatttggttagtctaacactctttcgataaatataacacttgcaaccaaaaactcgaaaataggcaacattaggcttcctcccaacaattagctcacaggaagtctttttcaagagacgatgcaaataaagcctattggttgcatggcaagcgatgtttatggcttccgcccaaaaggaatcggaaacaccatattcattaagcatagtccttgccatctcaatcaatgtacgattttttctctccactacaccattttgttgaggtgagtaggtagcggaaagttcgtgtttaataccaagatcatcacaatagtcctcgatattggtattcttaaactcggaaccattgtcacttctaattttcacaagagtgcaactaaattcattttgggccctttttgcaaactttttgaaaagctcggcaacaatagacttatcatgcaaaaagaactcccaagtatagcgagaataatcatcaacaatcacaagccaatgactattaccaccaatgctcttataggttggtgggccaaacaaaatcatatgcaagagctccaatggtctagatgtagatatgatacttttagtaggatgagaacatgcaacttgcttgccggcttgacaagcactacaaagcttatctttctcaaacttcacatctttcaagaccacaactagatcacgttttgaaagtttgctcaat

SEQ ID NO: 55941 - DNA, 10379 bp, Oryza sativa
gctccttaagctcattgttctcaacaacaagtgaggcatcacaaatagaaatacaagagctagagctagagttaggcatatccacaagatcatcacaaaaggtagaaatgctagatgatgcaacataagcaatatggcaagtagcactatcatcaagcaaatcacaagatatgctaacatcaatgagagctccatgttgagtagtggaaaggaggttgtcatgagcttccttaagcttctcatgagaaatggtgagtctctcatgagaggtctttagctcctcatacaagacctctaaagaagcatgatccttctttagggccttgaacttgacaatctccttttcactataagcatgaagctcctcaaatatactcacaagttcatcataggaaacatcatcacaatcatcatcactctcactatcactaagagatgttaccttagaggagctctttgccatgagacaaagtggagcgaagagtgatggagcctccttgatggcaacaacggccatcttcttcttcttggagcttgcatcatcaccaccttcttcctcggacccggatgaggtggagctctcctcatttgagtcccattccccgatgaaagcctcgatcttcttcccttccttcttaagcttcttcatgagcttgtagcctccactcttcttcttggatgactgtctccatcatcatccttggaagggcacttggaagcaaagtgtcccttctcaccacactcaaaacacctcaagttggagagagtcttgttgggtcttctatttcttctcctatttgagttggagtcccttcctctctccattctccttcccaagagatcattgaactttctagcaagaaggaccatctcttcctccaagtcctcattgacttcattcaccttgctcttgctcttgtcttcaacttcggcttggagagcaatgcacttcttggagggtgaggcttcctccatctccttcttcttcaacttgtacatgtcattggtgttgatcttccccaagaggcttgcgggtgtcattcttgacatgtcgcagttgatgagcatggtgacaagggtctcatacttctccggtagggctctaagcatcttttgggcaacctcaagatcggtgtagtttgccccaagccccttgagatcattcacaatgacattaagcctcccatacatgtcattcacactctcatgaggcaacatggagaatgtctcatattggatcttgaggaaatgaagcttggtatccttgtactcacttgtaccctcatggatctccgccaacttgttccaaatctcatatgcggtctcaaggttgctcactctattgaactcctcttggctcaaagagttgaacaaggcattcatggcttgggcattgagttgaaggttgcggtgatcaatctccgtcaagggtgtgtcggtgatagcaaagcctacatccacaatactccaaatatggaagctcatagcttttaggtgagtagacattttaattttccaagtggagtagtttgtgccattaaacatgggagccttccctacatggttcacctcgttcgacatcttctctctaggtggtgaagcccaatcaagagagaccaagctctgataccacttgtaagatcgagatgtcgactagagggggggtgaataggcgatttaaaaattaaataacacctaatcaaatctaacctaagttgctaggcttggtgagggtgaactctaactaagcaactaagttatgttttgcaaacctagggtgatagtggctcaactatatctctaggaaagtaaatttgcacaaatgtaaatgcgacaatcaaatgagacaatgagacaagagacttttcaccgaggttcggaaactcgccggtttcttactccccgttgaggcgagcccaactccaccactcaaccacgaagccaccgcacgcccccttcgtcaaggggtgggcaaggcgggagccggcccacggagaggactacccaagcctcgatcactcggggtagttctttcttcacttcgaaggtggtgaactccaaaccactcacaaaccggcgccgggcctcctccacaatcttctcggagaggtcactgggcaactcctccacaagccgtctaggaggcggcaacctccaagagtaacaagcaatgacccggtgtggagatgatcaagtgccatactagctctacaatggaagcaaatgcacttgactcttggctaaacaaccctctaacacactagatggatgaacacaaagctcaagtgagtgtgagagaggtgcaaggggtgtatgcaattgaattgggtgccaagagagcccccttgctgctggtgggggagtatttatactcccacccaccaaaactagccgttggtggcgaaatcccccaactttgtgctctgccggtctgaccgaaggtatgtggccggtcagaccgtgctactctgcaacggctagaaaactagccattgaagtgctgtcagagggccccatcggcctaaccggttagaccgacatggggtggccggtcagaccggcctcagctcggtcagaccgccatcagctcggtctgaccgactacggctctgtcggctctgtatcggccatcccgagcagcatcatctcagcctctagggggccagtctgaccgggaaagtgccgctggtcagaccgctcgcggggccggtcagaccggccagggcaagccggtcagaccgccactatgtggccggtctgaccgcccctggtcaggccgaacccagtgaatttgcaagtgaatgtgtgtgtaatgaaaaagagagcacaaatgaaaatgcaatgacctaatgtggcaattaaaatcatctctttgctaggtcattacccctcttaatagtacggcgaaactaaaattaaactagcaaatttgatcaccctacacctcgatcaattctaaattaaagcgctagttttaccgtcttctttccctttgctttgcaccgtcaattttaatccatcgataatcatccatgcgcacatatctcttaatagtacggcgaaactaaaattaaactagcaaatttgatcgccctacacctcgatcaattctaaattaaagtgctagttttaccgtcttctttccctttgctttgcgccgtcaattttaatccatcgataatcatccatgcgcacatatgacgtggacctaacttaaaatgtatagctcaaagacaacggttagtccataattagtgcttgtcattaattaccaaaattaacaccgggggcctagatgcttcaccagcgttttgtcaaggttgctgcagccccgtcgtcatcttcgtcctcggctccgcgtcgtcaagtgttgcgccggccgtgtctcgccttcgtccaaggatcaccgccgacgtcgttccctcgccggtcgcctccatcgtccccgagccgtctccgccgcgcccgttcgtcgttgtcgttcccacgcctcgtcgcgtggtggtaaggatccgtcctctcgctgccccgtcctcgtcctttcggtgtcgccccatgcccgtcgtgtggttgtcgaccccggtacccatgtaccagtgtcggtagtcgttcatgtgtgcgtgtggtgaccgtgttagtgtgcccgctcgatagccacgtggtttttacatgtgcagcccgcgtggtgtctagtggagtccgtttgttggccactcgcctcggttgacacacggggtccgcttccgtcgacccgtagactgtctctgtgtactcggtctaccgtggtcccttaggttgacatgtggggtccgcatgtcaacagcgcagccttcctgtcttttccaggctagcgcttgcacatgttttatagttgcaaaacctaatcataataatccgtaaatcttcatataacaacattaaacttcggatgatcatatcttgatcatacgaaccccgaatcgacccgttcaagtctcttaatgtttgttataacctaaagaatcatgtgctttctttttatgtattgttattgcttctttttaggcttgtagctttgcttatgtgcttcgcgtagcttctgtcgttccggaggtttccaaagcgtactttgtggtcgtcgccgaaggttcggaaggccgttctctctgagcaaggcaagtcgcatcacccttgagcatattgaatctcagtttataaaattattttgatttaaattattgcattactgctttacttaaattcccgcgttatcactgttttatttagccacgcctatttacctttgttatgaccttattattattgctattgttattcttaccttgttcaccttaggataaacaaaaccccaactagtgggtactctattaacggttccactagtatgaatttaggtagatgcttcgctgattaattaggcaacactaggtggttttataactttagactttgggagttctcatatcatttggacactgtggaatggttggcttgtgatggaattgaacacacacctccccccccctctattcaaaactcccaaaatggttttaggctgggcacgaggtgcatggttctgctagtagcacctcggccactataaggaccagtcttcgagcctctgttgcaaagcactaccgtactaaccacatgtctaatgggtaaggcttaactcggtgctcagtctagtcctagcaagagtacacggatggagatggatgaagtcggggctcgatggacatctcgaggccaaatgaaggctacacgggctgcggctcggtagtcgagatgtcatggcacagggccggtgtcctgctgctaggggctcaatcttacctacctgtctcgggattccggccataggcgaggttgggtcggtgcttttgtcacggctaggatgggtaaaggggttatgtcacatcctttacgacgggttccacggccgtggaatgctgagtaaagatgtgtcttgtgggtaaagatgtacacctcttatcagagtataatctattcgaatagccgcgccctcggttatgggcaagcctagcaatgtacccaagttagtggtttaattcctaaaacttgcttaacaactaaaatgtggaatggttggcctgtgttggcttgggacgagctgggacccaggttgggttgccagttcggtctgaatcatcgtaggccttgggttaaggcaggttcgtgcgggttcacggccttgattaataatactatatagctctaggatcgtctttataaaatagctttgggcaactaagtgacttttaaatgctgtttactgcaaaacttaacccctatattattaccccttgtactcccttgcattaatcatgcatctcccggtgtggcttgctgagtactgtggttgtattcattcttgctctatctttcccctcttcagtaagagaagctttggaggagatgtcttaggtagagtcctggcttataccctagttgagcgcctgtgaagatggagccataggcccgctagtccgctgctgtttatttgttattgtcaggcctgaagtgcatttgtaataaggtaaatattatcgatataataaagatgtgtcttttatatcatgtttgtgtggtgtaccccggcttttcctgggacggggattaatacactagcgttcgggaaaatgcaaattttctcggttgcgacaaacggctagaaaactagccgttgtagcgctgtcagagggccccatcggcctggccggtcagaccgagccgaccggcctcggctcgatctgaccgaatacggctccgtcggctctgtatcagccacctcgagcaacaccatcccggcctccagggggccggtttgaccgtgcatgtgccgtcggtcagactggccttatgctccggtcagaccgccgttgtggcgccggtcagaccggccaaggcacgccggtcagaccgccacaatgtggccggtctgactgcccctggtcatgccgagcccagtgaaaggtaaagtgtttgtgtgtgtgtgtgtgatgaaaatgtgagcacaagtgaaaatgcaatgacctaatgtggcaatttaatcatctctttgctagatcattacccccttgatagtacggcgaaactaacaaataaactagcaaatttgatcgcccttcacctcgatcaattttaaaattaaaacactagttttaccgttttcttttcttcgcttcgcgccatcaaattttaatccatcgatagtcatccatgcgcacacatgacgtggacctaacttaaaatatatctcaatagcaacggttagtccacaattagtgcttgtcattaattaccaaaattaacaacgggggcctagatgcttcaccatggagatcatattgaaacttgttcaaaaatatcaataatgttttaggtgtcccattagaaatgattatctaaaagtgggccataaaacctcggtctcatgctgggccactatagatctcaaattaattaatcatgttaagtcttaagtgttcatgataaattattctagtatttgataaagttgttggacatattattttgttcacagcataggtgcagcgcctttgtgcatattgttgtttaaatttcaactttcttttttgttttttatttttttttcacttcacggaaattcgcaaagggaaaaactctcaatatgaattatttattattattattattatgtcgaatttacccaaactatcaccaaagtgtgatttgcctcgctaaactacgaaaccagataaaatacatccctcaactattcaaaccagacaaaaatatccacctcaacgtaccggcccaatgtgacaaattttgttgtaggacaccgtgacttcgtggttttagctcccggacacggcaaaagttgatattttgggaagacactctcaaaatatgtttaattgctgctggacaccgcatgtattaaaatattaaattccgattgaataggagagaaaaacaacatgaaaatataaaaatgtctgaaagggtcaattaggcctagagggggagtgaataggctaatttaaaactttatgcggaagctaaaactgaaataagattggaaagtctgatccacagtcagactatccgaaaatatcagatagtctgatgttggatcagactgtctgatccaccaatgaagcacaacaagtagatctatcatacaaacaagagtaaagcacaaacagtgactagatctatagcggcacaattaagcaaagctaaaaggaggatgaagggagatcaccaatgatgaagttcacgaagttgttcctggagttcaaattcttgaggggattctactctccgttgagacgctcactaagagccgggtctttgctaaccctttcctcaagaggttacactaagcactcctccttccactaaggggtatctctttccttgcggaggcgagatccggccttcacaaacttctcccggccaaccacacgtagatcggtggctcgggagtgacacctagccgtttaggagtcctcaacctccaagagtaaaagacaccacacaactcttggtcaaaccctagtgctcaagatcgagtgaaacacacactaggccctcaaacaccaaatctacaaccaccaagatccaccacacaaagaacgaggagggatttgagagagggagaaagagctcaaagatccaaagcaccttagcaccaagctcaacccaaaatgaatgagaatgaaatgagttgggtaaccctagaaaaagggttaggtggggggtatttatggatcccccaaaaagtgaccgttggaggggaatctttcagcccatgtcggatagtccgatacaagattggatagtccgatattttaaacctccaacgcaacgagaaacagacaacgaagttccatgaaatttcggactttccgagacatcggactatctgatgttaaatcggagtatctgatatttttgaagcaaaaacttcgtcctcaaacagagactcaagttccatgaaatttcggagtctctgtatcatcggacatctgatccaacatcggatacaccgacacatagaaaaactcactcgaaaggattttccaaacaaagacagagagtgaagttatgtgaaaaatcggatagtctgatttcaaatcagatagtctgatgttgctcaagtaaaactgcaataactttttactccgaactccgatttcgaagatcttggactttatggaaagctagtttcgtgggctatcaaacccaacataaaacatggtccaaaaccttcaagagatgttgaaaaacttgcaaagaaacccggtgtaagtgttgtgacaagtgaaacaactcgggattgaaattttggcttaggtttttcaactcacacaaagatgaagcattttgagcactagtgttctaccaattatatgcatgtggtatccctcttaatagtacggcattcctatgacacaatgcaaggtaaaagatataatatgccatttgatcactgccgcattgcatcgtgatgtcgcattcatggggtatgcatctcattacaacatgtcgaggacataacaaccttcacatttgcttgaataaaagtgttagtcctctctaatcgcattgtaatcaatcatcaaaatcattaggggcctagatgcactttcaatatccctaggcccacttgtcatattctttcctcttgctccttatttcccctttctgcaaacaccccacttcaaacgaagcctcccaatggccttggtggagacgaaggctcccgatggtgtagacgctcgagggaacaagtgctaggcgtcgggcgctcgatgacctccatcctagagaagaaggtagagtgaacaacggacggagcttggcaagatatggccggtcgtctacatgaaggtggttgacacggagtcattgggggtggacgaggggacctagtagccggcggtgaggtggaccacccttgggtggagcagagcagggggcaaagctatggctctccctccaaatccatgggaggaacaacggcgacggttgtgcaagaagtgaagggccgcgtgcgacgacaggaaaatagcctatggagatggttccctagcggcaactcgagatctacatgggtgaggaggtttcagaggagtttgccggtgtggagcgcctggcgcggggaggaagctagtgacatcaacgagatggcacaccagaggcggtgcaaggagggggctgccggtagaaggggaaataaggaggaagagaaagaatatgataagtgtgcccagggggcatttttgaccttttcacgctatttatctctcatattcaaccggaaattaatattttaattaatgtgtatggtgtccagcggcaaaataaccatattttgatatcggaatcgctagtgctctgttgacagaaaatagggtgctaaatctttcacttttttggccattcatctctgtttacaattcgtgctgcatttggattgagcaaagtcatgcacggctgtggactttgagatggaccgagcttttgttgttgcgttctgtggactttgttgttgcgtttttttggtctcacatatttaccgttcaatttcgaaacacacgcctgtttttcttccttgcatttgagcagtgttttctactgctactttgcttatgatccacgcttactaattacatcgtgcttacattataattacatatgtaattttgtgacttacatcataaatatactaaaattacatatgtaattttatgacttacatcataaatacactaaaattacatatgtaatttggaacttacaatgtaaatacatgcaaactttttttttaatagttactccctaaatttaaatagatgagattaaatttatcctatggcttgaaaaatttgcatgataggaggctagaaaatctatcgcataatgtataggcagtccctaaaagaattgcttctctaatcttacattcttctgtttcccgtaatttagtggccgcgccacatagcgcgcgaagcctttctagtaataggtaatttttgctggctatactgagtccaaactgaataaagtacagagttagggaagaaatgagtagaaagagagtgtgagcggtcgactaattagtcgccggctccacacaagctccaatgcaacactagcggcgcatgactagtttctgttaaactcacaatggctgctcacttctcaagataaatgaagtggacgggaaagcttcaaaagaagaaaaattagaataaaaacattaagaagggacacacaaatagctctcttattatatacataccacagttattagttaattaaatgctaatatgaatatttttagacccatcagtcggcta

SEQ ID NO: 55942 - DNA, 2039 bp, Oryza sativa
  unsure (1)..(2039): unsure at all n locations
gtccacctccatggtgacgggccgcgccgcctcttcaggcttctcgatctccatcgccgcgccgggattgctgctgcttgtctcaggcttggcattgctcctgctcttggttttggttttggagagcacggcagagacaaaatccatgcgcagattggcatcctcttccactgttttgtttggtaggcaagcaagcaaattacaatccattcctggttcctctccttaaaaaccaaaccaagcgggcctatgtttactgaagattagtctttaacaggggcctatgtcaattccttgccgtcatcaaacagacagacaaacaaacaacacgatgatgatgagttctgtcttgacggctgcttccttccaatctcctcgcaatttcatcaaactacaagtacagctaaggcctcagcagcgacgcctgcaacaccaacaacagcttctgattgttggcagcaacggggcaataacaataggaaacatgagtttgtgccgggattgctgctgcttgtctcaggcttggccttgctcctgctcttggtcttgattctggagagcacggcagagacaaaatccaagagcagcggcttggccggcgccatggcgtcgatgatgctgccgccactgcgagagatggcgtggcctcggctgcgtttccggctaatccgtcgcagctaagaagctcgccgacggctgccacggggcgcttccacctctgcgcccatcgccgtagcgccggcctgcgcccaacccactgccgctgcgtcgccacgccaccccgccgcccgtcgccggccacccagctgctcccccgcccgcgccgctcttccgccaccgcaccggccggcccgcatgagaaaactgagaaagagagagagaggaagggagagaaaagaggaagagatgatgacgtggtcaccctgatgtgtggggcccacgtgggtcccacactgagtcagctgccacgtcggataaaaccggagtcaaaactattaatggaacttagtttgcactttttataagttggagtatgtgttgtatccggttttgctgtttaaggacgattttgtaacttgatgacaagttgagggaccttcgatgtactttttccttttcttcattgctggttttttctccctccaacctcaaatggggcggtgtggcccgattccagatgccttctcgtacaccgattccagatgaaacgaatcaatgggccggccggcgggcccgctatagctacaccaccccccagtccaccacacgacgcgcgctacattctccacctctccaccattccaaactgccaagtggcaacaaacctactactaaacctgagaaatccagattcccacccgancngacacanntcctntctcctcnngcngcngccgcgcnntcctcncaaaccctcccctcccccatggcagaagacgccgcggcggccgccatggccgcggcctccctctccgacgacctggagcccgccaccgaccgcacccgcatccgatccatcctggccgacggcgccgcgcgcgccggcgagcgcgtcgtcgtgggcgggtgggtcaagaccgggcgggagcaggggaaaggcaccttcgccttcctcgagctcaacgatggctcctgcgcctccaacctgcaggtcctcgtcgacgccgccgtccacccgctcgcgccgctcaccgccacgggcacgtccgtgctcgtcgagggcgagctcaagaagccgccggagggcgccaagcagcgcgtcgagctccgcgtcgaccgcgtcatcgaggtcggcgaggtcgaccccgccgcctacccgctgcccaagaccaagctcacgctcgagaatctcagggacgtcgtccatctccgctcccgcaccaacacggtccgtctgtttcgcctcacaccacgaaaactgaagccctttctgaagtagactacagaaatttctagattttgcaacttccgcactagttttgataaatcctgccgtgatgatttaggatgtctagttcctggtgtgaaaattatggttt

SEQ ID NO: 55943 - DNA, 734 bp, Oryza sativa
caatgtcgaccaatgtagcccgcgtactggtgtgtttggaggaagctggggaacaatatgaagttgttccgattgatttctcaattgctgagcacaagagcccagagcatacttcacgtaatgtaagttattcttacaacttgttctctccattttttttccatcaattttcatggacaaaataacttccatttgtctgaacttttggatcaatcgactatgttgatttttcatgattccattctctctttttccccctcatacagccatttggtcaagtcccagctcttcaggatggtgatttaattctttttggtgagatttttttttcttcccaccatgcaaagtcttttttttcggagatgtttttttttcgcgagggaatgttttatttcttgcatttaccaaaatagttatgaaaaaaattaataagatagatcaatttatgatatcgcatatgtatctatcatcttatcaaaatattttttaaaaaaatattcataactattagataacaatgcaaagaaagaagacattccctcgaggggaaaaaatgctttcactacttttttttcgttcttgattatttttaatccatacaattttacactgtttcaacagagtcacgtgcaatttcgaagtacgtgcttcgtaagaacaactctgaactcctgaaggagcacaactttctgacgctgccaaggttgatgtgtggctggaagctgagtcacacc

SEQ ID NO: 55944 - DNA, 2465 bp, Oryza sativa
aaatgatgttgtctgagaggaagtgattgaataaaaacatggagcaggaattatgtttgggcggtttgcttcataagtacatgaatgtgttgctttgtgaatcgaaactccatggatttaagctaaataattagtttaacaactcaattccccaattctaacattcccagtgaatatgatggctgttcgaaggagcatctattaattgcacttgtttggatgttaaaaaaaaactattttagcaatcatactatcttgccgtactaaagatttatctccgcaatgatttgttttcaatggcgctagacctagtattaccgttgttttacaagtggtggcatatgagagcaatctttggtgtgcagtcggtgtcaaagcgctccatgaacttctatttaggtcagttggctcagctgctgacttgctgtgttttcttgcacgggtactatataaacaggatagcttcgattctcgatgtacctatatggcacaataaaccatgtggcttcatctattctttaccaaatcttgttttatcatggatgctatcaaatttaatacaattgataacctttttacttgctgtccagtggatcttggtgtgtgctcgctgtgtccttcctctgacatgaacagagctggtcttatatgtaaattgcatcagacatacctttaccctgtatctcaaattgcatcatgatgttcatcacagcagcaggatcccaaattgcataagacttgtctttgactcggtgtaaattcaacttctctgcattgtctcaatttgtacccaaaagcttttgttctatcttcagtgagtcaaattgcctgttctttctggttaatggatgaatgaattaaccggcacgattcttgaactcctaaccagtactattttttgagaaaaactttctatatacgaatttcttataatactgttttaaatccaattttctactttatagattcatttgtaccatcaaataattatcccaaatcattcatctattcagccattcattacaaaataattcatataattatcacaaaagaacacacaagctcttcatatttttcagtctttgtgaaccgttctcatccaaaacgcctgcatattattcccacctttgcaatggggtgttttgagttgacaaaggatttgtgcgatcagattagcaagatgatagcgaagtactggtggagcaaccaggagaaggacaataagatgcattggttaagttggaataaattgacattgccaaaaaatatggggggcttaggtttcagggacatttacatcttcaacctagcgatgctagccaagcaaggatggagattgattcaggaccctgactctctgtgctcaagggttcttagagctaaatacttccctctgggggactgtttccggccaaagcagacatcaaatgtttcctatacttggagaagcatacagaagggtctcagagtgttgcaaaatgggatgatatggaggatgggagatggatcgaagattaacatctgggcggatccctggatcccgaggggatggtcaaggaaacctatgacacccagaggcgctaaccttgtgacaaaagtggaggaactgattgacccttatactggaacttgggatgaagatttgctgtcacaaactttttgggaagaggacgtcgcagctattaaatccattcctgtgcatgttgaaatggaggatgttttggcgtggcactttgatgcgagaggatgcttcacggtcaaatcagcttacaaggtgcaaagggagatggagagaagagctagcagaaacggatgccctggggtctcaaattgggagagtggggatgatgatttttggaagaagctctggaaactgggtgttccaggaaagatcaaacacttcttgtggagaatgtgccacaacacgctggcgttgcgtgctaacctgcagcatcgaggtatggatgtcgatactagatgtgtgatgtgtggccggtataatgaagatgctggacatcttttctttaagtgcaagccagtgaagaaagtttggcaagctttaaacctagaagagttgagatccatgctagagcagcaaacgtcaggaaagaatgtgttacaatcaatttactgtcgcccggaaattgaacgaacaagtgccatagtttgcctttggcagtggtggaaagagaggaatgaagtaagagaaggaggaataccaaggagcccagctgagctctcacacctgattatgtcacaggcaggagagtttgttaggatgaatgtaaaggaaaaaagccccagaacaggagagtgtgcagtttggagacggccacccctgaactttgtgaaaatcaacaccgacggagcatacagtagtaacatgaagcagggaggatggggttttgtgatcagggatcagactggcgcagtccttcaggcaggagctggtccggcagcttatc

SEQ ID NO: 55945 - DNA, 1668 bp, Oryza sativa
cccggagttgtaataaggtggcacatgagcttgccgcgtatggttgtaatctccagaccgtgtcttcctgggcaggctgcccgcctggtctggaacggctggtatccagcgattctgctggtttggtaatataaatctctcggtttccctcaaaaaaaaacgcctgcatatttcattcctcacttttcagagaagccacaaccacaaaccagcagcgtgaataatgtttattacggagtaatcactatttccatcagctgacaactttcgatactgaattactgatactcgttcagtctcctgcatacacattacagataagtactgtagtatttttgcatctatgtcatttctcaattactcctagtgccctccattgctgagcggtggaaccttttttttttttttagagaactctgagcggccaatctatccatcgttgtcctctgcgccagatttgggtgccactcgacttttgggtggtggatctatcacgaacagtagtaaccttctgatttgccttccttgaacctctgccagcttcaacttaattatttgtttctttccaaaccagcctccctatagatcagtagctgcaataaaattgtaaacattagccatgtgaaaagtatatcagaaaatttatcttcatatgtagcttcataatattgtataaatttacaatatccaccaacataaaattgtagaaattaatcaaaattactggtaccaggatggcatgtatgtgtaaacagtgtaattttcatttctattatttatacaagctctagttgaataatacaggttacctcatagcaggtagcaccgtggtagagcagattcttgactggaattcattcaacatggcaagggaatacgcgatgcagtgagatccaaacaacgaacagtctgaggttcacttcaatctgattcttgtctgtgttttcccactgttgtagttcattgttaggaaaaccacatcggaggcctatcagctggtgcagaactcaagtacatgatactgatttgaacaaagttttgaagtttgaattggaccagttgaaacctttaactccaaatggctataagattgaaccattcaacgagttaccttactttggttgatcttttcgctatctgttaacattcacttcatagtttcatgtgctacttttgacctcattattctctagcaattcaccacgtcacacagagagacctggccgtggtcctctccaccaagatttctccatactgtgcggcatgctagcattagcaagtcatgcacccccaatggcccttccagtgagatttagtgtacgggttgaattttcagaaatcagttcaaaccatggaaccagtatgcctcagcaccctttttcttcccaaaaccggtaagcaggagctttattcatgaaatagcactacagtcatctcagagcgaactcatgcttcaaggcacgtcaatgctcatccggcactgggccacaaacaactgacagattagcttccctctgaaacaaaccgaaacaaaaacccagcacatcctctcaggtacaggcagcccgcatgcttgacagttagcctgcaaatattttagcaaaataactaaatgccctgctccgaatactcgaatagaataaaatatattatcatattgcctaacat

SEQ ID NO: 55946 - DNA, 713 bp, Oryza sativa
agtcaatcatggcttgtttcacctcctcgtcagtctctccaagaccaagcatgatagaggacttagttatcataccctctttgcaactttttgcatgcttcagaacagctaagctctgatcatatctgtaagaatgaggtaagaaaaattcttacaatgccagaggatatgaggaaaagaactgtgcatagtacaagttattaactgcacattgccacgagatactagaaatatagtgtatgcgcaaaatcgaggataaactggataaactatatcctaccactatacttccttcgaacagattctaagggaaaggtagttgatcaggcaaaataaatcatctcccaagattatgatgcgagaaacgttcagaaataaataagagtaccacaactcaccaatcaaacagattgcaaagctttgatatttgcaaaactattgttatgtctcatacaataaatacagcaaggaatatgcaggtcatcagatagaaaatatctatggctgtttttattttgcaatgttacagtctacaatatagtttacacttcagagacaacaatttgcaacctatatataagcactattacactgtaaagtatgcatagctcaataataattagattcatttttactcggggcgaatttaagattaatcacttaaactaagacacaccaatagcctgagaatgatcatatagtcaagctgtaag

SEQ ID NO: 55947 - DNA, 8453 bp, Oryza sativa
tgttggcaggtcatctatgcacacaactttaattaagaatatatattgcacttaacaattaacattccattggagaaaaaaaatctggtaatgttttcactcaaaatctttaatgtataactttcatcattttcactttaatctggaattataatctaacctaaaactgctaaaatccaaacctgataatttatgagactaatggttcttgtcttcaagagaggctaacgacatttgagtttgtgagattgcaaacatcactaaacaattcaattatgaaccctatccccttagaatgcaattgaaggacctctgcactctttgatccagagaatagagggatacatatgtaatatgcgtctccctgcaccgcagaaaggggaaaacacactaataattgtgccatacttgacagttaatgggcaagacacaaaatgtgccattttcaaggtgacttccagctgatgttagctccatcacatcaactccaataagtaaaaaagtgcaaaatatcttcaagcctatcattggaattaaatctaaaaatatgttccataaaagaacttaatacttacgaggtaacgaaatagtgtagtaagatttgccaagctagatcaatggggatccacttgaatatgggaaaggcgagtgctttggttaatgacattgtggaacctataggctatgtataattttagtgtgggacccccggaccaaatcacattggacccctgatccaacccaatcaaataggcaaagcaagcaaccagaatgcaagacgcctgatggccgaatgctaattaatgccagatgcctgacggccaaacactaattgcaatctgcatcccacaacttaatttattaaactgatgaattgctttcagattaattaggggcattgggcattttgtttattcaattatgtgcactgccacaactgatgcttatcgtttacactataatcggtaatcggcagtcagccaagtccttaggtaattaactaataattgctttgtagaataaatttgtgtgatcagtagtccaccatgtttttagacatttcctgaggaagcatgactgatatgatacttgtgagatgcttagcaagcagaattcatagcaagtaaaattatctcctaaacaagagcaaataacatagcgagacgatagaaccaattgactaaacatttggggccccgtatcataagcaaccctgcccaaaccctaggtaaacaattttatgaccccaaaataataaaagcacaaaatctttattgtttgaggatttaggaagagaggatatcaccttaacctggagtctgtactgcgtagtgccgtaacccaccacagctccccggcgggcgcacgcgaggaggagccggccgacggcgagcccagaactccagaggccacgcgcgaggaggcggcggcggtggtggagaaggcgccagccgacggcgaacctggctcactggcggccgcgaggaggcggcaacggcggggtagggcgagcgtcgggcacgcgcgaggaggcggcggggtagggggcgcggctgcggcgggtgcgcgctcggagttggcggcggcgcctggcggtccggcgggcacgtgcgaggaggcggcgagcggctccgggaggcggcgacgggctagcgcacgggagagaagttttttttttcgatcgctgtatcgctataaccgctgctaatcgaacttggggatggctaattgcagaggttgatccaacttttgatataagccgttggatgaatagatctaaaagtcaggaaagataggtgtttgatgaacttgtgttttttatattagtatagataactactatatataactatgaacagagtctgaaatagagcagtggagtagccccccgctccatccattttcatttttctagaacacttgataggtaaaaccatttggttgagatgcattacagaacaatgtcaataataaaattcctcgcaaaaaaatgtcaataataaaataacaaatactggaaaatgaagcaacatttttgtaaaccagaatctagaacctaattttatgagatgtaaccttcatttagagttttagactaatctgatccacgtactgacgtacatccaatgaaccaaaccgaccataaaaattggatggtatcctcaattccccatcctcctgctttgattatccgacctgacgggctatagcgtggattgtatcaccatcctccagtttgagatcatccggagtttgcgagtcctgaacacgacggccctcgtaaattaaaacacacccatgcctgtacatacttgcaggctccctgcttaagcacaggtccatcaaaccctgcagcttgtcagtccttcgcagggtgtatgtgcgcttggccttcaccatggttaacaaatcgatggtcacgaacctgctcggtttgctcgccggaacgaggcggagctgatcgccgtcctccatctcgtaatccgcgggcgtctcctcgccgccgacctgcctgccaccgtacgtgaccgcccactcgccgttctgatcatcagttggcaccatggcgaagtagtaatcgatcaggcgctgcaactcgtcggtcctgcgcatggggcgggtgacgacgacgccgctgcggccgccatcgtcggtgctgcccttgatcgtgagggtgacgaaggtgctcggcttgctgaacagatggaaggtgatctcatcgccgtcgttcatgtcacatttctccggcgtctgatagaaactgatctccctgccgttgtacatgaaaacaccttccctgggcgctgtcgagggcaacatgtcaaagtagagacggaacagggtgcagatgacgtccaacctacgcatggtgtgtgtgacccggcggcctttgttgtccttcacggtgagggtgacgggcatggtcctagttccgtcggggaagaagctaacctcgtcgccgtcctccatgtcgtagtccgccggcgtccggttgccggtcacacaacggccgtagtgcatgaagacgccaccaccggcggcggcggcgacggcggcgcccttgcccttgtcggtcggcgtcaccatgtcgaggtagaaaccgatgaggacgcgcagcttgtccgtcctgcgcatcgtgcaggtgatcctgacaccttcgttgtccttgacccttagggtgatgagcgtgcttgcctcgacctcctctccggccgaagacatggctgatcgagatctcttcgacatggctgatctagaacacagaagccgatcgagatggagtatttgcctggattggttgagttttgagaaaaccttgaggattatgtagaatcaccatccggtacggtataatttgtggtataatttgtttctatagatttgtgcgcgcatgcatggcggaacgtgcacgcatatgcgggctaccgccaagcgcgcgtggagcagtttgctgcatgcgctgctctatcttctcctatattttctccagtgacgacgctagggtacgtacgtgcacaccagtgaaattggagttgtgcgttctgaatttcgtgtttttgaatttgagaatacgaagttagttcgagatatggttggactagagcgaactactggcaaaatgacatgtcagaactatcatctccgatgagcaacctgactgtatagtatagggagaggggaagatactacgaatattagacacgctgtattaagtcttaggagccggtatatataagagtacatgggaaggatataaggaaggattacagataagaaaagaatacatacaaatcaatcattcctaatacatctttaacaaccatatacttttatcactaacatgtacttgctactatgacatgcccctttcggttgccgcatgatatgcatgcatggcaattgatcaatcatgcttaaattaatgaggtccccccttcacaaacaaaagcaaataaatacttgcgttttcactgggctgggttgcccagcatgccaagaattataccgtccagtatttattgtgaccttcacatggtttcgggtgagtgcaatccatacgcgcataatagccactcaagtctcaatgcgccccatgatcataatcaaacaccgttcaatataatttacatggtatcgaatattaagcacaaaggatattgctgggactcacgcgtgccaatcaacttctgcatggcatgtgcccttcaaatcactcgaaggtggcgaccagatgtattatacattcagtaaacttgactcaaaaggcatgagctctacaacacctcaattcaataccatactcatgtctagcaagttctatagtcatagtgttgatgtaaaaacacgaggcctgggagatctgcttaactccaatgcaggtccaaaacttgcctttgggtgtatgagcgtgccagttgatttgatcctgcaatcaacaagaaacgaagacaaagaaaccgtggttaaatccataaacgatagccgatcagctaggtgccgatgacatatcatttatctttgagccgatatcatatttgcatcgatctgcaattattaacaagtaagaaagaactaaatctactcgatcggctgtagatattaacaatatataatccttacgttgatatatacttaaatcaagtgattgggatagatcggtcgccatgccgagacagtataaatcacttagatcgaaataaatattaacattgagagtatatatgttcatagcatagccgatcagatagatctagcttgtatcggctaatactccgataccactctatattaagatgttaaagcaaatagaatataccaaacagaagcctaatctacttaaatgcaacaagatcttaatataaagggcagatttaacatgtcaactaagcacataagacaaatatagtcaaatcaggtaagatcggctgaaaccccgatgctaccctaatcagcaaccaaaggcaggctagagattgagattctaatcacgactcataagatcaaactcaactgatacagctataagtatgaaaagaagaacaatatctagacaatcaagccgttggatgtgtcatagagtggtggatatcctatataatctaagtcaacatcggtatttaacctaatcggctgccttctactgacagatgttagctgattataggttagatagcgatattgccagagattatgtaagatatatgataactcgacgaattacataaacaagattagagtgtcatgaagatggaagcactaatcctgagaatgcaagccgtcataacaagttttacctcttgtcgaagatcgaaaccgatgcagctcaacccgaaagcaaaaactcgtcgaaacaaaacgaaagtaaaaagggtggcgatgcgccgagattgtattgaacgtgtgttagtttgattacatggggctcgaggcctatttatacccgagaattacaaaatatgtgtaacatacccaaagttctagactttaaaagtttcctgtcaaaatagttggaagctaacttttctatttttgagagccaaaaatttccattttaaacctaggtgaagttgatctaactcttgcatgaataaaatttgagaacaaattaaaactttttcatttataacctaggacaaaatgtaaacttctgtgtaagcatgcatactctcatatgcatactctcatagacatgtttgacttgagtccttcatatgcatttggattttcgatttgcatttcataataggtctcatgaatattaacgataaacaactaaaccattagggcttagtgctagctagaggaagttaaaataggaaccgtacaccttaaaatatatcaacatggttaatgtcaagcctcacaaaactaatttggtcatccatctgaagacatgtcatgaacatgaaagtgaacaaataaattaactcatatagggtatattctatcttaatcatctctataagcatcctcttaatttaatattaaagtaaacttatgcataaataggtaaggagcttacgacctatgtaaggtaaactgtaattctaccatatcaacatcacctcaggttaagaagagtccaaataaaacttttataagcatttacatgcatttaggaaaagggaaacacataaaagagataagcatcgctaattatctaaaataattcgtgcaagataaaatgatgggaaaatttatgtaagctctacttaatatatacaactcactgtaattttggtacaatttaataactaaatttgataccttaaataaacaagtcaaacttgtcaaataatagactaaatataattcttaatcagctaaaaccatacataactaaaatgtgcatttaactgcatggaagtgtataggggaaaatcatgaataaatataatttttccagaatttatcctctcagtttaggtcttctaaattcaaacaatgttctatcgagcccatcttctcctattttctgtgagcaatctatttataatttttaagtgcaaccaaagaaaatagaaactagctacattcatctaccttcagaaaaacccgcactaatttgtatgcttcacacgttaaaatattgagatataaagttggagggagagaattaatctgaaaatcgtccaaaaatcaatcaacacccagtttcttacccatccctcagactcccacctagcttacattgacctgggcccacatggcagcctctttggtttgaaccacaccctgtgcatctcctccatccaacacagtgacagctgagagagagagagagaccgagggcgccgaccggcactggacggcgtcgacgcgtggcctcgacgtggcagcgccgaaccgaggcttcacctccacccagctgcatcgcctcctccccattaccactcctgagccgagcaaaccgagggggagagctccagcttttctttttcatctcgaccttgtcgccggccgtgaagacgatggccgtcgccatcaccattgtgccgcggtcgtttcctcttctcttgcgttccattatcgcctctctacgccgattccatccctcttaagtttcatcccatttcatgcagtggtttggtgggaacgcaaacctcgccgacgatgctctggagcgcgcactgggcgccgccatcgggacatcgtcttcgttgccgtcgaaccggagcaagccgagccgagccaccgcaccatcaacatctcctcggtgtcctctcttaaatccctcatgaacccctgccagtggtgcagcgagcttggagatcggcatcgtcttccccaattccggccgtcaagctccaccttcgatttctccctctccggtgagtcacagttcaattcctcgggcataaagctttcctgagacctattcaacaccgtgtgtatgcatgcatggtagatcatcagccatatcaagccggcgtcgtcatcgagcgaggctccctgccgtcgccgagtcgttctgctcgtggtcatcgctatctggacctcgccaagtttcattggacgctcggtaagcatcctaggatcccatagaggcacatgcatcaatgctcaaactccacatgcaccgtcacccgagaaccaccgccgctcgcgccgccgtcgccattaattccgatgaccaatgcttgcaaaaataccacctatagcctcgccttgaacccctttacattttatccttatgttgcacaccgagatctgccgccgtttgccaccggcgagctcgagaacgagctcggccatggctagctctgtgtctgctcaaaccaaggacctctgctgagaagagtcaaaactctaggtactagtttgtaaaacctacctcacacacagaacagtcacaggactgcgagttgatttcctaaaaccataggggcctttttgcatattggtctgagactgacctgtggatccaatctatttaaattctggaaaaatctaaatgaaatgcctaaagctttatattttcaacagaaaaacatgtaaacttgtaaaatctataacaaattgaaaacaactcattttagagcaaacttagtttctacagatccaccaacatgttctctaaaaacaaagtaaaataaaacatatacacactttacatcaaatgcctctaaaactattatctttaaaataactagttttacataagctgaagtttagaagtttatataaaattcatcttagatcctttttgagtatacccaagttctgtagaatcaccaaaacatatacttccaagttataaaataaaaatatatgcttattgtacaacaaaagcctctaatatttatgtaattaataaccaacatagagcagcctttaatttgtaaaatttgtagaaaattcatctttagtccaaatggagtgaaccaagtttttatagaaccagcaaatggtgagcttcaacatagtaaaataaaatatggcaccttctgtat

SEQ ID NO: 55948 - DNA, 5021 bp, Oryza sativa
  unsure (1)..(5021): unsure at all n locations
ttagcggaagcattattctacccaaaataccttttatgcaaccgactagagtagaccctagttagaaccatcctaaaactgaagttatcctcaacaaagcaatcctcatcgatgaagacctcgcctgcatccaagtctagaataacaagacaaaaatacaataacaatagcaagggtcaaaatgagattcaaaacatatgtacatgcatggctaaaataatggaaggtcaaaagtagttcaatttcagcattaagcaagttttgtttttcacaaatatttttaaaatcatgttttagaaaaaaaaagaaaatttcagcaagcatacatatatcattactggcatctntnnatacantangtnaanaaaatnncatanncatgtatactaananncaactttggtgcctnnctccaaagcaacaagtataatgaaccatttcgaatctcatttcatcatcaattcacaaaaggtttagttcataattaaagagagaacaagaggatttaaaacattattctatactcaatacatatccttatgccgctcataatcatgaggacgactaaatgattagtttttactctgcggagtttgtacactatacccacatgatgcgctatagtaatcatgtaaaaacatgctacaccgtactgaaatacccgatttactactcacaacatagccgttacattactcatgatttagctttacactagcatgataagtatgattccaccctaggcatatgacctagagtcattaggtggagtgcccacgccttaacctaacaccgtggcaacaaacacaagagttttccccacgaggcactatatcgttgtattggatagacttagatgcctaaattaccatatatgtaaataggtagttcatatgaactaccactaaaactaattcatactacttcggcctaccagaatgcaaggctaaataatgagaaattaacttagtgagctctggctaccccataataacacatgtggtcgtactgtaatcacaagtgactaacattgagttaagtccttagagtgtgtcgggcaaacactccccctatcggtacacaactaaacatcacatgtataccacttgctgcccaagactaaaatcattgattgattcattttggttcacaaataatcacatattaattttctgtccagaagtatttagaaatcaaactttcaaaattaaagagtgcctataatgataactacactagtctaggcatggctaagtatagtatgacaattgaacaggatcttaataactttttagcaaaaggacagtacactgtcatgtcaaaaaggtgacaatcagtaggttaatcaagtttcaaagaggggaatgcaagaatttggttttagctatcacatattaaattttcaaccatttatgtttgaaactaagtatgcaatttttcaatcaaaacatttaacctccagaacatgggagcaatatgatcaacgagggaggggaggtggcttgccttgctctggttctaccacctgttcagtctcgtggatttcttcaactatcgcctgattgtcgtctaaacatacaggtgaaaaccaaattacaaatatacacaaagattcagcatggtctacaatgactgctgtttttatggttaataagtactgtgatgacttgatttttagtgaaggaatttttattttatcatatcccatctgcaagatataaatattcaaagttgcaaactactaaattatggcctatatgcatttcgagttgttaagacataaaacttcaaagttctgtcaagctgaacatttttagattacagattataaaaatatgaacctaacaaaatttagtttgaaatttttagaactataatgaatttccaaagttatgtcaattttcagctcaaaagagagtgtttaattaatttttcctctaatttttcaaagcctaaatatcctcgtgttttagtttatttacaaataggtactaaccccacatgtgagtgacagattaaactgataaaacacccctggatgttttaaaagtttgcaaatccacgcccttgcgctaacagaacagggtagcagtgagatatgcggcgtcgcctccggcgaaagatgaggtttcagattgtgcaaccaaaatgtagagtgagaaggggttctaggcgaagctatcgacagctttcttgcaagctatggtggtctacatggatggcgttggcattggaagcggcttggctcagcatgcatgtgtgcatattgagttagaggcttgatctatgcggtaccaggctcgtatatggaacttggggcacctaggaagctaacccgaaggccagcaaagtctggcgaagtctcaatgaaaaagaaccgagctcatcggcggcggggctccacagtcgttgtcgatgatgcgtttctagtcttgatatggccaagggtagtgcacgcattggttaaaggtggcatggcatgtttctaagcaaaaggaatcgtgccgaagctcaccagagagcgagagggagatagatggcgttggcaatcggagatgaggaagaagaaaggaatcttccaacctagaccactttgttccgattccgtgcgggttcttggtcaccgtggggtagtgaagacaatggcgagacggtttggccggattcagactgtggtgaccgggcgacgtctgcaactccatggtagcgctcggagttcaccgttggaccgagttgacatggcgcgctttcctgaggattggctgcattgggttagagacagcatggagaggagattgcggaacacggcttaagcaagaacagaattctcacctgatgactatgagcggcggactcaaccttgctggtgccagagaagatggttttgtgcacgacgaaccctagatgatcttccctagtttcttcacgaaatgagcagagggtgagaagaggagagtggatgttggccagctaaatacagcggctgcgatggtttggtggacccagctgataggttgaaccaaatcgactgcggctttggaatgaataaatagaacgaaaccctaaatatgccgtatcggctgtaatactgtctcttttgtttttatcaatcactttaagacagtattatagaaatagctgatagaccaatatttagagcaaagatagataatgtattagctgttactccaatacaaatttatataaacaagtcaatctatataaatatatcaaataacaatcgatcacaaaatatgaggtttaatcgagaccaatctaacttgatgtatttatatagagtaatatatatgtatataagtggcaaatatacataaaacatatcacgaaacatgcactatcatgtatattaggtaagatcggctgaaactccgatactatccttagttatgattaattccaggttagtttttaaggttctagacaagactagggttgatgcaacttaaagtatgataaaaatcaatcaaggaattatccacttttcgggatggtagatatcttagctaatctaatctagtaagataatttagccgatagcagcataaaccctaaagcgagaatcggccgatacgactaaatcgagatactaaactagattaactaatatatatgatagcgatgatcacaataaaatactaatacatctaaagcgatgtaagagctccaatagtgcaagccattgagacaagttgcctcttgtcgagagatcgcagccgatgccccaacttgaagcaagaactcatcgaaagtaaaaagagaaaaggtggcaacgcactgaaagttgtatttattggattgtcatcccttattacaatgatctagggtttatacttataccccggaaacaaaacgtacctattatggacacgactcaaactttcctaaagataaaacaaacaaacaagtccacatggcagactcttactatatctctaattcaaattgacattaatatcttaattaatagatataattgtcttaaacgagctctatctctatatggaaaaatcagttatctcaatcgaggcccaaaccgagcccaagttgagtcgtatcggctgcttgccatatccgctcaatcggcgcagtctgttttggcaagattcaatctccttcaaacccaattcgatatccaactccaaatccgagactatcttgccaaattttgctgttaacaaatgctaaagcagcaacataaccttcatctacaatctccaaattgagtttctaaaaatcagagagtaacttcggttgatcaacttggacagaggtggtaatgtgatgtagctttcagctgagagcatctgctaccacattagcttttttcgggatggtaatgaatgccaagattgtaatccttgatgagttctaactatcttctttgcctcagattcagatctaattgggtgaagaaatatttcaagctcttatgatcgatgaagatttcgcatcagttgcctattagataatgatgccaaatctttagagcatgaactacggccgctaattccaaatcatgggttggataattgacgtgaagcataagccaccactttgccctcttgcattaatataaaatcaagtccgtgtcgagatgcatcacagtaaatatgaaagctttcatgaatatctggcatcactagcactagggctgctttgagcctttttctcaattcatgaaggcttaattcgcatatctcagaccactcaaatttgtgttctcttttaaagagttgagtcaagggccttgtgattttagagaagtttttgatgaatcgatgataataatcagctaggccgagaaaacttgtgacttcgggaacgttctagtgttgtttccaattaaacacattttgtacatgttggcggtatgtcatgagacccttcgaccggtcctgctgaaaccgtgcaaccaatggagggttgaagctcaagacatcgagtctgtgggggcgaagcccacatggcgaagactatgaagcaaagatggcgaagggcga

SEQ ID NO: 55949 - DNA, 15265 bp, Oryza sativa
ctcagccaatcaagcccgggggccactgggccagcgttcgccagtcggcccattagaggcccatgtacctcaattacactatatacccatgtaaatgtccctttcataagggcaaccatgtaaattcccctgttaaacctaaaccctaataggggaacctgtaatagggctataaatagacccctaggccatgtaaaagggggatcccaagaaaaattctcaatttaatacactttactgctttccaaccactgttgagtactttcgacgtatgccgctgtcgtttcgacaacagctggcgccgaccgtggggacctccgagcgaaatcattgagagcgaatgccaccgaagagggtcgtgaagaagaaggtcgcaaagcgaaaggagaccgaagcaggagaggagatggccgccgaagaaggagcagagcctccgacgtccatgggcgaagctaggggagcaccatcggcttcggcaccggcgccgcaactgccaccttcggctcctgccgcttcgtccgggcagaggccaaacacggtcgacacggcgaaggcagccgcggcggcaagggcgctccagaccagggcggagatcctttcgacaagccagctgctggtgccccaagccgcttcatcacagccggcaacggcttcgaccgcgctcgccgctgcacaagtcaaccccaacctcgaagcacaaggcgaagccgacatggaggccatgcgacaaaacatgacgcaactccaagacatgctttgacaaatgcaagaacagcagtaggcatacgaggcagcgcggcaagccaaggtcgcttcggtcccaatcctctagtattcggcgggctacattccaccccaagtccacccacaagcatcaatccagccccttccgccacaagccatgcaagcgccagtgtacttcgccgggcagccttcggccgcaacaatacacccgaccccttatgtgcagccgcaggctcagccggtcactatccaagtacacccgccaccacctggccggccaaagtgcacccagttggttgccgtcgagccagcctggttcgagggtttcgccttggagtcaaggaccgcagttcgacttcatcaacactgctcaagcaccaaccattcgaccacaggaaccgacatcaggcttcggagcaaaccaagcgccaaaccaggtcgccatggcatggacccagccgtcgttcgacccatccatggcggcgcaccaagcgtccccgttcggagacgggccgccgaacactgtggcccaacctcacgcgcaagccatgacttcgcccttcgccacgccatagccgcagcaaggtgccgcgaacaaggcgggtggtgaaaagaggctaccattgagcgggagaatcaagatccgtccaatcccatcccagttcaagttcccacccgtcccacgctattcgggcgaaacagacccaaaagagttcctgtccatatacgagtccacgattgaagcctctcatggtgatgaaaataccaagacgaaggtaatacatctcgctctagacggcatcgcccgttcttggtacttcaatttaccagctaacagcatttactcatgggagcaattgcgcgatgtcttcgtccttaactttcgaggcacctacgaggagccgaagacgcagcaacatctactcggcattcactagaggccgggggagtcgataagggagtacatgcatcgcttctcgcaagcccgatgtcaagttcaggatataactaaggcgtccgtcatcaacgccgcttcggccgggctgctcgagggcgaactcacaagaaaaatcgccaacaaggagccgcagacgcttgagcacctacttcgcatcattaacgggtactcaaggggcgaagacgattccaagtgacagcaagcaatccaggccgagtatgataaagcctctgtcgccgctgcttaagcccaagtacaagcacaggtcgccgaaccggctcctttcgccattcgccagtctcagtcggcgacccaaggacaaccgccaaggccaagtcaagctcccatgacttggaggaaattcagaaccgaccgggcaggcaaggccatgatggctgtcgaacaagtttaagacctccgcaaggagttcgatgcccaacaggcaagcagccatcaacagcccgttcgcaagaaggtcagaaaagatctttactgcgccttccatggacgctctgtgcacaccaccgagcaatgccgaaacattcggcatcgtggcaacgcgcaagatccaaggccgcagcatggagcagctgccgaagcatctcgcgaagctattcaagaacaagcacccccggccgaacagcaccaaggtgtgcagtgcagagtaatccaagtgattacaaggactgacccgccgaatcaactgtcaaaagggcaaaagaagatgcagctgccaatggtgcacaacatcactttggcaagtgaaggggccccgcgatatttgaaccagcagatctcttttgggccagaagatgccgaaggagtgttgttcccacatcaagaccccctggtgatctcggccgaggtagctggcttcgaagttcggcgaatcatagtcgacggagaaaattcggccgacgtcatctttgccgaagcatatgccgagatggggttgcctaccctagccctcacccaagcaccggcctcgcttcatggttttggcggagaggcagttcaagtcctaggccaagcacaattggtggtagccttcggcacaggtgaaaacaggcgcgaagagcaaatactgttcgacgtcgtcgacatcccatacaactataatgccatctaaggccgcgcaaccttgaacaagttcgaagccatctcccaccataattacctcaagctcaagatgcctggccttgcaggagtgatcgtggcaaccttcagctacatcaaagggcgatttagccataatcaacagagcagtgcacaatgttgaggccgaactgcatgaccccctcatggcagggtgatcaaggtgcaggtcgacgatgccgatcccacaagacttgtatctctagggggcgacatgtgcgaaagagaagttgagaacatcctggaggtgctcaagaaaaacattgatatcttcgcctagggccccgacgaggtgggaggtgtttcgacagacatcatcatgcatcatctggcggtcaagccggatgccaagccaaggaaacagaagctgcgcaagatgtccgttgatcgccaagaagcagcgaaagccgaagtgcaaaagctgctcaaggctggggtgatccaggagatcgaccaccccgagtggctggcgaatccggtactggtgcggaaatcgaacagcaaatggcgcatgtgtgtcgacttcacagacctcaacaaggcatgcccaaaagacgatttccccttgccgcggatcgactagctcgtggattcgacagctggctgcgaactcatgagttttttggatgcgtactaaggctaccaccagatccacatgagtccggccgacatccccaagacagcattcgtcacaccattcggcaggggcaaccttcaccaagctagtgtacaaggtcctttacaagcagctggggtgaaatgtgcaggcttatgtcgacgatatcgtcataaaaagccgcaaggatttcgaccatgcgtctgacctgcaggaaaccttcgacaacttacgcgcggcgggtatgaaattatatcgtgagaagtgtgtttttggtgttcgcgcgggccagttgttgggttttcttgtttctgaatagggtatcgaggcgaaccacgagaaaatcgattccattcagcaaatgaagcccccgtcgagcgtacgcgaagtacaaaagctcgcaggccgaattgcggcactcagtcgattcctctcaaaagcagacgaaagaggcttgcccttcttcaagacccttcggggcgcgggaaagtttacctggacacccgaatgccaagcagcgttcgacgagctgaagcgatatctgcagagcccacccactttggtcagcccagcactaggaagcgaactgctactctacctagcggctttgccggtggcggtcagtgcagccctcgtccaagaaacagagtcaggccagaaaccagtgtattgaaatggaaaagcttgcttacgccctagtgatggcttcgcgcaagcttaaacactactttcaggcccacaaagtcacggtgccatcgcagtatcctttgggcgaagtgctccggggccaggaaattactggcaggctcaacaagtgggcggcggagttatcttccttcgacctgcatttcgtcgctcgcactgccatcaagtctcaagtcctagctaacttcgtggccgaatggacactggcattcgcccttgaacccgagcctgtcgaacaaccttgggtgatgtactccgacagctcgtggtcgcacaaaggggcgggtgctgcggcagtgctcacttcgccagggggcatgccgatccggtatgctgcaaggctgcagttcgacacaaccaacaacacggcagaatatgaagctatattgttgggcctaaaaaagacgaaagctttgggggttcggcgcttgctcatccgaactgactccaaattggtggcaagtcatgttgacaaatcctttgaggcaaaagaagaagggataaagaggtatctggaggctgttcgatctatggaaaagtgtttcgccggcataacggtcgaacacttacctagaggccagaacgaggaagcagacgccctagtgaaatctgctgcttgtggaggcccgcattcgccaggcatcttttttgaggtcctgtacgcaccaagtgtgcccatagagagcctggacatcatggcaatcgaccagacagagctgggtgaagacccagaagactggcgaacctcgttcgtaaagtacctcaagaacggctggctcccggaggatgaagcagaagcgaagcgcctacagctcagagccgcaaaatacaagctggtctcaggctagctatatcgctccagggtgctccaacccttgcttcgctgcatctcctttgccgaaggagaagaaatggcgaataaaatacaccaggggctctgcggcgcacaccaggccgcaaggacagttgcctccaaagtgtttcgacagggtgtgtatcggcccatcgtgctgaaagtttgtgttgagcaagctaagaagtgcaaaagctgtcagcggcatagccgaagccaaactgcaccccaatatgagctgcagcctatcgcaccaatctggcctttctccagatgggggctagacatcattggcccattccctatggcacgaaacgggtacaagttcgcgattgtagccatcgaatacttctcccaatggatcgaggccgaaccactcggcgcgatcacttcggtagcagtacaaaagttcgtatggaaaaacattatttgccgtttcggagtgccaaaggagatcatcactgacaacgacaagcaattcgattctgacaagttcagagagatgtgcgaggggctaaacctggaaatcaggttcgcttcggtcgcgcacccacagttaaatggggtggccgaacgcacaaatggtaaaatccttgaggcgcttaagaaaaggcttgagggggcagcgaagggtaagtggccgaacgaaatgctagttgttctataggcccttcggacgacccccacaaggccaaccaagttcagcccattcatgcttctctatggcgaccaagcaatgacctcaacagagttaggggctaattcaccaagggtgatgttctctagaggcgaagaggcgaagaggggcgcgaggtgtcgctcgaactcctagagggggtgagagtcgaagcactagaacacatgcgcaaatacgccacaaacacttcggcaaattacgacaaaaaagttcgaccgacagagctattgcctggccatctcgtcctaaggaaggagaacccggtggtggtcgggaagcttgaatcgaagcgggaagggccgtacctcatcaagcacatgtccaggacatgctcctttcgcctagcgatgctggaaggcgaagagttcgaccattcctggaacgcggcttcccttaagcgtttctatgtgtagcgcgggtggcacccaaatcgctaacttgtaaaaatgtacatactgttatgtaagcctttcggcactatgtaagcccttcggcacaaaaatgcaaaaaaagaggaaaatgaaaaaagaaaaaaaaactggatgtagggctattatccactctggaggcctgaaccagtataaaatatttgtgttttttgccttttttgtgtgaatgataatttgtggaaaaaccccaaggcaaacgcctgatcagcgaaaatgccagggggggcgaaacgaatcggccgaagcatcgctcgctgaacgttgaaactgtcacgaccggaaataacccaacgggcgttccttacgtgcgtgcattattccttgtcccaggaggcaaggtacaccaaaagttgatacagttcagagtttaacaagcggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaattgtgcaagactgagtacaaccaccgtactcaacaagacacaaccacaagtgcaggataaatgcaagggagtacaagggggttataatataaagggttagggtttgcagtaaacagcattaaaagacacttagttgctcaaagctattttgtaaacacgattctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagtaggttttaagaattaaaacactaacttgggtacattgctcggcttgcccataaccgagggcgcagctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagccccgagcagcaggacaccggccctgtgccatgacatctcgactaccgggccgcagctcgtgtagccttcatttgtcctagagatgtccatcgacccccgacttcgtccatctccattcgtgtacttttgtttataaccagactgagccacaaactaaaccttacccactagacatgtggaagtacggtagtgctttgcaacagaggcccgaagaccggcccttatatggccgaggtgctactatcaaaaccatgcaccccgagcccagcctaaaaccattttggggattttgaatagagggggaggtgtgaatccaattccacaataatccaacaattccatagtgtccaggtgataagagtattcccaaggtctagagttgtaaaaccacctaatgttgcctaattaaccagcgaagcagctacctaaaatcatactagtggtaccatgagtggagtgtccactagttggggttttgtttaatctagggtgaacaaggtaataataacaataacaataataaggtcataacaaaggtaactaggcatggctagataaaaacagtgataacgcgggaatttaagaaaagcgataatgcaataatttaaatcaaaataattttataaactgggattcaatatgctcaaggataatgtgacttgccttgctcgctttcccaaacgtcggcttcaacctccacgaagagcggatcttccgaagctgcagcgtctacacgaccaacggaaaggaaaaagcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggaaggggcgcgcggactgggtccacgggagtggggcccacgcagcagcctcacggtccacggtggaccgggtgcacccgggctcacactggccggcgccgtgggtcccacgcgtcagtcgcacctaaaggcgcgggcggctgacggccgggccccacgcggcagccactcggcgcgcccgagggcggccaagccggcgcagccggcgggaggcggcgcgcccgcgccccgatggtcgccgccggcgaccaccggcgtggcggagcggcggccgagagaggggaagggaagggggaaaagaagcggcggtccacggctcaccctaggtcgacggcgacgacgaaaaaggcggccggagcggaggaaggcggcggtgcggctcgggttgacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcggcaacgacggcggagagagagagcgacggcgcgagctcgattccggtgaggacgaagggcggcgaggggcggaaacggacggaggaggtgcggggagggtttaaatagagccggggcgagagagggtggccggggaagggaggaaaccggcgcgggaggtccggccgtcatcaatggcgccggcgagatttgcggggtcaaatccgcccgtttgaacgcgagagagagagggaaatttggggggaaagggagaggggatcacggggagtgatttccccctctctattgcacgcggagacggcgggaggcggcgggattcgcggcggcggcggcgctagggcgcgggccccacccgtcagcgagggtggcgggcaggcccgcccgtcagcggcgcgcgcgcggggagaagccgggtgggccgcggggagaggagagggagggggagggagatgggccgagccggcccaggagggagagggagggaaaggggactttttagagtttttctttttataaaatcattttaactttgtttattttttaataattattatttgtgctctgaaaattccactaaaatttatttacgcattttaggcttctaggaaatatacaaaaatcctctaagccttatttgacttttaactttgcacattttaattgttggaggctttcacacggattttaattattgtaggcataatttagaggatgtattttagagtcgttttgggacgtgacagaaaccgcaacagcttgtttcggaaaacaactaaccgaacaccgttacactcgatcaatatgaaaacacaagcgcacctttcagcgcagaatactacagatcgaaaacgaaagtcgaaagctaaaaagtcagcagacctatttcgctaatatacgcaaaggggccgacacattccgacctaacgaaagcacgaaaagtgacaatgcgaaaaatagcgaaaaggaaataaagcacatctatattaacttcgaataaataatcgaagaatacaagtcttacaacatggtacaagcaaagaaagcaatggctttacaacctagcttacagataaattacacctttgcccccacatcaatcctcactccctaaggaatggtttggcaaattgggttcgtcatcactactaatattatacatgaccctaagaggggaagggggcgaaacacagactagactataacgacgctaggagatcgcctcctgacgattggtcatctgatggtttcgccaaaagcgaaccatgttctccagaccttctgtatgaacatggtcgtagtcttccagggttcgcccggggtgcgcccgcatccagccgacaaccttcaaaaccttgtaactgttgctgtttattatcatctcatgataaacaagccgaaacggacatcgcaccttcggcaaacccttcactgccacgaacttcttgttcttgcttcgccaattcccaaaggggggccaaacgcacaattttcggtgaacaccctgctaaaacagtgcagaaagggcaaaaggcgaagtgcaaagttaaggctttgcaagaaacgtaaaagtcggcgaaaagagtaaacactctctagtatgcaaaaataatgcgaaaatgacgcaagcatatatgccaaaggcatcgaccataataactggctaaacttgggtcatccattccacatatccaaaaggccgttttcggctacaataagaaggggagagggccatcggccaaatttacattgttcgccctccgcggcaaacgccaaagaaaactacaaaatctaaagagaggacggagggcctcatacctctgggtgatcttgggcatcgcctccaccccctccgaccgctgcatcctccccttcgccctggtccgccgcctcagccttcgctagttgctcaagaagacgcgccttggcggtggatcggccgtccttctgccataactgttttcgccaggcgtgaagcgcgggcgaaatgtcctgtgcactgacctcccagtcccccttcgcatagttagggaactcggcgacgtgctcgtagccgaacggttgcagaaagcccatggtgaaggccgccgacacgcgtgcacagcaatcgccgtacgcagtggcgcagtccgagaccgcaccaccggcctgctaggttcactccgagaagtcgaaggtggaggcatcttcgccagggactcctcgcaccctcgcctccatgtcggaaagggcaaggcgaagtgtttggcacgccatcttcgcggactcggtggctttcgccatctcccgcacgaaccgctgcgactccttctcggcgctcgcctcagctttgctgacctctaggcaaagagcctccatcttcggcttggtgagattgtaataatcagtcagagcaggagaatgtgctccttttttaagttcagccttgaggcgctcaatctcagcattcgcctccctctccttctccagctcggcttggagtcgtttgttttcggccttcgtctctttgagggtgttagcgaggccctccatctccaagctcttgcatcccagttcgtcatccttggcccgaagacggttcttgaatccatcaagacgggcccgcatggttcgctctgtcgaacaatgagccacaagaatctgggtacaaaaatagagggggcgaagaggacgaacgtcagttatgagattgttttaaaaaaaaagaaaaacaagagaaaggaaagaaaaatgaacaacatacccgaactgccaaacttttgatggcagaacaaccttcgtcgaactcgttcagtttggtgaacaagctcgggttgccagccggcgagacaagattacttaccccctcgacgaaggggataagctctgcctgagtttcaaaatcaccaggggcgaagtggggcgccgcaagagaatacttcgaggcagatgtttcgacggcagcccccttcccctttggtatgacaagcggcgaagcaaccggctgacgcatagggcttccaaaaaccctagccgcggccttgacgacccggtcagcggaagccaaggtcccagcggcagcactacaccccgctccgccagtgtcaactatgacaacgggggcggtcgaaagacttaaacttcgaccagcgggcgaagtcagggttttgtccaaagactcgtcgtcgctgaaaacacgagcgatatcgacgagccctttctttttggcacacaaacacggtcaccacacgcacaagcgaacgactatcgacaccggtacacgggtaccggggtcgacaaccgcacaacgggcacgggtgacaccgaaaagacgaggagcgagaggacggatccttaccaccacgcaacgaggcgtgggaacgacgacggtgaacgggcgcggcggagacagctcggggacgacggaggcgaacggcgagggaacgactttggcggcgatccttggacaaaggcgagacgcggccggtgcaacgcttgacgacgcggaggcgaggacgaagacgacgacggggctgcggcacttgacggagtgaggacgacgaacgagaacggcttgatggagggacaaacgccacgacgaggaacgggcggccgaaggactctggcgaggcgggtggaggggttggcggcgacacggcggtgttccggcgaaacctaggagtggccggggaaggagacgatgctctgtcgcggcaaccggggcggctagaggtagtgggtggcggcaatgccaccggttgttggcggggacgcgcctccggtggtctgcacgcgaaacggaggcgacgccggtggaggggaagcagctgcgacgccgagggaggagacggcgcggccggccggcgcacgggcgaggtggtaggggcggctggagagtggccggcaccgaggaaagagaaggaggaggcggggagaggtggtgcggccacgggggagctcgggaaggggctaaaacgatagaacggagcgagggtgttccattttataggatgggggagcgagccgaccacgggagaaggtggaatggaggcggaaatggcggccggcggccatggaaggtggccgggaatggcgcggccgttccgggcgattgggggcacgaatcaagggggaaaacgggggaaatcaaagaggaatcaatggggattaaaaccccccaattaatttggaaagagccggcttgaatggggtggatttggaggagggaacgagctagggttcacgagagagagtgaggaggccgggcggctggaggaaggagacgacgaccggcacgtgggccccacgcgggcgcgcggtcagcgcgcgtgcaatgcgcgtgcgcacgcggctcgggtggctttttttttttgagaagaaagtcggtaatttcattcatgagaagtcagatttacatgcatcgcaataaaacctggagggtttagaagccacacatgacgcccctcactcaatgtacatgcaaacttagccaagttatgagcatctacatttagatcccgactttcatgatgaaattctactctaacaaagtgatggcttcttatgttgatgtcattaaggactgccaaatatctgcattttggtattgtcgcaatacccctgataacttcttgacagtctgaagcaatacagacctttaggatgttgcagtccatggcgatagcaagtccttcattacaagcaagagcttctagtgtagttggatcagacatcccttcccaaaccatagcactagctgccagaaatttaccagatgtgtcacgacaaatagctccaagagctcctttgttgcttgatcgagaaacagctccatcatcattaatcttcatgcaactttcaggaggtggtatccaactggttgttttagtacaaactagaggtctcaacctgtacatgcattggattattaatgatttccaaatcagccagatatgattcaataaagccccagattgttaaagggctttgataaaaatcatcatacaaagctttgcatcgagaatgccaaattgcccagcatataacaatcaattttaccataagctcaggtgttagattttcttgcatatgaaacaaccattctctggggtctttaatatttgtgattgcaataaggtctgttatatcattatccactagagcccacacccacttggccatggtgcattggagaattgcatgatcccaagtatcctgtgctgcaccacatattttacatatatctgctgtactcatgtttcgctgttttcgcaagttttctgttggaatggaattttgtgacagtctccaggcaaaaatcttcagtttggaaggaacgttgattccccataaagatttccaagacttagcaatggcactgaaatcggagacactagctttgttgtctaaccaattctctctttgcaattttgtttgaaccagcattcgataagcagatttcacagagaagattccagacctctcataatgccacgcccaagaatcaggttgtcttgttgagcctagtggaatatttaagataacttccttgtccatgtctagaaagaacttgtccagtaagtcatgtctccattttccggaggaagcatcaataagttcactgaccttcaccggtgggtgagattcttaggccctgattggtcgaagcatccaatctcttggaatccaattatcatcccagataaaagtatcttttccacttccaatccttcgaataattcctagtttaagaatttcacgaccttcaataatagcacgccaagtatgtgatggcctacttcccaaaccagcattcaggaagtcaccatttgaaaaatagacagctttcaaaactcttgctgctagtgaattaggatactgcaagattctccacccttgcttggcaagcaatactagattgaaaatatttatgtccctaaatcccattccaccaagaaacttaggcacagtcatcttgtcccatgctacccaattggttttccttgaaccttgtttacttgcccaccaaaatttccggattaaagaatttatatggttgcaaaggcccatgggtaaacggaaacaactcattgaataagttgggatggcttgaactattgatttaataaggacttctttacctccaactgaaagtgttttctccatccatccctgcactcttttccacactctgtccttcaagtatttaaattttccttccttggctctacccacatcgttggcaaacccaaatagcgatctgttatagattcattagtcattccaacctttcgtttgatgtcctcacggatggccatatcacacttcttgctgaagaaaatgcaggacttagaaaagttgaccagttgtccgggagctgcacaatagttagttaaaactctactcactgcatctgcacaaacactagtagctttgaatagtaacaagctatcatcagcaaacaaaagtgggcttata

SEQ ID NO: 55950 - DNA, 1796 bp, Oryza sativa
ccattcattaattccaacaatccccccccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcctaggatctaattcacgggatctccgatcacatagactgggttaccaccatagtataactcacatgggtctcaaacccatctccttcgatacattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacattatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgaga

SEQ ID NO: 55951 - DNA, 4738 bp, Oryza sativa
ctacccctccatatctcatatggtgttttgtccttatttctgttaggaactctgtttaacacatgatttgaggtcaacaatgcctccccccaccatgccttaggcagtcccgcggtgtccaacatggcattcaccaagtcagtcagcgtgcgattcttcctttcagcaatcccattagactcgggagaatagggaggcgtcctctcatgtatgatgccatgttcctcacagaataagtcaaattcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccaccatttgtcaacaccccattcatttcacaaagatctgaatgtaggagttctagtggtgccaagtttctctccttggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaaacagaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggtcggtggaaccccgtgcgacctgataagaagaaaacaatgagatgtcagcacaaacatgtacattggccccagtatcaacccaccaattagtagattgattaactaaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttgttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgctatcaacccctcaacgaagtattcctgtctcttgtgtttgagtgcagtaccgaaacttctccaagatgaaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacctagaagcatttcatagctgtcagccacagagtgaccctgatctgccatctcttaaaatgcacaccggtgaatttatccggcctcagtgcatcggcaaaaccagccatagtaaaatcacagtgcctatgataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatggagtagtctacgagcgacggcgcagtacagagtaggaggcaaaccctagattgattttgtgtatgttacgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgcatctgcgcaagggtgaggagccaatttttcggaccattcgacgtacgcgtacgtcgtgcacgccctgccctgccctgccctgcccggccaggccaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacactttcttcagacaacaagttaaagcttcagcacataacaagaagagataaggtgatatgggatcaccttgtctaataccgtgagagggttcgaaaaaaatccaaatgctccccgttaaaataattgaataggaaactgaagtaacacatttcattatagttcttacccactaatcatgaaagcccaacttcctcatcattgcttccaaaaaattccattcgacgcgatcataggcctttgtcatgtcaagcttcaaagcgcaaaaagaatttttctttgtcctattggttttcatgtaatgcaagcattcataagccaccaaaatattatcagagattagacgggccaggtacaaaagcagattgctctatagagatgatatccggcagcactacctttagttgatttgcaatagtcttggatatatgggcggcgcggctcggcattgggccaggaggcggcccaggtgggaggggagggaagaggtgggccgggaggaggaggagaggcccgggggaggagggaaagagagggatgagagggagactttgggctgggctcggcccaaaggaggaggggattatttttaggttttctttttaataaactttcttaatagttgttgttgcttaataattacttccggtgctctgaaaattcaagtgaaacttgagggctcctttaagaccaaggagaatttaacaaaaattctccgggccacatttgaatttttcttgtacgtattttagtgtttgccaatttctttttgaattttcattaattctattattccttttagagaatgatttttatttcgggatgaatttatcaggacgtgacattgggcttcatgtttggcgaaatcgccctgcgccgctaacggagggccttcgccgcgtcggagccagtctcgaaggggatggagtggtagaaccacttcgccatccaatggcgatcccacttcgacatggcggcgttcaccggccgtagatcggagcgctcagagcgaacattaaagttcacgcttccgaacgccgttttcttcgtcctggccggggtgacaaccgtcttcgagttcacggtggcatagaacacgacgtcgaaaagctcagtgctcggttcgaacccggcggtccggcacgcccagtcgaagatggcgactcggacaagtgccgacaggctcagctagggaagctccacctggaagaggcgaaggatctccagcaacaaaacgttgcatgaaaaccgaaggcccgccccaaaaaatacggcaaaaaccaccgtccagttgtcgccgggtttcggcaccacggcctttcccgggaggaaggcctgcccctccaccagagggccggcgctgacaagcttcgccagctcatcgtcgtccacaagtgaagcccctagaaaggcggtggagtcgtcgtcgatccggccgggatcagggcctgtcgcggaagcggggttcggcttgcgaggtgccatggtgaaaggtgtgcgcggtggcgaaaagggagaacaaccgaaagatctaggaaatcaaggggcgccgtgaaaggaaaaaatggagaaggagagagcgctcgcagtgaaaataatgagagtgcggcggtgaaaaagggaaggggggaatatatagcccacccaagcgacggttcgcctccccgcccaatcataagccgccacatgtcacaagggtaggcgaaacgggaaattcccatcgatcgagccgcacagtgataagcccacaaagggaaagcccatcactgttcatttcggcccaggaaa

SEQ ID NO: 55952 - DNA, 1328 bp, Oryza sativa
ttagaggatatacagtatggtcttttagctataggtgctgtcccaggaattaaatcaatcacaaactcgatgtcacggtcaagtggcattcctggtagttcatcagggaacacacatggatactcttttactatgggtactgatttgagctcgatgttgatagagaatgaagtgatggctgctgagaagtagtagcacgatcagatgtgaatgtgatatgtcgaccatcagtttttactaatgacataatatttttagtacaatctatggttccttgtttggacaaccaattcatacccaagatgacatctaagctaggatagtttaactgaatgaggttggctttgaacttcacccctctattagaatttcaacatcattacatactagattggttttaatggttgcaacgggagattgtactaacatggcattctttaataggttgactttcagattttgttggttcactaatctggtagatatgaaagaatgtgatgacccagagttgaaaagaacaagagtaggagcagagtgcacatgaaaagtacgcagcacgatgtcagatgtgtccgtagtctcctcaacggccacatgattgagtcggccccatccaataggttgagatggcttggctgcaatatgtccaccttgctgcccaccatgaccctgtgcgggaccatgtggctgcggttttgttccctgaagacgtggcactaatcgttcggtcttcggaaatggatagttattggaataatgaccaagtttcccgcagtacgttgtagcatttatgttagctacacgattctgatttccttgcgatgaggcaccacaggaatataattgaactgttgtcggagctgaatgatgggaaacagcaaactgtggcgtcggtggctgcgaagccacatagcggaccatcgtgggctgagaaaggcgcatcgggtagagctgctgctacttgcatcttttctggctacccacttccatttgcgatcctcaagaacttccttttcactggcttccacacgaagagccttgtcagccagagtcttcatgctagaaattttatgagcaaagagagcatgcttgagttccagattaagtcggtcgcggcatagctcaaatttcctagctttagtgggcatctctaaagttgcatagtgccctagatagttcaagcaatctagaaattccataaaggacatattcccatgctacaagtggaaaaactctttcttctacattgccatgagactggcatgtatatgagcaaatctaaatccctcctttgaaaacaacccagccgataagctcatcgggaggaa

SEQ ID NO: 55953 - DNA, 2159 bp, Oryza sativa
ctgatcaactccagcaccacttaaaagatgaccattcacatttacattcaagttcagcattgaatttcagaaaactgatcaactccggcaccactaaaaagatgaccattccattcacattcaagttcacacacacaattcagaaaatcatgcgcagtttcagttcacattcaagttcacaaagcacagtttcagttcacacacacagtttcagtttcagttcacactaaaaatatcatcctctgcgatcagtttcagttcacacacacagtgtcaagttcacaaagcactgtcattaccatttagaaaatcatgcgcagtttcacatttaattggatttcagaatttaattaccaggatacctgaaactgaaactaccaggataccataatttcagaatttacattatggcctatagagcaaaactgagtaagggagaactgaacatatatgggtactgaataagcagaaaactgaatttggctgaggttcatatatggctgggtactgagtaagggaaaacacggcaaaactaccagtatactgaacattgatactgaacatatatggctgaggttcatatatggctactgaatatgcagaaaactgaatttcagaaaaaaaaagcatgaatgagcagaaaactgaacatatatggctgaggttcatatatggctactacaagtgctaaatttaacaagtttgtcacagaatttcagaatttaacaagtttgtcacagaatactaaataagcagaaacttcatatcttcataccagaactggctgaggttcatatatggctactacaagtgctaaatttcagaactacaagtgctaaatttcagaactacacagataagaaataccttctcaaacagtttcaggaaaaagggccttcataagacacttcatcatcatagctcgctgtgccttttcctcatcggacattgaacttgtatcctgtgaaacgaggttgttataagtctccatcatctttgtctctttatcaagcttctttccttctttgtactcttgtgctgtaaggtgggcaatttttgtggcctctagcttctcagaagctatcttctcttgcctgtccaatagcttcatacgcttctcattgtttgcctcctaaaatttactgtatctatcaaatttgtctagctcaataggagaatcctttgagtgaccatcatcactactgctggaaccctttaacttgccatttttagcagctagagctgcctttttagctgccttctgaccaattggtcgttgtggcatctgatcacaagtgtcctcattttcctcagattctccttccagatggaatgctttccttttacgtgcattcttcaggttttcattatatgttttccactttggcacatctcggcaaattttccaaacctctgtcagcatataaggtccaaccacgtctttgcattctttgttgtcatccacatagaacttgtgtgctgcatcaagccacatttcagccgaatatccacttgtaaatactctacgagccttagcgtaagcacattcaaagaggtctgtccatttattaatcttgttccatctatccttgcattgcttcgcatttcttcttcgaagtggaggggtagttttgttgtacgtttcgacaacctcaccccaatattggacaccacccttatccgcaccacaggtaaagtcggttgaatgttctaaccaagcgctcatcactctaacatcctcgtccggagtccacatgatcctcttctcggttctaacactgtcattgccatgtaatatttccacttcgggcggtgaactaccattgtgtgcctgattcagaggactcatgtgaataactgcaccaaccaaatgagagttctgtgcttcatttccaaaatagctcatgaaaccaccaggtggacgtacatcttggtccctgcaggaaattgcaattaacatgaaattttccatggtccatctacaaataaaattcagatgcagtagtagtactattgtggctgtatttatgaagggttagaaggtaaaattagcttaaaatgatttcggcacagaagcttaacatgaaattagcttaaaatatgaaattagcttaaaatgatcagttgacacagaagcttgatgggtatttttactcttt

SEQ ID NO: 55954 - DNA, 2757 bp, Oryza sativa
  unsure (1)..(2757): unsure at all n locations
gaagtcacctccgacagaaccatcaatggagaaagccgggacggtcgtcgctgccgctactgacccgcgaccgtgtccgcgagaacggggcggcggtggtagcccgacagcgtgaccaaaagaaccccgaccgaatgagggagccgccgccgccgccccgacacctagggttcggcctggggccgtcgccgccgcatccaatgtcctcgatccattccttctccaagctgcgccgggcgtggacatcccgccgcaccaactccggcgagaataccagatggggggcgagcagatggcggccgcgcagatgggcgggcgaagaaatttggggcaagtcgcgagcagagcgcgggagaacagcgcgcgtggttgcctgggaaatttgtgggcgagcgcggccgcacgcgggatccgttcgcccgtcgcctggggatgacggcgctctacagcgcgtgggctcgcgtcgactccacctgggagaacgggatgaactcgtcgcgtcgggaggcgccgggctgcccgtctctgcgcgtgcacgggttttttttgcaaaatcaccaacacacagacggggcgaggagacgggttgtacatgccctaagtcataaagcctgcatgcagcccagctgacctgctgctgtacacgtggtagagagaaacgaccacggtcctcctgttcacaaggttttacacgaaaaactgtaaacagcgcacgattcctctctacacaatcaattaatgttaattacccttttcatatatacagaccatcgtccataatttaccttttttacacatgctaaactaccaaaatgggcatgcaaatatgcggactaattaatcatgacatcagcctcatttcaggttcacagcttgccatgcaaaacatgcagagttatatttattaacattaaagaatattcagtgaaaaaaacattactcaatctattgcactgtttgaactcatgacaatggaagctgcgttaaaaaaaagcaagacgtgtcttgttcagtgtgcaggtgtagtaatatactccctccgttttttaatagatgacgccgttgactttttctcacatgtttgaccattcgtcttattcaaaaaatttatgcaaatgtataaattataaatcacacttaaagtattatgagtgatnnnncaactaaaaacaaaataaattataattacgtaaattttttgaataagatgaatggtcaaacatatgagaaaaagtcaacggcgtcatctattaaaaacggaagtagtattaccatgtcaactggacacaaaatgaagaacatatacaccaatttgatcgcagtgaccaattctaacgactatatatcgatataatcgtatacaaatacaattgtatatatggaaatagagatatgagttgtataaaatctatatttaataaaaaatctagcctaaaaaatccgctatatttttatttttaatccctttgacgaattatacaaaagatgctctcaattcttttgtcgatctcacgccaagccacatatatgagttcaaagctgaagttaacacgataggtagcctcgtgctttttctgaggcgacaaatatcgtctccattggtctgtcagtaacaaaaaccctctaattaacaccctttcatcttgtactttaatttcacctcttcacacaaactgtatatgctgtcttttacttgacttgtagtgcaaccttccactgtcacacatgacgcctccatctgcaatggcatcttaattaatcatcagtaactccaatttccaaatagcacgtacgcatgcatgcgtccatgccatctccttcatctgctcgatcgatcactctcagatagattgattgattttactatctcgatcgagttggtcgccaattcgccatggccagcagcctcatcaacctcctcctcacggaggtggcggccatcgtcagcatcgtcctcctcgccctcctcgtcgtgctcagctcctaccgccgccgctccggccacccggcgctccgcctcttcgtctgggcggcctccacgctcttcctcccgctcgtctcctacgccgtctccgccgccgccaagtgggacgccgcgcgcgtcccgctcctcctcgcctggaccgtcttcctccagatgctgcgcaacaccatcgacaccgcccgctcgtcctcgtccacgatcggcaacggcagcggcagcagcaagttcaggccctccgtcgagcagctggcgaggatgggctgggtggcgttcctcattgtcagcagcgacggcaccgccgggagcccacagctcaccggggtgctcctgtggctgtgggtgctcagcctcgccaagctcgtccaccgcctcgttgccgccgagctcgccaagaactcgttcgccgtcggccttaacgcctacctcatctccgactacatgaagcagctgtacgggcaagaccaaggagaccacgacgtgcaagctcctccgttgttggtgatgggcgaggagaagctgcaaatcgaggcgaggccacaggggtaccgcattggccggacatcgccgccgccattgtgcgtcgacgccgggcatgtggtcaccatggaccggatatgccggctgttctcctccggcgatccactcgtcgcttctaacccgcagatcaaggacacatgcctctcgttcgccctgttcaagctgcagctccggcggttcgtcgggtgccccatcgccgaggcgggctctcgccgttcggtggcgttcgtgctcga

SEQ ID NO: 55955 - DNA, 7840 bp, Oryza sativa
gtccgctccgactggatcaaggtgtccgccatctgcgagtacgcgcgccggccgtcatggcgcaagtcgccatggactcgccgcaacgtcggccgagttctcccgctcaagccaatgcagcgctgggacgatcggttcgggcagacgtccatcctgcagctccgtccgtgctactgtggctgcgtctcccggcaggttgaccggatcgccaagtcgtcggccactgtgccggcggcggtgaagacggccgtcgtggacacgctaaggacgaaccaaggaaacctgggaaacggcgtgctctcgttgcagcggaacggcgtcgccgacaagctcgcctgggcgtgccaccacgccggcgacgagagaagcgtctccgagcagatcctggtatggcatgtggcgaccaggcttctcgagatcatgcgatcagaaggcgctcacgggagacacgacgacggagacggcgacggcggcggagacagcgacacggtggtcgtcgcgacacggctgtcgcggtactgcgcctacctggtggcgctgaagccggagctcctgccggaccacccggcctggacggaggagctgtacgagggcgtggtggaggaggtgtcgagggtgctcgcgcggttcgcaggggcggtggtgcggtacgagcgcgcggcgacgtgcctcggcgggagcacgaacgcgacgctgaggaaggcggccaagctcgggcggcagctggcggaggagctcggcggcgacgaggagttgccctggagggtgcttgccgatttctgggcggagctcgtcgtctacctcgcgccgtcggagaacgtcacggcgcattccaaggcgctccgccgtggcggcgagttcatcaccgtgctgtgggcgttgctcggccacgccggcattgttagccggccggacactgacgtctgactgacagtgtgagtgtggtttatggcgaacacatggttttctttccgcttttgtcattgtgtataccaaactgtcgacatgagatgtgtttgccaaactgtcgacaatttatttctgatttgcaatagtaaaacagtttccaatcctttacgaacaagaagcagaggttctttttatgaacaccgaatgatgttgcatgatcttctttaaaaaaaaaaatctataggcataaacatgaaggaattttgctagacatctccagccaggtggcttgaaaggcaaggccggaatctgtcatcacataagcaaaagcttctctggtcagaaaaccaggttgttgcacgctgcattgcgcagctgcaatgcaatcttgagacagaatcatgtgccgagtcgaaaagcaacgcaatgcaagctacctgttcagccagactaggtggctagcttttatcaccaggcagggggcatctttatctttcaggttgtctgtattgcctatatttttttttatacccaagtccctaattcaagggcaatgtttatctcttggtgcagaattctaatatctcagaagagctgggcttaccctttgatgtggatttgaggatatcagaagatactatgaggtatcaaattttgtagcataaattttgatagcttcacatacctcccaaaaatttgacaaagttggccctttcatcattgataaggacgttgagaaaatcctggactaggagaacagcacaatgaagcaagttgaatcggagatggatttaaatcttccgggtggatgtccacccgtttattgcatgcatgccaactaaatggttttgaaaaaaatttaaaaaatttgacaagatagattaatgcataatatataggcaataaataaaatgtaacgagtttacatatatttgcagaaaatttgtaattttgttaaaacttgtagaaaatgtttttgaacttgcatctttgtggaatgatatattccatgcttgtggatgctatagcaaactaggcagtgacccaaacaaaaataatcctctggtacttgtggaccttgttaggtcattcacagggcacatacgtaacgtgtgacaatgttggttcacatagacaaattgcttgcgtgtaggagagaggggagtggggaccgctccttcaccggcttcgcgtgaccatagttggtcactagaacctcccactcttgcagcagttctcgatcagaaaaagtggtcatctgcgcgtggagagagagagagagagagaatgggggaaacaaaagtgtctgactgaagagaaaagccggataggggtgcggaggtggtgaagtggcgacgagtctgaccccaacgaaggtgccctcgccggggacctcgtttgcccacgcctcccacctgcttcgatccgcgccggagaggggagaggagtaagggcgctgagcgaggaaaccggaggggagatgaaggggcgatggtgcctgaagcagtgaggggaggggcgtcatcggcttgatctgccccatccggccacgctgccagcgagctcgtcgcccgcaccaccaggtcctcctcgaccgccaccgctgcgtggatttggggtagccaaggaaggaggccacaaggggagagaaagagtggtggtggccggagcgggcgagggaggggcggttgtggtgggcggcggggtggctcgatcttccttgcattgccacgcggtcgtgccagcggggagctcctcaaccgccgccaagggaggaggccgaagggaagagagggaagggcggttcagtggtggtggctagagtggtgaaagggggagaggagagcgtcggtttcgaggaaagggagagtgagagagagaagggggaaggtggaggaaaaaaagggaaaactatttttgtggaccccacttgaggttacaacattgtgaaccttgtgtctttcaccattccttagcctacgagggatgtgaggtccggcaaacacatatgccacattgctatttctattgcccttattgatcattcagtacaagttgatgtagcaagatcagaaaatgctgtccaagcagatatggaggtagagtttcatcgtagcaagcagcggttcggatttttgaaatggggttcaacacttcaactgcttttagtaatatgcttagcttgtcgttccacctttaataaaaaaaaagcttgttgttccacctggatctggaattttgcatcaggtgaaccttgaatatctgggcagacttgtgtttaacaatggtggtgggatcctttgccctgattagcagaattgccgtacttactttgatacaggatttaaaaacttcatatgatattacatgttaaaactttgtttggttaatctcactaacaaggggattggaggagaattaattccacacctatccccctcaatttcctttgatcccttcttcatgggattaaccgcacaagacttaacatgggtatatggctgcattactatatattaagacgatatataataattttgtactttgacttttaacaataaccgtaggtagacttttagctgatcttaataatcatgaaaagagattgaaaaattaaaattgcccaaaaagctcttagatttattctagaatcaaataatacatttatgtaactacccacttttatttgcttcaaacaaaagctattcttgttactctcttcttttaccttttaactctaaggagtacatatgagaaccgatagctggccaaacaggtggcctggcccaatgcggcatgagtccactggcaacacaacccgctttagtacaattcgttaggcacgacacctgtagcaggctatgctatgtcggcctatgtgccaaggccacggcccaagaatagctcaagaagacaccgtgttgtgctgggccatcacagcacgactactgttacggctcgtgggtcaatgacaggcccaactgtacatatgacctatggaaattgaaatttgaggtggaaaaataaaaagcgaaaaagaaatagtgaaggtggaaaaataggaaaagtagtaaaaaggatggaaaataatgagtaaacatatggaggaaatgggaaaaggtaagggaaaataggaaaaatatgactaataaaaataggaaaaaatggaaaattaggaaatatatacagaaaaaatagatgggccagacaggtcgtgctcgtgcttgcccgtagacaaccgtgccatgccagcacaacccacaggccagtgtgccgtgccatgtcgtgtcgtgggctggtacaatacagtcatactctagtcatactctggcctagcttggcatgacccatttggccagttatatgttattgataagtgtggtgatggaagtgaaccattatcttcttttaaagaggtataaatcgcgttgtagaaatggacttacgcacaaactatgacagatggccttggccggtgtttctgatgggtgagttgatggtataaaggcagaagctgcaatgcttggccatgggcagccaatgagcatagtattgtcagggcttgtcggtttcaagttagagtgacaaggaagctgaggaatacagatttggtcctagcagggacatttaactttttgccactcgcagtatataacctgtgggttctcatgtgtctataatacgtgggatcaatgacaaatctttaattgcgacttgtaagagtggcaaataattaattattcctaactcgggaatgtttacttcaggctgataggaaacatggtgttttgtcggttaatttgctgaattttacgggggaggcatgagtgaattatcactgcaggttgatagggctacaatcgcaaacatgggattcgaatccaattgtaatgctgggagctgctatagttgccaaaatggcttgcgaattaggccttgaggtcaagccatggattaagacaagtctcacaccaggttctggacttgtgaagaactatggttgtactacttgcttaggaaattctggagaacttgatatgtatctgctgcaattgataacaatgatattagagtaaattttataaaactacatgtactttacacgatcttatcataaaactacagatttagtatctttgtttattacaaaactacagatactttacacaatatatcacaaaactacagatttaagaacttgtttcacaaaactatatatttagtgtcttcatttattacaaaatacagagttagtgttttcatttatcacagaactacacatttagtatcttcatttatcacaaaactatagatttagtgtctccattatcacaaaactataggtttcaacaatgctaaaatatgtagtttgtgataataaagacattaaacctttagttttgtgataaatgaagatattaaatctatagttttataaaacaagtttttaaatatgtagttttgtgacaaattgtacaaaccaggaattgaagaggagtgtgcacatgtgtacgtttgtactatatttctaaaaagaagaaatatgccaggttttttacgtaatgtcgtgatatcttttgtatgggggtgtataatcgggcaatcactcgtctggaaaaatgttttatttatcagtgtgaaacacgcaatcctcgctccgatgatgctccccaagtgcatctgaaatcctataatatttaagtttttcatcggtgcctttctatttatcacaaatactgtagtaatttgaggacctatttgtccattaaacagcaaacaattaattacaggtgctccaagcaaacaacttttaaccccaaatctaatgcattgtcactatacatgtacacttgtgctacaataaagtcaaagcgaaaaccacatatataaatctattatgtacaaaaacatgatacttgagtactattgtactcaaccaaagtttatcttatgagcgctggagaaatgtttagccgccctgaccatctcgccagccgcatcataccctgcgcggccaccggcggagccagagctcgccaccacctttgagcccaatcgcgcgaaccaagacgccacggccaaccacaaactggagccggatttcctcttcttgcctcccatgactaaacagttactacaaaaacgactgtgtgatcgatgaactgaaccacaaactggagccggatttcctctgctagtttgtttcaactttgatgagctactgtgtcgttgtgtttcttgtgctgttctgttggaagagtttgcagctggaggcttttatatagcattggaggcttggagcagaggtatgcatatgctgggacctgggtcctataagctttcttggcagccaagctgcaaatgaggagagagagtcagagagtccacggttgtgccgtgttctgcattttgtgccgtgttgtgcattgatgtcactctcgcttgacctgaaacatggtcatggtcattgtattcctcatcagtttaaatttaacccaaagcaggaaacgtgtactttgaattttgtgtattaccccctgtacatcttgacataagtcgacgttttttttttccttgtctttattgatacaatcatatatacaagctgtttttattttaatcttctggcaacatgctaatcatggcatgcttaggaatgttcctggatagctgcttttgaagaagaagctatttatcagacagtgatagggaagttagttacatggtcgtttcatcaccgtggcaccttcttcagagaaactcaccgattcctatagagctcacatgctttgaccttttctttttcatattgtaaaccttacatcgatttcttagcatgcttgatttgtgacgaagctacactactagtgtggttttttttttgtttgtttgcattggtcggacaagacagaaacgtaagaggagactgcttagagcactaacaatagtagacactatatgtgtatcatgtctatactattaatttaatgacatagatactactgtacaaactatttgcccaatacaacatttcttacgtgtgggaccaaataatacaaactatttgcccaatacaacatttctacgagtgggaccaaataataagatcttcccagtacatcatttctacccagacaagaaatacgagtctctaattatggaccaagactattcactacgccggaccaggtcatctctgacgggcccaaaccctcacctttaacgggtttggtcttggtcagtgattagtggtcactgatgacaaaatcacctgtgacggatgaaacacccgtcacagataacccatctctgaccggtatataagtcatctctgatgggttaaaacttgtcacccgtcacagatgagtcatttgataatatgagtcacagataagtcatttgataataagatgagtagttgattaaaaagtcaacgacgtcatacattaaaatatggagggagtataacaatattaatagcttgtcttaattatgacatattgtatcttattaatttctatatgtaacgcatgaaatcccaattgtatcttgattgttgcctaatcaaatccccattgattctatttatagtaggtaatctgaataataaattcaaaatttgcagagaaaaaatgaatggtaattgaaattcaaaattggtgcaaaatcatcataggtggctaggctaagtaatctaccaacgaaaatgatttctcatagataattggttgcccgctagcaaaaagatccattttcaccggcctatgttatctagtcacaagcggcgcggctggcctcctatgagaaaatgttcttgttgcccgcgttatgccaatttataatagtgagcaccatccacttccccttccctttcctgtgaagggatgaccatgctcactagatctagcagccacggcctccctggtggaga

SEQ ID NO: 55956 - DNA, 1209 bp, Oryza sativa
agttgatgtatatatagttgtaggttgcgttgtacgatgatgttgcttatctgttgaattgagtttaaatttaatgattctagttggtgtgtaatagctgttgcaagagaaaatttgctgaggcttgagcccatggctgtactcagtttagaatgcattttctcaggcagggtcagcggcagcgcaatagttcctgggtaaacaaaatcgtttgccataagtcaatatttcggatttaagagcccaattcacatcttcacctggctctttctattttattcgaagtagaaacttcaggacctatttgaccggcccttaatcgaacacttctttttacaaattaacaacgaccttatgaatcctaaatatatacacatatgtgtgctacagtaattgaacagataataattctattatgtacaaagtacaaacatgataacatgcaccattaacagttaaccaaagtttatcttgtgagaactggagaaatgtttagccgccccaaccatcccgccggccgcatcatacccggcgtggccgcccgagccggagcccgcggccgccgcctttgaggcgcccaagcacgcgaaccaagacgccgacgaccagaaaccagagccggatttcttcttgcctcccatggctaataatcaaattaacacgaggggaattaacaaagctagctcaactagtacgtaagtgacagtgtgtatgtcttattaatgctcgcttaaatagcttagctacttgatgagcaccgatcgaactgactacggaatgtttttcttttgctgaaggagttgcagttactggaggctttatataggatgcatgcgagcagctgaggtaattaagctggaagctgcacacttgcttcgtgcttaattacttgcttggcgaccaagctgcaagtgagagaatcagagagagacctgcagtgttctgacttctgactctgaggatcgagagatgatcttgaattataatgtcgctatcacttgacctgaaacttggtcatggtcagttaatactcggtatatatttagtttcacttaaatcaggaaacgtgtacaattcaaattatgcactcttgtgcacaccttggcatcgatggacacgttcgaggcaagagcttgctgaccaagacatgcagacatgcatgcactaggaatggaccaggatagctatctgctgcttgttcaagaagag

SEQ ID NO: 55957 - DNA, 1508 bp, Oryza sativa
cactaattttttaaaaaaaatgaatggtcaaacgctgcaagcaaaaagtcaaagcgaccactaatctgggacaaagatagtagaaaacaccaaacgatcgtgcttcctaaactgatcagttgattggtgttcatgcccagaataattacgagcactaagaatatgacattcgattaaatttgagaaaacacatgacttggacgggtgataggacgatgatgggatagtgttttccccgatgcaagtagccagtccggtcaccaaggacggaacatgttgatgtatattcaagcaccctacgtacttccacttgctaggcatgggatggcttatcttagaaccgagtgaagttgtggttatctatgcccattcgtcattcgtgtgggatgtttcccttggaggtacccatgcgtgcataggttggtagggggtatctcccacgatggtaatcctaacttagtcacacgcacatgcccacggctaagttatcgagggcctatgcgtggtttaggtggttggggctgagcttgagaaaggatatgttatgagcttgaatcacttgaaggtcacacctatgtgcgtgtgaagcatttgatcgagtaagactattcgaatagccgtgttcatggttacaggatgatcacttgatgtattagtcagtttatgttagcatcaaacctgggataaatggtgggtattagtcacggttaatcttggtggataagtggctaatggttgcttgagcaagggtggtccatggacgatgtttagagcctgttgtgctcatttgttgttcacattcagatttatatacttgttgtacataaatttcagattgtgttattttgcaaattcttatagttttaacttattacttgctcaacaaaacttgctttgtgcaaaatctgaacccttatggtcctttgatatacaagcttatatattcctttgtaatattatatattgtgtaagtcttgcggagtactatttgtacccatgttgctatttttaggtaaggataccggtgactttgatgtgtcctactactatccagccaagggtggcgagggtagtgagtagctgagttggttgccttgtgggctattggctgaccatgggttgagacttctgccactatatttgtgatgtatgaagggcttatgaaccctattgtgtaatatttaccttgttgtgtgtttaattttattaaatacttgttatgctatcaattgcttgcagacgaaagtgccaggctagtcgctttttcctgggaactagctaagcatgagtaagtgttttgagtaattgagatgatcgtggaatatagcgtttgaataagtcctttgagatatataacacatttggtcgccaccttcgaatggtttgatggggcatatctttggtcgaaatcaactaacaagctattccatcgaatatctctcttactcactactcgatatcgtggttaatatattgaaaggtgtcaactacgatcatggatacactga

SEQ ID NO: 55958 - DNA, 953 bp, Oryza sativa
atatgtgatttgtcctacatcacaataagggagatttgatagaaggaaataaaatagacgcccctaattaaatgagttatggttgggactgagaggtgtttggagggaaaaatagcgctactctatttttttagacaaatttaaatagtattagggactgagggagtagtttacttgctccctctgaaaaaaacacatatgtttctcattttttaagtttctggatcaactttggaaggaggctttctttgggtgcaaataagtttattgataaaaaaatatttatcctatactgcttacttttttctataaatccttccatacataaagtagatttagcatctatctgtttcatacgttactcacttcagttccatcaaattgtggagctaaattatctttggaagcatttatcctatatcactttcttttctccatatatcttgcaaaatggttggatttatttttctctctcacacacagacagttacttttccaataattataatagtctaactttggaagttagtatctttagcagcactttacttcattggcacacttactgtttccataaattttgggcatgggagatcttttcaaaggtttacttttaatggagaaactgatcacttacccactttttctcccttccatgtcgttttatgtagtagcccattttacagatttgaaatttatatagtcacaatttagttttagtactgatgtgcaataaggtttataactttttgtctataagaaattttgctcgtctatatttcactcttttcttcataaatcatgaaaaaggtcatttggcatatatctctttcatacatgttcaacttttcatacaagtttgcaatacgagaaattttacgatctttacttagaggtggcatattttctaacgtaaagtttggtacctttgtacttgaggttctgacagacac

SEQ ID NO: 55959 - DNA, 1708 bp, Oryza sativa
tgcatgcattccttttatatcaaagattgggatgaaatttccagcttaatcctgacagccgcaatgtgtcttgagcaaaaggaagcaaggctgcaactgaaacacggtgaatagtaaataaaaatctcgcttttaggaaaaaaaaggtgagtcgtgcacaagtgctgtaatctggttttggcaaatttttatcgagatatactactccgtcgctttgtttacacaataaacctgaactctaggtgtagcagcttgaagcattaaaaaataagatggcagcaaacagatgtttgctttattggatttaatacttggatattccactgtgcttcccaaattgagctgaataaatagcttgacgaattgttctcttaacatgtctcagttgtcctttgtatcaaatgagcagcataatccattcatggattgttcttttccactggtgatacagatagttacttctaatgtttcatggaaaagttcgagctacagaaatttcttaagcaagcttacggattgtttctgatgagtttagcaactctatggaaacaagcataagtgcttctcatctgaccagttccaagagagaagtagccaagtaggtagaacaatcccaaaactgcaaacttattttactgtatatatatactttcctttttagcattttctgtaaagtcccagttctgtattgcagttggcatggttgtgttcatcggaatattgaatgtcaaatcgaaaggaggcgccaacctatagctatcaacaacatggacaccatggttcagattcataaatttggggatcatggatgtctaggttcagaaatttttggattttaggcaacaaattttgtagaatttccaatttagaaaaacacattttgcatttcgttataatgtaataaaataccaatttacgtttatttgatgaattatcaaagcaacgcttacaatacttttatttttatcggtgcatgtgagctacaatgtattaatatatatagttgtgcatcaacaatggatgtgttgttctccaatatacttcgcttagtatatatatcgacatgccttgtatgtgcacgctcactagtagccctaaaaaggccacatgtttgtgcttcatcatatatcatcacataattattcctgaacattgcgccactgtctccacaactttgagaggcacatcaaatttatctgcaactttcctagactactatgcaacaccggtggattggtcttcgccaacaactctaaattaattgtgatatttaagtcatctggttactttctcccgtttgaacctgaattagacaaatcataaattttacatgcaaagttcagtacatattcactataaagtcagtactagagtaaaatcaaaacttgagcaaaaacaggattttaggtccaggtactgaattggacttaaattccatgtctcaaaactaattaaatcagaaaaaaaaattcataacttgacaacttgaacttgagtattcctgaaaattactactactcatgaactagagttttagttttgctctatgaactgtagcaatcagacaaatagagggcttaccaccggtatcaatcccacctctatgtaccatagctccagccccatcctgatctgacgcttctatataacaaaaagaaagttaattcattcatgtacttgtaaaaatatccagttattttgggggaaa

SEQ ID NO: 55960 - DNA, 2311 bp, Oryza sativa
attcaggcacctaaatttcagtaggtttagcttaaattgaggagttgttcattaactagattatgtactgaatcagagcttagcttctgatttcaatgatttcgaaacaaaatttcgaacctgtgattcacaacttcaaattcagaacttcgaatttagaactagcattgtgcatttaccgtactcaacagcaatgaaaccagtatgattaacagctcctccctctccagtccttgttcgccacgacacgtcttacttgactgtaaagtctaccacccgaagacagtgtactagtctatgtacgtgttggactcgttcttctccaggcttccctcgctctctttaatctgccaccatcaacaaattaactctgcactgtgcacacatatgtaagaatcctactattatcctttccccgtttccgaccaggctttccacagaaagcagagtagcgaagcacatgtcgccggtgaaggtgttcggctcggcgccgttcacgaacgtggcgcgggtgctgctctgcctggaggaggtcggcgccgactacgagatcgtcgacgtcgacttcggtgacagggagcacaagggccccgaccacctcgccagaaacgtatgtgtgcgcagagacaaggattcatttctttcttgctttcgactaattcattaaaagagacaaattattgccgagttgcaacttgattttgtcgctggtgtttcatcagccgtttgggcaagttccggcgttccaggatggagacctgatgctcttcggtgagtaatatacacatttgaactatcgagcaaaaagcattctcagtttctcacgaattcgcctcaaaataaaattattcaatctttgtgttcaaagagtcccgtgcgatttgccggtacatactgcggaagcacagggcgacggacgaggccaacctgctgcgggaaggcgacccctccgagtcggcggtggtggacgcgtggctggacgtggaggcgctccggtacgagccctcggtgcacgccgtgttcgtccagcggcgcgtcgtcccggcgctgggcggggagcccgacgagcgggtcatcgccgagagcgtcgcgcggctgagggagacgctcgccgtgtacgaggcacggctggaggccacgcgcgggtacctcgccggcggcgaggtgagcctcgccgacctgagccacttcccgtacacgcgctacttcatggagatgccgtacgaggtgccggtgttcggcgcgtaccctcgcgtgacggcgtggtgggagcgcctgctgacgaggccgtcggtcaggaaggtggccgccatgatgagcggcggcgagggttgatacgtgtgctgatgcttgctactgttttctttttcttaaaaaaagagaatcatactctctcattcccataatataaggcatggtcaaaattgacacggtcttcaaaactaatctttatcctataatttctcatatattataaggtttgtagtaacaaaatataaccatatgaaagaaaattcaaatgtcaattcaatgataaattttttagcaagtaaattcatattgtactaaatattggtcaaaatgtttgaaagtgaaatcttgaaatacgtgggtgtcttatattttaaaatagagggagtaatggagagcgtttatatttctggcctctgcacaggatgcttggtacagtattgtctattgtttgtcataatgactactctcttcgttttttaaaatatagcaatttttagatggatgagatatattctaattaatactatgaatctagacaggggctagctaagatatatctcatccaatcaaaagttgttatattttgggatggagatggtgcttattactatgtatacatgaattatgtccttgtgattaagacagtgtgtatacctttgcgatactggatatgttttccatatccttgagttttcacttaattcttttcgtgtgactaagtttcatgtcaaatttttgttttgcccttctacatatgctcattatgttagttgacttcgagagttcgagtgggttattaacattttagaagtgatgagctgatgatattgtatctcgcttataatcataggtgcatgctagcctctgtgaaattagaggtatgtccgtgcaaatttagccgagacacatgtacaatacgaaaaacaaggatctatctcaaaatatggcgacatatttttaggtaaaatataacaaatataattatagtttaaatctagtgtaattacatattaaatttaagggcttacatatatatttatattgtaagtgtctaaat

SEQ ID NO: 55961 - DNA, 6686 bp, Oryza sativa
tatagtttattcataaccaattaaaaatataatggtttgaaaatatttttcatgttgaatcaaccaaatgcatattcttatataaaaaagttttttttgtgtgtccatcaatttttcaaaatattgggttgtctagccgatagatcgactaattgcaattatttagttctcattccgttcgatgcagctgcggcattgttgtcttgctgatccttgagcttctcgaacagcttgcgttgcacgtgctgcttgaatgtgcgcggcgcgaagagcggcttgtcggcgccgtcggcgagcagctccggcaccggctgcagcagcacggactcaggcggcggctcgcagaagacgacccaggagaggcgcacggcgtcgcggctgacgaggccgcggtggagcacgctggtgtaccggccgttggtgaggatctccagggcgtcgccgacgtggacgacgatggtgcccggctcggggcgcgcggtgacccagctcccggcgtggtgcacctgcagccccggcacgccgttgtggaggatgaaggagagcgcgctgacgtcggtgtgtgcctcgacgccgacggcgaggtcaggccgcgggcacctcgggtagtagttgatcttgagctgaaggagcaggtcgtcgtcgacgccggccagctcatgtcctctcaggcggcgttccagcgtctcttccggcaggccgaggccgagggagaggatggcgagcagcttggatgcgagggtccggacgcggccgccgaagtcgcgcgacacggggacgtactccggcgggttcgccggccagagcgagtggtcggcgaggtggtccgggtggacgaggtggaacaggtagtcctcccactccctcttcccgctggcgttggcggcgagcttgctgccgtacccctgcagccgccccgccgccgggtcgttggcgtacgcctccttctccgcgatgggcagcgcgaagaacgcctcgcccgcggcgcgcaggcggccgaggacgtcgcccgggaggccgtggccggcgatgtgtatgacgccccactcctccgccgccgcgcgcaccgcctccacgcacgcgtgcctgccgtcgccgtcgttgtcgaacgcggagatgtcgacgacggggatgcgggcggtggcgtcgtcgtcggacgcggcccgggcgagctccagggcgtcgccgaggtcggcgcgctcctcctccgggcggacgtactccggcgggatggcggagacgccgctgaggctgagggcctccactctcagctccacatccgtcatgtcgccctcccgaagtaggctagtagatgagctgcgtgcgcacgtactcgatcggcggccggtgatggcgaggcaggcagagcgcgggtagatttatactccggcgctgccgccgctttgctccatccatggatcggtgcatgcatgtgttacgtttgtagctaacaacaaccagcggtgtcgggcacgcgcggttagctccatccatcaatcacgtgcgcgttcgtaacattggttgattggtccctgtcaataatgcccctgttgtttcttaattcagatgatacgatccgtatgtataaactcattgcatgctcgttagcctatataaggcataacaagaatttgacttttacaagttagaaatttaaattgtagaacttattttgtagttgaattttttctattgttttctagtttccaaccttaattagcatatatttggacagtgaagaacgaaagtttaaaagtcttaagcaccatttctactatgtgaaactatgattgtgtacgcgcacgagggcatgaacaatataggcccactcctatccaatggcctcaaataacaggtaggcgctgaggcaacacctctaaaaaaaacctacccttttgggcacttctcattttagtcctcgtgcttctaaattttacaagaagatttaaaattttacactactagtaatctgtccgtgctaacgctacggcactataaaatttgtgttaataaattattaaattcatgttaatcaaattaaatttcccaaattctgtccatttgatccatgtcatatatgaaatatatttaagaaaaagtacaaaactatcacattgtctaaaaattaatcaaaaccatcagcaattgtatctactcagaatcatctagcaaatagtagtactaaaaagtctggaaaaactaaaagcttcatatcacgggtttgatttatcatccacagattgccatcctaaaatacaattcaacaaacttatagaatgtacaagggatatgacaaaaaaatatattactaccagagttttttttttgtttgggaatacgcaaggcacgcatatttgtattaagagaaataaagagtatgtacaagcgaagccaaacaagaaaattaggagggggatgcgaaaacaggagaacaataaaaagcttaagcctattctcgcgacatcagaaggaaacgacctagaacaagacctaaatggttagcaccggcagcacctcgtgtgccaaccgccagagagtcgcttccgtcatagctcgggctatctctgaccagggcctttgctgagagttgaagaccctattgttcctctccttccagattgtccacgcagtaagggttgctattgtatcaaatccccgcctgctagccctccccactttaaggcaggaattgtagacccagagataaaaggaatcttcattcaaggggagaaactatggcaaaccagtgctggaaaggaggacccaccaaagctgatgagactccggacaggcaaccaagatgtgatcaatagtctcttcatgttggtcgcagagcacacatccatccgggtgaggcaaacccctagaacacaggcggtccaccgtccaacagcgcctcattgcgaccagccaggcaaagaaccggcatctcgaggggggggagtcttctagatgggttcggagtggaaaggagccctacctagaaagagtgcacgggtatgccgaacgttaagagtagactcccgatgcttcccacttccaaatgaaagagtcggggtggtcagagagccgcaccgacgacctcaggagactccagagttgaagatattgaagaatagcttgcaaacccagcgctccggtgcagtctctaatccatctccggtcttgaagggccttggcgaccgttctgcgacagcgaagccgtgttgggacagacgcccaaaccgccggagatatgtagcgaatggaggaaccctccaaccagttgtcctcccaaaaaaggatggactccccattgcccaaaacacagactgttgaaactaccagagattagatatgcacatctagacaaggagcaacgagatacacaccttcttgccgctgatcaatggtgcttaaacacacagaaatattatagcaacatgtaacaaagatgcacacctaaaaacattgctcgtacttgccggctcgtcagccgtcagatggttaggaaccaaaatcaatattaaccagtattgtggccactcaaaccgttggattagaagggtcaccacgtttgcatccatgacagctgacaccctccaatgaagtttccccttgatgcaatcgaccaccgcaagcaagatacggagatatagacttgtccaacaccactgtgtcatcctcatctctcacctgtactaatccgctcttcatcctgctaccatcacaaaaggtggctgctataaaaataaattaaacagagtgtgagctacaaaagaatccttcgtaatagcatccgaagaacattcatctctagaactgtcacaagtaaacctccatagagcattttttgaagtgttggggctattgcataaaagtaagggtacacttacaaatttaatcgtaccttcaaaaggtcatgatcattccatggccctctgttagaaacttagaaccaaggcaacaccatgactgcatgcacatggaccacgaatgaactatggcaatttactgctaaagaacaatatgttttcacgaaattggtaagctaaatagatattgttgtataaatacgtgcaggctaagcgtttcaataaaggttgccaggcacagctagtaagtatgcacgtggaatccatgtggcataatatttgtgataaatagattaccctaaatcaagtcactcaaatttcgtaaaaaaacgttaagtggtctctctgggtgaagcaaactgaaattcatgcaacttcagagtcaagccacatttatatttcatctttcagtcttgtacatacatgttactaaaagcacttttgccaaaacttgcaagtgaacttcagaattaatgcataagtacataccaattcatgctacacagcaaatggctataattaaatctatgcaaattgatctcactatgtgtgtggggtcctcctgattggcatttcatcaagcaggatgccggagagggtacctgcataccagggcgtgctggaagtgggtggttgtgttgtcccatagtggacttggaactggaggggggcgcaggtgatggtccccagattcctgggttggcgacgtgtttttctctctcagtttgcagttgttcttcagtaacagagttgggagaatggagtggtcgagctgtgaattccacgaaaccagaggttcaagatttggcctgcacagaaggattcatctcatcacaatgcaaattgagagaaaaagaaacatcacaacagattacctgttcacgcaaagatctgatgtttgccatgtttaggcggaaggcataactggcttcgtcaacagaatggacacggtgggcttggagtgcggctgtggaggtctcgacgcttccacctgtgtggaggtggtccgcaacagtttcaggcgatcgatcttattattttatctgccgatgcaactggagagaaggtgatacagcttcagctcgccgatctccttatcccttctatatgagagacagctaacgagcgaggagatatcagacatatatagaagtgagaatcacaattagctttcagaatagtaaatccacatgcacatatgcataaaaaaagactctacattaagctgcattgccatcgttgatagcaatatagggctgttctccttataagtcgtcacgacagtaaaatagcaaaaaaaaaaaaaaacagattaattcctgtgcaatttgatgtggcaatgaaatatagaccatgaatctggttactgactgatcaaagccccctatcataattgaccatgataaagagcgtaatgggtgtaccttcaatttagggaaggaggttgtgtgggtgcgaagcagctgttcacggtgatgtgggaacagataatcggtggcggcaccgtagtctgtgatgacggcgaggttcccccttgacagcagtcctatactgaaacaaataattgagcactcaaccattccagagtactacctgatgtagatcagaacagctagggatatttgttggctgccgcggaggagattggcgaggcagtcgtacggacgcggaaggcggcggcgatgaggattagggcagggagcgcgacgtcagggcgtggacgccggggtggcggggtgcgggcggcattggcggatgccgtcggatgtaaatcatcatatcattctcgatcgttggatgtgtcacatgatgaatgagtaaaaacatttattgaacttatagggtagaaacatgctaaaaatatacaaactaatataaaatctctttttctctcctctccccactatccacgtgactgttcccctctcctctcaccactgagctcactcgacggcaacaaatgcatcctcttcacggtgatcacaagcttgcgttgtctcccctccacctccatttccactcgacggtgaccatgagctccccgctgttattgaattgctactaccgcttgtccactttggtagatatcgctgccttttatttctcactcactatctctttatagtgccaaggacaccatagacaggtcaagaaggccatgcttgtggttgagaccttagtagtggttgagtcctcgcttcagatccaatagtgattgcggaggccattgcagcttcagctcagtcacccccacgcctcagatctacttgtttcccttgcaaattggtcaagcaatggcaatagctcgtttgaggacaccgccaccctccccccttgccctcttctcatttgtcggccatcaccgtgctccgtagtggtgcaggccaaggtggcgtgggctggcgcaaacaaatcgagacggctttggtaaaggggccgagacagcgagtgcagatccaatggcgggccgggcctgggtggcatgtgcaaatccggttacgaggacagcggattgaatgagaaactcctagcgacggataaggggaagggcgagatagatgggaacctatcgcaaagatatgacttcgctaacacaaggctccaagcatgccttcgtggttccctggatagggcaagccgagctcatcgtgccatgcacaaggcacaaatgacctcatgtgcccacccgaccccaccctctcttttctccatatcgatcagcatatggcgtcgtgtggccagatgtcattgtgttgttcataacatgagtaaatccatagacgagaagctcatttctgtccatagtactttaaaatatagtgatggtaacag

SEQ ID NO: 55962 - DNA, 1478 bp, Oryza sativa
gctgtccccatcagcgacccacctcaactgacccgtagcatatgtgcgtacttcataatctagacaccacgtctacattattaaatactactctacatcccccgagatgacatatagtaaccgagtaaacgggcattaaacacacaccactacacctctctggtaggctaattatacgactgtaccgatacagatataaagtaaagacaacacttggatgtattaaaatatcgaaagtatataaagaataatatttcattaattccaaaagtcttacaaaagaaagaaggaaaactactaaagccataccgaaattcctccgaagagtccgaggactccgagagcaattctattctactccacttagcactagaatactaaactaaagtgtagaagagatatcttgagcttgctcgagtgtgtggaagaacgaatgaagtgaccccttcatatagccttggaatgacggttaaaacggttggaattgttggatttaccctgcaaccaccattgagaagtcatcacaagcgtacacgtggaggcccaggctgatccggcgctgccagggttcggcacctaggtaggctcagtaggcctccacacttcctaggtcactgacaggtgggtccctatgacggttgcgacagttatgacagtttccgagacggttacacctgacatgtgagcccatcttatccttaagcttgcttaagggtgagttttcttcatttcttctccattttatttgctcaatcgctgcaatcaaataaaatccaagtacaagtggaaatagattattctaaaataaatatgcattgcaagcatagctagttctcctttattttagttatattgacggtcgaaattgatctataacgaccgtcaacaaccagcgacctccacctccgccgccagccgcccgagcaacctccatcgacgccgtccgtggccatcctcagtgccaccgtgctggtgaggggagggagaagagagagagagatggggaatagagagagatagagaggggtggggaactgaaaggtgggtcccaccaattttttattaaaagaattgttgagtgcactgccatgtggaaccaaaccaccatggattgagtcagagagttagttgtctgattttgagtcgaggagttagttgtccgatttatatagttggaggtgaagaatgtccgattttgtggttcagggggcaatttggtcgaccacgatagttcggggaggtaattcatacttttttttaaataagataaatggtcaaatgtaaaaagaaaaaagtcaaaatgacatctaattttggacggaaactgtaattgtttgtccaagattcaaagaagcaggtcaaagccgaaagctgccatgctgattttgcagcgagccagcaagccgcggttcgtacactatgctccgacagcgtttgattgattttgtcaaaactgaattaccaccggccgatctttt

SEQ ID NO: 55963 - DNA, 1309 bp, Oryza sativa
actgagtatatacattttacggaaaacatgactgataagtttaacagaatcaggggaggaacataaacacgtaatattgtaagatttttagatttttagcatgttcagcatcatccactggatgcatagcttccaaagaaatgatgacatattgaatagaatatatgaggaacaatcagtgcaagattttttgcatgctcaacatcagccttgactaggtacatcagcaacaagccaggaaggatgatataatagggaataatgatgggatgatacatatgtaataatggttaagactgttaccatgtgcaatatctacccattttactatttgattaagcagagagaataccaaaagcatggaacaatagctatcgtactaaagattccaaaatatcttctgcttgaagttgagcatcgcataccttgttttgagaaggtccagacgttcctccctttggcttccaccaaccaactcaccaacctttggaagatattccagcaaataagttagggatcatactatgacaggtcgataatgacaaaatttctgttcatgtaacacattcacatgcttacacctaactcaaaatttatgttcatgcaacatatttacatgcttacacggttacacctaacctcaaattttctgttcatgcaacatatttacatgattacacctaacctcaaaatttatgttcatgcaacacatttacatgcttacacctaacctatattggaactaactagaagtctgaaatatttatatttaccttgggcacaagaacatccatagcagctacagtcttctgatcatcattgagtctcatataaaatgcctttatttctttgggatagttataaacaatcaccggcttcttaaatatcacctcggttaaataccttaaacaatgtaagaagagagataaaaatgtaaacaaagcacagtaagtcatcggaagataaaatattaaattccaatatagatacctttcatgctctgaagctaaatcaattccccattcaaccttgttttcgaatttcttatcagtgacatttttcaatagctcaacagcttttgtatatgaaatgcgctgaaaaggtgtcgaggaaacaagctccagacgctaaaatgcagtcttatcgtaatttttcaccatgaattccatgtcttcccggcaatgctcaagaagccacttgcaaaggtactgtacatatctttctgcacagttcatatcatcctggaacacagttcgccaaaatatcatgaaataacaattcatacagaatcttagaaccaatagtagat

SEQ ID NO: 55964 - DNA, 1050 bp, Oryza sativa
  unsure (1)..(1050): unsure at all n locations
atttatattttctgcttcaggatgctgctgttcgccgactacgaacacatgaactcggctgttaagctcaacccagctacatccaggatctttgttaactcctcgaagtctcatcaaatgcctcaccctttcaacatcattccattttctctgggaagcatagatgtttgacagcaatatatatgctgaggaatctccggtacctaactccatcaaccgttcaccagcatatgctccgacatcaaaatctcgcaaagagcgacatgctcctagtactatacgccacaaacatgttccgtggtcaatagtaatggactctatgaaatcctttgcttccttaagcatccctgctcggctaagaatatcaaccatgcaagcatagtgatccagcctaggagttaaaccataatcttttgtcattaaactaaaatattcccatcctctgtcaactagacccatatgactgcaagcacacaatatattaatgaatgttatattatcaggtatagtgccctccatcttcatttcttcaaaaagatccagtgcaccattgccacacccattttgtgaaaaaccagaaatgattgagttccatgcaataacatccctatcaggaatccttctgaagacagacatgccatcttcaaggttcccacactttgaatacatcgtagacaaggcacttccaacaggggcccccaaacctaacccatatttcacgatttgcgtgtgcaattgtttccctggttccagtgctgcaatgccagcacatgctctcagaccactagctatagtcgatttactggggatgataccttccttgtccatcctggcatacaatgtcagggcttcctcgtgctccccattctgcacatgcccagaaaccatcgctgtccaaaggacaatgtcaacctcgtacaactgatcaaacccttcttttgcgtcagcaatacaaccacattttgcatacatgtccaccagtgcactcttcacatatatctgaacctcaaaccnnnnnnnnnnnnnnnnnnnnnnnnnnnnnnnnnnnnn

SEQ ID NO: 55965 - DNA, 948 bp, Oryza sativa
gagtataccgtaatttcctttggattgaccaatactcgtgctactttcatgaatatgatgaatacaattttcatggagcatcttgtcaaatttgggttggtattcatcgatgacatccttatttactctaaaaatgagtaagagcatgcccatcatctgcgtttggtgttagacaaactccgtgaacatcaactctatgcaaaatactccaaatgtgaattttcgttgaaagaagtttctttccttggccatgttctttccaaaggagggatcgcactcaaccgaggtaatgtactgttgtcgaaacgacaaccgcatacgtcgaaagacgtggttactcaacagtggttggaaagcagtaaagtgtattaaattgagaatttttcttgggatcccccttttacatggccctaggggtctatttatagccctattacaggttcccctattagggtttaggtttaataggggaatttacatggttgcccttatgaaagggacatttacatgggtatatagtgtaattgaggtacatgggcctctaatgggccgactggcgaacgctggcccagtggcccccgggcttgatcggctgagacggcctcttgggcctccttgaagtttggcttgctatggcgaagtcatccgccttcgccataccttcttcgccatatagacttcgcccaaaatgccttcaaccttgtgggataccagtgcgattcttcgcccttcgccatctttgcttcatagtcttcgccatgggggcttcgccccgatagactcgacgtcttgggcttgaaccctccattagttgcatggtttcggcaggaccggtcgaagagtctcatgacataccgccaacaagcctctcacaggaaagggtgagataggagcttcggctgagaccgtgcaaaccatgtggtatggtatgaggcaccccttttcgac

SEQ ID NO: 55966 - DNA, 1371 bp, Oryza sativa
tttcctgggtgcatgggaagcatcgattacatgcattggccatggaagaattgtccgaaaggttgggcgggtcagtttacaagtggtaaacaaggtgttcctactatgatccttgaagcagtggcatcaaaaaatcttcgtatatggcatgctttctttggtaccgcggggtctcagaatgacattaacgttttaaacaagtcaccactgttaattcaagcaataaaaggggaatctcctacggtacactatactgtaattggaaatcaatatgacatgggttactatcttgccgataaaatatatccagaatgggcagtattcgtgaagacagttaatgcccctcaatcagcggaagataaaacattttcgttgaggcaagaaggggtgaggaaagatgtcgagtgtgcatttggtgttctgcaatcacgctttgatattgttcgtcgaccagcacgcttatggaagcaaggagacgttatcaacattatgcaagcttgtgttatccttcacaatatgatagttgaagatgagaaggactcagttagggatgtcttggatttgaatgaaaatccaagtgcgacgatagtgatcccaccagaagtgcgtacaaatgatgaccctaatccaagctttgcagaggcacttcgtagaaattcggctatcaaagctcgaccaacacataggcaacttaagaaggatctaatcgagcacatatggcaacgctacggaaacaaagaaaattagacaaaaagcattgtaactatatataatataattattatatatatggtttctaaaaattattgtaatcgcgtttctattatttaatcttcatatttattctatcaattagccacacaatggtacatacaaatacatttatagttgatctaagctacatgcaaagcattaaacagcttacagatggcccctctgtttgtgggttgtatgagctgtctttatatctatctgtatgagaatttcgagtttctgcagacgacccaccgtctgtgggttgtacatgcccttatgagaaagtggccgcgcgaccagctagtttgcgtgccttatgagtgcacgaaccacggaaccagctgatttaagaatctttgatgcatgttttgttttcgtcaccactattacaatacggttttttttcgtgatagttaaaataggttttaacaggctgtcaatagggtcaccagagaccaaaggccaaaaaaagaaacataattttcactgatcgatcaagttttctcgaaataaattgccggttacgttcagcatctccaattaattaaggtgcacgtacagatatctataaacgcgaatattagagaatggcctaatattaaataattagaaaat

SEQ ID NO: 55967 - DNA, 11573 bp, Oryza sativa
cccaaataatacctaaatcccaaaatgcatcaaatccatgaacacatgaactaaaatgcatcaaatccatgaacacatctagatcatattcaacaaattacagaggaaataatacaaaacacaaaggaggagggacaagaaggggaggggaagagatcgattcgcggcctccaaccgccatcctcctgccgctcgccgccaccgcatcgcccttccgccggccgcggcctccgcctccccttccgtcggatctggcggaggggagggtgcggccgccgctgccacctccgccggctagccgccaaccgcgggagagaagggagggagagagaggaaagggatggagagagagagaggacgcgagtggatgcatggatgaggagggaccgagggagttgaaccttatcgatcgcctcatgctggaggggcccaccggctcggctcaattcataagtgtcggtttttaatttaccgacacctataatatattaaaggtatcggttttttaagaaaaccaacacctatagaataggtgtcggttcttatttagagccgttttttgcgatttcaacccatggaagtgggaaaaggcttataggtgctggttttagcacttccggcacctatagtgccgacacatatttgatgttttatagctgtgggaggacggttaagttttctaaaaaaaaatttgcaggttacattgagcatctccaaaatattaatctctctaaacgtcgtgggagtgctggaaaatttgggcgccacgtcattggtttttttttccaaaaacaccccgttcttccggttaatcacgtccgagtttcacctaccatggcgccgttcgatgccgcattgggatcgatccagtcgtccacctggcctacggtgccggttcttccaccaccatcagatcgatgagaggacaacagacggtcaagatcttcccaacatatccccacacagccaaaaccctagcagcgctcgcggcccgctcgcatatggcctcatccgccgccacgctgctgtagccctctcacgggcggacggcgacgcatcggcgcacgcagccgggcgccggttccccgcctcacgcaacggagtgagggcatggcgtgcgtgcccctctctttccctccccttctcttcttctcactcttcttgcgccctcgcaggttttttcctccatcgtcatcggcccatcaatggcagttcgtcccacatcgattgccatattggcagcatcaatacatagcatcatctcgatggtctgcgagctcgagctcgagatgtggtatttacccatatcatgcgaatcatttgagccttccggatcccaactcctgaagcgtccagggcgtatctgtctccatcgttaggcgctgctgttgttcagacaagctgatctaccgtctctcctttcaaggtgaacacctatgcccactcttcccttccaaccccgtttcttctacttcaccctcactccatcattccccatttgcatgaatagttgaataccattttgttcagttacatagttcaagtcgtcattcattacttcgacaaacagtctgccgagttcatcaactcagctgctggggccatcaccgtctcctacgtcatgcagctactgactggtaccatctttatccatcattaaataaaaatctggatcgatctatgaatatcccctgatcctaattttgcatcttaatattgaatcaacaatttattttctaaacttgctgcagggaggatatgcataatgtgctttttacagagggacaatgttctaggtgtttgcaaaaaagcacgtgtgagggcacaaatccatactaaggcagatcgccaacttatactgtcaggacatatgtgttttggtactgttgctgctttcaaatttattggttaactgaacttaaagctgttttgcattgataatacttcactactgtttgacatattatattttcctacatggaagcaattgtacgaactagccgactgatatgttctatttttcaaattcagcatcgaaataaaaatagcatatgcttatgttaccatttttctattatgtggacaagtcatagcaaaaaaatgtgttgcaattctacataaagtcatatcattcaaatgggacatttcaaattgcatgctatgtaacgtcagaggagctcttatagataatgtacagacaatatgtgttttgaagctctttgtatttcaagcattaggtaggcttttagtcacttactgattagcatttttctttgtgtgtttgctctcactgcccacttagttcttaatgtagtttctagatgacttagatttggcactaatagaactagattttaagttaaatggatgatttatatgcaggaagatccgatttgcttcgatactctactatctacatgccattttcagtatttttgttgtacgactgctatacttatcctagcattgctatatatcattggaccaaatggattagatccttctttacacttttaattctcttagctgatagatcattgaatggttaatatgctcaattttgggttgcatgctaatatggtgtatatttgtctgcaggatattttttcccttccttttccctatcatccttctctattgtgagttataacttattatcttaattttagtcatccaggccttctgcaatacctattttgatggaattattgaagttttcataattatattcagctatctgtcttttaaaactgaattactagctatgagctcagaatagtcgcaaagtatttgccgttgaaaatagagatgatttcctatagcccactaaggagtgatggtaggatagatgtggctcttatgtatcccggtgattcaccttgaactataaaaagaatctttgtccagacaattaatgccacctatttgcatcaatgaatagtcagtttaaatgcattaattgggtaaactagctctttctatatgctacttaattagttttctcaaatatgtagagtaaattaccccatagttaaagttttccaatccaactatatgcccatccattttcttctcttaaatgcggaaaacacttttactagcactagcaccttaaaatttgagcaagaaaagttattttagcatcacaactgcgtggttgttcctttcaccgctgttgataacttgatatgacagagagataacagagctccccaagaggtgttataattttgactgaatgcaggataactgtagtatactttcctatgggattgtaaaattcattgcttaatttgtcaaccttcaaaccattgtcatcggcaagcatagactaatcttctttcttttattgttgtaggcctacttgggagggagttttcagcagtaatatatgccacacaaaccatatccgatatactttccatcagtgggggagagtagtttagatgttgggtgagtgcatttcattgttggagtgtaccagtgtaaaatgttctgaaattatttcgtaactaataaagcaaatttacaaccttctgttttgtatacaggttaatggtaattagtaagcctctttgatgtgttgtggctgttatgcttaattcaatgtttagtttgtagttctcttggaccttagagcaattatatattaattacctgggatttatgggctccaacagctacccaaaccagtccctaattcttctgtgcctccgaaaccatagagaaatgaagccagaagaagggaaggcttaggcgagaccagggttaccggagggtcctgtaaaaagaaaaccacggcaatctccttaaattcaaataaattttaaaaataatttaaaattttgataaattttatacagttttcgtacggtttgccacggcgcggttaccatggtaactctggccctggtggtttgggaaaccctgggcgaggcgcctccaattccaatcttgtcttcgcacgtgggacgagacgctgctcccgtaggaaagggcttccgcgtcgctagccaacgccgcctccggtccgccgtcatacacctgttgcgtccgctctaacagccggcgcagcctccactcatctcaccgtccccgtccacttcggccgctagcacaatatattgctctgtccatcgactgtctccatacgctatctgtctttcactactggagaaaccatctttgtctggtcggccaaaattcacaatagttccggttcattaaaaaaaccgggactaaaaatcatatttagccccggttgaaaagcccatagcattttatgatctttagtcccggttggtatctttttactcccggtaaaaagatgaagtggaaggatgaaagcatttggataatacccaggaggaggaggaggtgctgagcttgagctagctccaggatgagaggagggcgccgccctaggagcacggggagctccaagctaaaggcggggcttgtactgcttgtgcttcttcaaattttgcccagcagccccaagcttgtcttgaatcaacctcatgatgtaaggggcataatagattccctaagtgaaggtccccttggagatggcaatctcttgcatcataagagacacaatgtcgaactgacggccctgaatgatggcatcgatgacgtgccaatccgcccccataatgtcatcattgttgccaaggcgagggaggatggtagctctcacaatcctgttaaccacactggggatggtcctcaagccggcaaccttcccatgtgtgtaccgcactccatcttcataaaactgagagaggtagtctatggagagcggattgtgagtgtgctcctcatgcaagtcatcttcaaagttcaagcgaatattgaggagccgccggaattgcctcctagagatagaacactggagggtgtcggacatccacttcatctcactattgtctccagccacccacactgtagcataaaactgccggatcaaatcttcattgtagtcttgcttgagagtaacaatccgatcaatgctaacagtcttgaagagatcctgcaacccctcaaactctggacattgatgtctctccaagaaatccccttatgctctgcaaaagctttccctgcataaacttgctcatacacactcttctggaaagcggtgtgaaaacggggatccggggtgtcccgaggcctcaaaaactgatcatggtgcctcaagatggtatattgtgatggattcctcatgttcacaacaaactggatggagggatcaatgtgcatatatcatcacttccttcatcctcatcctctccacttctactgacatcatctccactttcctcctcactatccccctcaacattggcctcaacctcttcatcactttgagcgtactcatctccgctcgattcctcaggctcactcacgggattcggagtgggtgcacgacgatcatggcgagtgcggggaggcatcactgtcaaagagcaaaggatgatagatattagcaataattctagaaacaatttggagaggtgaaaatttgcctatatcctgtggaggggtggtcagaccacagccagtagggcggtcagaccgacgatatcaggccggtcagaccgcctgccggtggccggtcagaccgacgactgacggccggtcaaaccgcgcgcacacgccggtcagaccggcggctgacccacagtcagaccgcctgtgtctccgggcagacctcctcccacaagttcaagcatccaaaaattttcacatctactcatttgagtctaaaaattgctagaacaatattgcacaagagtggaactagaacatcaaagggttggacctatttcatcaagattggaataactacccatagccctagggtgaaatagattgatttgagagaatgcacaagagggagagtgatttaccggttggaggagttgaatcaaaccaagaaactaccctctattggtgcaaatcgaagaacacctcgtgcttcacctagagttccatgccatggatcaaaaactcaacaaaaacacaaactaatccatggaatagagagaggaagcggaggagaatcacttacggtgtaaccggagagaaatccgcggtcaaaccgaatggatttgatggagggaggtggctaggtttgggagaggagagatgagtttttttcgagttggggaagaagatggttgaatgggaggagattaggtcgggtaggggaagaagggagaagaaaaaggacaaaagtcctgggcccacctgccggccggtcagaccggtgtcacgcccggaaattcactaataattttcgaactaatttgtgcataaaatcctcgtccaggaatcagccgaggtacataaactgacaatttaatatacaaatccatcataataataacgttacatacttaaaaaaaaagaaaaacagcagcggaattaacggtctagcgatggcttcagctccactcccacaggcagctcaactggggtataagccaaacgtcttctccttctggatcctttttcttcaactgaggttgattgattattgcaagaatgagcatatgatatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgttgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctagcttgtggttggcacggttaatgtttcacaacagtagctcgcgaaccggtccttaattgccatgagcacaactctcaaaaccatgtgctcacaacccaccattatcaagttttagttggcaagtaattaattaaccaatcacgattgaccatcgtgaactatcattaagccataattaaataatagtgagtcataagttatcccaatagtgtgttaatgtttctaagcatggctaagcaatcataactaatatctagctgaaccaatatataaagcccaactagtcaagttataataacccaaggtatcaaggaataaagtaatcaagaacaaaagggttataacaaacaataggttaattccacccaatgacattcgaaaataaatgcaatagttgaatagaaacaatagctttaaacgggatcaacatgctcaaagggttgtttgggatctgtgtgacttgccttgcaataatcagtcttcaattaatcttctgaacactcccgacgcactcacgaaccttcgcaacgacggaaacgacaagctaacacgcaaaacgaagagaaagactaataaaaactaaataaacagtacaaaaacaagcataaacagtacatgtggatatttttaacatgtagatcatgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggatatgaacacgtagaggacgacgagacgaacccaacggtactcaccctcgaaccaaacgacgaacgacgacggccggcgacgggtctagcggcggcttcggtcggcggtggcaccggagctgcggtggtcggcggcttcgggggtcaggcggccgggcttctccaccctcccgcgcacctaacggtggtgacggcgaccggcggcgacgacggaggcggcggcgcgacgcggatggagctcggccggcgacgatggcggggtggagcacgtggcggcggtgctacgaggcacgggagatcacgggagagggggcaaacgaaagaggaggacaagggggtcctatatatagccatggaaggccaggatcgagcccacaacgacgggaaaaactcgggaaagtttagatcttcgccggaaaaaggaaaggttgaaccgcgaaattggaaaggatttccatataaacttttggggatttcttggggacaaggaagaggagattgagaggattccattcccgcaaccaattcgaaaataagagcaacggagaggttggattttggaaggggatcggcggcaacagccaacaggcacggcacggctcggctctggctcagtccagagctggaagatgaacagtagcgcggggaaggaaagtagacttcttgccgggcttttcttttctcagcctgatttgaagagggagcaaaaccggactttggctgagagaagaagagaggatgcaggctcgggttgggccggcgtgggatgcacaacacgcgcgcgaggagggagagaagaggaaggaaaggaatgggccgattcagcctaagacaagggaggagaattttattacttttccaattaaaataatcacttaaatgatctttgaattgttaaaaatacttccaatgctcaaataatttcaagaaaaatcctgaaaatacttggacactcaaagtacttaaaaattataattagaccatttaatgattaatttaatatgtgggtaattactgaaatgctctttgtatgattaaaattaggaattgagctccgaaaaatccgagaatattgcagagagtataattaatcatggagaatttaatacaaattaaatccatccatgctttaaattaaggaaattttatttcccatatttaagttcacttgtaaattaatgaacgtttaatataaattctaataataatttattaaataatttataaatcccgaaacaaaaatcaggatgtgacaaccggccctatgtggccggtcagaccgctgcacctggatagtcaaaccacgcatatagcgtcggtcagactgccaggccccctggcggctgtgcacagcccttgcacaagccgacaacccccacacaataaaattcaataaaaaaattgatttttggagcaatttttgaaatgtgtgagtttaaatattgctaaccacccataatatttgaagattatgatgatttgcaacaaaactcacttaagtgctaggaggtgaccttttatggtctatacgggtttttgggcgaatttgattttcaaataacttttaaatgatttggtttttgaaataggtttgaataccaaaaacatttcaaaacttcttatctaccaactttgttttgaaacttttctcaaattccttctcaatctcattttggggataattctcattttggccaaaactaagaatctagtttcttcaaaagagggccaaaatgacattttcattcagaaatcatttttcttgcaatgtgaggcttagaaaacatataggaaaccttttgaaacattttccaagagatagttttcaaattacattgattttgcaaaagttttgacttatgttgacttaggcattttgaaaatactactagcaccactagttgatttgctcacatataaagggaagtagagcacatgcaagagtgcaaaactcccccttaatgtgacatgctccattttcgcaatgaagaaccaaatggcaacaaatccaaagcataagagcaaatgagagcaaatatacataaagcaaatgagagcaaatatacataatgcaaaaagaagcaaccatggtgcaccatctcaagccacattagagaaatatatgacatttaactcattcctcaacttgcaaaagcgggttttatcaagagacttagtaaatacgtcggctagttgatcctcggttcttatgtggctaatgactatgtcacacttggcaacatggtctcttaggaagtgatggcgtatgtcagtatgcttggttctagaatgttggaccgggttattggctatttttatggcactatcattgtcacataggagtggggttttggtgaaggatatgctatagtccacaatgtttgtttcatccaaagcaattgggcacaacaactacccgccgaaacatattccgccttggcggtagagagggctacagagttttgtttcttggatgaccatgacacaagggatctaccaagcatttggcaactaccggatgtgctctttctatccactttgcaaccggcataatccgaatcggaatagccaacaaggttaaacttagtaccttttgggtaccacaagccaatagtagaggaatgctttaaatatcttagaatccttttcacggccactaagtgacactccttaggagcggcttgaaaccatgcacacatgcaaacactaaacatgatatccggcctagatgcggtaaggtaaagcaagctaccaatcatggaacgataaagctttaaatctaccggtttacctccctcatcaaggtcaagatgcccgttggttgccataggtgtcttgatgggcttcgcatcctccaagccaaacctcttgagtagatccttgatgaacttggtttggctcacgaacgtcccattcttgagttgcttgatttgaagtccaaggaagaagctcaactctccaatcatggacatctcaaattccctaaacatcatatcaccaaattccttgcaaaatacctcattagtagaaccgaatatgatgtcatcaacataaatttgacacaaaaagaaatcatcaccaatgatttttgtgaaaagggtggtgtcaacttttccaattttgaaatcctttgacaaaagaaaatctctcaatctttcataccaagccctaggagcttgttttaaaccataaagaacttttgagagtttataaacatggttaggatttttaggatcttcaaaaccgggaggttgttaaacaaagacaagttcggcaatttcaccatttagaaaagcacttttcacatccatttgaaatagttttatatcaaagcatgatgcaaatgtaagaaggatgcgaatagcctcaagtcttgccacaggggcaaaagtttcaccaaagtccaaaccttcaattgtgtgaaaccttgtgccaccaaccttgctttgtttctcaccaccaacccgttctcatcttgtttgatcctaaagacccactttgtcccaatgacattgtggtctctaggtctatcaaccaaagtccacacct

SEQ ID NO: 55968 - DNA, 5295 bp, Oryza sativa
  unsure (1)..(5295): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttagtagataaatttccttaaccgaatatagcaagaatccgacaactaacgacttgacaactctcatcggctaatctcaggacttcgaagccgatgctgactctaagccgatgactactccgggcttaccaaatttcactattaacacatgccctccacttttgaagtatgagaactcatgcttcaaaattatcttctttctctatcttgtaatcggctttcatgagccgatactgatgtactccaccatgctgaaactgatatgcttgccccccgagccaatattgttgttcctccattaaattcaccaccgtgaccatgatcttggaattgacttcttcttcagacatgtggatataaaattcgtggtcccaccaggcgtgctaatttgtgttgacgaaaaaatcgaacacactggcctgggagatctgcttagttcctgtgcaggtccaaatcttgatgagatgcgggcgtgccagtcagtttgatcctgcaactgacaagatatgcaaatagtagatcaaaacagccgattggctgacaagccgatggagtagttccggtcgatagccgataatagccgataccgataccagccgatagcgatagggtttaagtaatcggctatatgtccaatgtagataatgatataaaggcaatcggctgatgatgatgtaataaaataacaatataatctagtataaaccaatcgacaaataatgatatgataaataagcatcgatccgaaggttaaagcacacatcggctggaggtccgatgtcatgaaatccacaagattagattaaatagtgaaacttttgttgtcatcggctaaatccaacttatatgtatagcaatccttatgagccgatgcaacgtctagataactcaccggctgaaaccccaataaaacccttattggcaatcaagaagcaggctagagattatggttctaagcacgacttagtagatcaaacttaactgatgcagcactaagtatgaaaaaaaaacacaatatctagacaatcaagccgttgactgagttttcagggtgatagatgtctaagctaatctaatctagcaacgcgatttagccgataccggcagaaaccctaaaacgagaagcagccgatagagctaaattgatatgctaagactagattaacagagacatatgataaataggtaggcaaatatatcatccaaaccagagcaatccaagaggtcgaatgtactgttgcagccttgaacgacgccgacgtagacgatacaattgcctgggccggcgaaacattggacttatcccttcgccaaagatcgaagacgatgcagccccgcgtcaggtgccaagttccgccggaacgtaaaaacaaaagtggaagtgaaaagggtggcgatgcgccgaattgtattgatcgtgaagatagtttacaatgaccccaggtgtacatatttatacccatgggtagataatagtccttataggacaagaaagaaactttcctaaagataaaaggaaaacataaagtccttataggacactaaacacactttcctaaagataaaaagaaaactaacaaactattcctaattaatagatacaactgccttcttcggactcgatccatacatggcaatcatcatgaagcacatcaacttaatccgacaatgattccaatatcaccttgccggaatcggctacatcggcttgccttgtccgattcggtaactgctgatgcacactgtagccgatgcggttccgaagccgattcataccctgtttccgttatcgatttccttccaaatccgcttcggccttaactccaaatccgatgtaaatttaccaactttcgttgttaacactaccggagacactaaggttttttgttttttctagacaccagagacatgtttacggagtgacgcattttcttatgattaattaaatatttattattgttttaaaaaatagattagtataatttttaaagcaacttttgtattgaaaccttttaaaaaaacacaccgtttagcaatttaaaaaacatgcacacgagacacaaggcagatgagttgggaaatgtggaggaagaacacagcctaagagtaagtttaatagtatagccaactactaactccaaatcatatatagttaatttagtagctaatttatacaatagttacctatagatatatactacacaattcaaacttggtcccacacctgtcatatcttggagtccgtgctgtagctggctacaaatctacaacccgatgctatttctctcttctctggtatcttctcaaaatgtgttcaaggccggtcctaacatttcggaggcccagagcgaaataaaaatagaggccctcaatgggtataatatgtagaatatttttttcttaacgattgtagagctaatatatcttctaaatagaacatacaaatgcaatacacgctctacacacatacgcctgatagataaagatcataagaccctaaatcacatatctaacagagtaaggagaaagcatagataagaggtgtcctactaaacctgaataattgcatcctctaggttaggatgagttactttggcctagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgaggcccacgggccgttcggggcacggcggcccgtgaagcacagtgtttttttttttttaaaaaaggaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaacttacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttctacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgct

SEQ ID NO: 55969 - DNA, 2459 bp, Oryza sativa
agcacaagatgaggagtgtgggatgaggagaaatggctggggttcatgccctatttatagggcgaaatttgagattttttggaattttttcgaattttttatgaattttttagcctcccaacggttattttcaaatttgaacggtcaaatagccgttagtgccacgtgtcgccttcccgttggaccgccgcccgccctgtcagtctgtcacgcgccgccggcgcttttcggcctgacgggccgtgccgggccgtgccgtgcgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctatactttggccccactcccaccatcataaaataaaccagcccaaattacgattacgatgacactacgctacgctaggtaagcttatacttattaaattattgtaattattgtagagacaacattgcaaacacaatccaatttcctattaatagttccacgactttgagaaaattgtgacagtatcaagtaattcatgctagcatttttataagaaaatgcagtgataactataattgtacgtatcaacatgtatcagtgatcgatcctgtatttagtggtggttatattaaataccatcaataatcatctcaataaagaagagagaggagaaaatgtgtggaacggtgaataaataatccagtgttaggattaatcaagactgatcgaggcccttatcacggcggggcccagggccaccgcaccactcgccctaccccagggctagcgcaaaccgaactcgagccaagcacccgaaaccgaattcgagccgcgctgcggatccatcacaaagcccatctacccaaaaacccaatcatatagcccacgcgcgggcttggcggcttgcccccgtttgcgaaacccgatcaacccccaccgtcgcatccagatcgtacggcccaaacgcaccaactcgaaaatcccctcctcttcctccctccctccggccctcccgagccctaaccctagctctctctccccatcaccaccggcggccatggcgctcgccatccgcgccgccgccgccgccgccggcgacatggcgccgtcatccgcctccgacccgaccctcgggttcctcaccaagcgggacacggaggtgaagctgccccgggcgacgcgcgtgaagaacaagaccccggcctcggtccagatcaccgcggagcagatcctgcgcgaggcccggagcggcaggagcccgaggtccgtccccccaagcagaagatcgccgactccgtcgagctctccgagtaccgcctccgccgccgcaaggagttcgaggacgccatccgccgcgcccggtggaacgtcggcgcgtgggtcaagtacgccaggtgggaggagcggcagggggacttcgcccgcgcgcgctccgtctacgagcgcgccctcgacgtcgcccaccgcgaccacacgctctggcgtggcgtggatatgccgagttcgagatgcggaatcggcatatgaaccgaatgtaatgtgtgtgatcgcgccgtctccctcctgccctgggtggaccaggaccagctctggtacaagtacatccatatggagcaagtgcttggagccgtcgccaacgcccgcaaggtgtttgagctgtggatggcatggcgtcctgacgcagctggttggaactcgtacatcaaatttgagctaagatacggtgaaattgagcgtgtgcgggccatctttgagcgttttgtggccgaacacccgcagccacatacattcatcctgtacgcaaagtttgagatgaagcgcggagaggtggagcgggcacgacgggtgtacgagcgtgcagcagacctgctggcagatgatgagcatgctgaggttttgtttgtagcctttgctgagtttgaggaaaggtgccgggaggtcgagcgcgcccgtgcagtgtacaagtatgcacttgacagggtgcccaaaggccaggctgaagagctgtacaggaagttccttgcctttgaaaaacagtttggtgaccgtgaaggaattgaggacgccattgtgggtaagaggagattccagtatgaggacgaggtgaggaaaaaccccctcaattatgattcatggtttgattacattaggcttgaggagagtgttgggaacaaggacaggatcagggaggtgtatgagagagccattgctaatatcccacctgcagaggagaagcgttactggcaacgatacatttatctatggataaattatgctttgtatgaggagcttgatgcaaaggacatggaacggaccagggaagtttacagcgagtgt

SEQ ID NO: 55970 - DNA, 2284 bp, Oryza sativa
ctttagcctttagttcctaaatcagttgaatttcatattctagtgatttgttgaattgacattgtctgagacaacacccgcacataaaaaaaacttgcttccttgtgctttcggaattgctgtggtacctaagcattccaacattcatattttataatgtttgaccatccatattccatagtccaacaatatatgtatttataatttaaaggtaccattatattcattgttgaaaatattttgattttcagtttatttatcaatacagaagttaatgagccatgcattgtaaacatcactagtaaatattttgattttcagtttatttatcattctaaggaaaaaagatgtccagaatacagaacattttgaaaatttgggccttttaggaagttttttaaatagttaggtcctattatgattgacagattctctcattaatttcactagaataattaattactgcagaaactgttataaaattatttatacaaaactgttgtacagcatcaatccttgttacaatatttgagaattcagacagccataaagtagtgatcttagaaaatctatagaccaccttaaaattttagtcagccaagagtaccttaaaatatgaaattccttttgtttgtttgctatgtatattcttaatcatttccttttttgtatcttacaggaatacttgcagtttgaaattgataaaaatgaattccacagaacttgtgaactctacgagagattgcttgatagaacaaaggatttgaaggtatggattagctatgctgagttttgaggcctcagttggtttgggtggggaagacagtcaaagtgaggagattaaaaatgaagttagttatcaacaacagcagatagagcaggttcgaaggtgccgaggtaaacagaatttggagaacaaatttactttgtccagttgagtacctctgttccttttgtcattcatagtgcaataaatctaacctcttctttattgcaattttcagctgtatttgaacgggcatttgaatacttcagaactagtgctccagagttaaaggaggaaagagcaatgctccttgaagaatggcttaataaggaggtgagctttggtcatctcggtgatgttaccttagtgcagaaaaaggcaccaaggaaagtgaagagaaagagaccagatccttcagaggatggctccactactgcgtatgtgccttactcaattatttcattcttctatagtttctctaacaagtttcattttactctgtgctatctgcccttaaaaggaggttaagaaatttggtataacaaaaggagacaataaatagttttgactcctaatctgttcgcatagcttgttttccatttaggctgcctgcaatttagggaacaaatgtgctgataaaacattttcctaaaccttagtaggtatgaggagtacatggattatattttccctgatgaggttgcgctggcaccaaacctcaagatcctcgaagcggcctataagtggaagaagcagaagacagatgatactgatgatgactgatataaacagcaaaggctgccttgatgccactgtttctgtggtcagagatgagctgatccttgtcaaaatcagatctgaaggacttccacaatgctgggtaaagttgtgaatgtgccctgccttattgctcaacttgtacaatattatgtggtttgtggccccggcattgatgaattgagtcatctgtcatgctcatactctttcattttagttttgatatgcacgatcatgtcgcttgccttaatatcttttacatctagggaggcaactatgtagcagtcatattttcctaggaatggtgcatgttgtgtatggaatctgtaaggtgctgtacataccagtccgatggattttgtgaaaacttatgtcacactggtgatatccaattttggtgaacaagataagtgaattgagggcaactcgtgcagtcacaggtgtgtcatgtctcttatttttagagttctgaagtggagctcctcgtgactcgtcgacagcaagatgggctcagatctcgttctctgcgggaataagttcacattaggtccctctatatgtcgcccagtccggctttcatcccagcaaaaccgggtatgactccgtgcaaaaaaaaggtcgctcggcagtattgtgcctggttttggatgacgtgacgcctacgtggctccctttgactaggtcctcgtccaacgtggcgcttatgtgacaaatgagtcctggaaaaaaaagggatccact

SEQ ID NO: 55971 - DNA, 1642 bp, Oryza sativa
tacacgagaagaaatagcacaaacatacgtatcccacaggttgaatacaggaacacgagagcgctagccaggccgttcccgctgaacgggcgagcggaaccgcgatggtcctacgggccgaaactgtgaaactgtgacagtcccgcggctcaaaaacgcagcaccaatgcagtcctgcggttccattgcgcggaaccagctctgtgaacagtagtaaacagagttaaacaataactaaataaacaatgttttgaacggtattaaaaactcatgcgtgcttagatgccggtgccgcaccaccggcaccgcaagtggtgccgtgcgaccaatctgcaggaccacgtcggtcccgcggcaccgcccctcctgtccgttccgtgccttcgagctgcactgatggcacggtgccgtgttcctgtaccgcggaaaatgtatatttctgtaaatgcatgtatatatacaaaatagagaaaaataatgtatactttaaaatttaattgccggctgtgatgttctatcactaattgttttggctctgacgttgcagatatgatgaggttgcaatgttagtaggatgtggatgggtaaagttaggagcatctcttagttgcagaggagattccaaatcaagcgcccaattcctccaaacgaatcggacgatcaaatgtttcagtaaaaataaacaacaattaaaacttttaaatcttgtgaaccccctcccgtgtcgacggttccttcaccgccgtcggccgccgctcccttctctacccgctctcccgctccccctaccaccacttcccccgccgccaccgcctccatccaactgccgcacgtcgttcatctcaagttgccatatgttcatctggactctgaaagctggccttggtctgcttcattttggtgttgttgtgtctccatccggagaccagagcccgcactcactgctagttgccatccccaacctgccccaatatttctccaggttttgttgctagctctcgatctgtacacgctgtgggataattgcttgttgacaagtaagatcaaatcctgatggtggaagaatggcaccccattttgtttttgtatcagggctgcatagagtataaaagctttgtccccctatgcttgcactcagagactcttccattgctgtcatcgcatatggtgttgcaacttgcaagtaacactgtcatctcaatgtgcttgcacgggtagcatacatattctcactaactgctcttacactaacaaggatgaatcagactagcagagagagagtgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttgggaaaaatcaacatatgcccctagaggcacccggaccccccttatatatggggaggagtccgtgttacaaaagataatctatatccctaacggaatatgcagatacagataaaatacagtcgtaaccgactaagtcccagggtatttccttgatgcacaagttgagaaacaaacccgagatacacataaa

SEQ ID NO: 55972 - DNA, 2126 bp, Oryza sativa
ctttgcagtcaaccatcatagcctgctcaaagataataatccgagtgcttcaaacttttcatgccaaggcctgccgagtagtgaagacgaagactgtaaagggcgaaaagataaagaatatggtgcatcgaatagatgcacctaattaggtatagcccccaactatgtgattagtcaacaaactaaacatatagttgagaacaaaataatagcataattatgcatcatatgacaaaagcatacgcggcgcctaaagaggcattccagccgactgcttttcagccataataaaagaaatccgagtggttaacactctaaaaagttcacgaatgaacacacttgacaggcatccgaatataagactctaaagattacccaccaaatattataaaaatcatggtaatgaataagtctaatagcctaggctatgactatttaccataatgaaaacaggcatataacataccgaggaaatgactatgataaaaacaagtcattccaagttaacccagacagcttttgtagcctaaaaaagcgtacaaaaacagcataacgcctttctgtcgggcaccttttaatttgcatcgcaataattccaaagaattatatgaccgcgtaaaaaggattttatcagcattgggcaacactattgtgtacataaattgccaaagcaaagaatgcctaagtccctaaggaacacaatgggccacgctgttaaaagtattgggctgaggtactgttcaggcctaggcccattcgcacctccgatacccttaacaagaaaacccgagatccaaacgacgcttcgtcttccccgccggaactctcgccattttccccactccttgctacagtacagagctgggccggcaaactagggttcaccattccactcaaatccaccttcaaaaagtgatcaaaatccttcccgtgatccaccgcctcaattcctcacctctcccaagccatccctcgaatcaaatcagcgcattcggggaaaatcgatggcggaagagaaagaaagcttcgaaggccaatgggcgccgtccgacgtgacggaggagaacctgaaggagatggtggcgcacggcgttctccctgccaaggagatcatcgggtggcggccagcgtgcggtgaggcttttccgacccccgatacacacgaggtcgtggtcttctctcatttcttttatggtggatttgctcttccaacctcaaagttcttccgtgggatactgaatttctatggaatcagcgtacatcatttgaatccgaactccatagtccatattgcaaatttcgtccatgtctgtgaagcttttttgggcattagacctcattttgctctgttccgccgaatctttttccttaagcctcaaccgaacaaaaacaaaccatgcgtagttggtggggctggatttcaactgaggggcactctgagccagaagtatttctctatgcctttcaagacttcaaacaaaggatggcacgccaactggttttatattcaaaatcccgagcccgctcttcctgagtactcctgtcttcccccagtataccaagatacctggaactctcttcccatgggagatgaagccgcccaagccttagaactgatggaacgcatgctgaagctcaaagagcaaggcttacagggagagcaaatcactcggcatttcattaagtgtcgattatctccaatcaaagagagatcccgcacagcatttgagtttgacggcaagcatgatccaaaccgtgaagacccagactctctggactttaaaatcatgaaggagagaatgtataaaatcttctcaaatgctattgtcgtcagctactcacatcagctgccagttgtaccatataatgcattcaatccgcctccgcaggtatgtatctgaaaccttcaactcatgaccaaaacataattttatcttcatgttgagtgagctaaccgtggaagcatctcattcaggagtacgtattgatgaaatctgatcccccaattgctcaacgccgatctcctcgccagcacaccgttcagggaagtggagggccgacaatcaggtcagacccgcaacctcaaacctccaaaccggctgggcagacaggttctcgcaagagaa

SEQ ID NO: 55973 - DNA, 10523 bp, Oryza sativa
ccaaagatcagaacatcttccaggtataaacctctcggtaccattttattccggcatgcttctctcatagaaattacgctgaatattgaaaggacactttgcaggaaaccgtccgatatagatccaactggaaaagatcctgatccggctgccacagagtcaaatttatccaaagatgctgagccgactgccgaaagccagccgactgccgaaagtcagccgactggtgcccatgcttcggatgacaaggccaatccgagtgaccagccgccgactggaaaccagtcggcagctactgaaactgcaacaacccaagagcccccgactggaaaccagtcggatgtaggtctaaatcaagagattcctgaagctgaagcgcaggcgacaacttctcaaggaccagaggctggtaatgactcagtgattgggtctccggataaagagcagggatcacctcacgctcagctaggcacatcctcaggtaactcatcttctcaagtgatgccgttctgaataactccagcttactcgtctaatgtcttgggaatacatcaggtccactaggcggcgacgaagaagaaattctccgcataaaggcagctgatgactctcgtcctcctatcttactcaaatggtgggacgagaactctcaagtttccggcattgtcataaatcgccaaaaagaagatgaggaagtgtgccagctgaagaaagtacttggagaagctactcgcattgtgaatgtaagtcttctaggtgactgcctttgatgactttgttttctcgttagcaaaactaatccatgaaccaccgtgcagagaatccatcttcgcaatgaggccaagaccacaaccttagaaaagctggttcctcatttgggaactcttgaagctgttaggagccagctacacgaggccaaggagcatgccaagaaaacggagaaggaattaagggaacgaattgctcagctccaggattcaaactacgagctgagtggttcatcaaaaggtaatctctagatctgtcccatttatgctgtcataactggatcctcaaacattcggatttcaaacagcgcaagccaccaggatggctcaaatggagaagcaaattgaagctttgagaaaagacaaagcagaactagctgcagaaagggactcggccttgaaggaggttgaaggtactgccagctgacaatctgaactttcctctttttaatgtagcagattcttattgtaaatgtgttttgtagaccgtaaaatcaaatctcaagctcagtttgacgtcctggttgataaaatcaagaggcttaaaggagcaagagatgaagttgccaatgtcgctacaccacttgtccaagctatgttcctcaataacagtggtccgagtgcacttgacgcaaccgaaatctttgacaagctgagagttgcaccggatgtatatttcaagaacatcaagaaagctggaagtatgggagctagcatggcattggcgatgaccaaatccttgtacccgagaattgaaatcgacaccattgatggatttgcagacgggacaagcgaagaggctgctcttgatcttatcagcaatgctcaaaatgcggctgataagattgcaagtgacgttgtagagcaattccgcaacaacgaccttcagccgagcaacaataactctgatgatgaaaggactgactctgactgagtatgaatgtaacaaatggaggctcaatttgtacaatactggtgtatttatgctgtgcttgatagttctagccaaatctttgatttcttaaaagcttttatcaagctttgttgagcctaaaacccaaagaagctataaaaaactttcagtcctcgcagactaagtagaaaaatcgaacaaggcaatgataaaccaagtaagcaaattgaattgataaaaaatcacactccattattataataatagcccccgactgacaacttcaagaagaaaacttgatgttgacagtcaagatagggaagtacaatgataaacttaagcgtagaaacgacgaagatgttcaatgttccaagagttgtcgacgagagtaccatcttctcgcttgagtcgataggaacctggccgggtgacttcagagatgataaatggcccctcccataaaggagataacttgtgccgatcccgtgtagtttgaattttcctcaaaaccaggtcgccgactaaaaaggcacgggatcgaacattgcgattatgataacgccgcaacccttgtaagtatcgagccgaccgaatcaaagctgcttcacggacttcttccaatcggtgcaagtcatccactcggtcctcttcgtagcgttcttcacggaaatttcgaaagcgcaaagattcgaattcaacttcactcggcaacattgcttctgccccgtagacaaggaaaaaaggtgactggcctgtggcccgactgggtgtagttcgcaaagaccaaagcaccgatggcagctgttgcacccatttgccggcatagggttttagccggtcaaagacacgcgctttaatcccttgaagtatcatgccattggctcgctccacctgtccattgctcatggggtgtgccaccgaggcatagcaaatcttaattccaaagtcttcacaaaagtctttaaaaactccgccagtgaattgtgtgccattatcagtgatgatccgattgggcactccaaatctatgcacaatgttgatgaagaagtctcgagcattatctgctgtgattgtgacaaccggtttagcttcaatccacttggaaaatttatcaatggccacaaagagatgcgtgtaaccgccgactgcctttttaaacgggccaaccatgtcgagcccccaaaccgcaaacggccaagacagcgggatagtttgcaactcttgagctggtaaatgaatttgtctggcgaaaaattggcaaccttcgcacgtgcgcacaattttgtcggcgtcggacactgcagtaggccaaaaaaaaccctgccggtaagctttgccgacaatggtgcgtgcagcagcatggtttccgcatatcccagaatgtatgtctttcagcaattgtctcccttcctctaaagatacgcaacgttgcagaactcctgaagggcttttcttgtataactcagcttcatgcataacataaagtttgctccgccttgaaatccgctcggcttcatctttgtcttgagggagttcttgagaagtcaaaaatcgtatgaggggctctcgccagtcggcttcaatcatagctacgtcatgagtgcccgcaatttgagcagtatctttgtgaggtaccgtcggcgtataaaggtgttcgacgaaaacatcggaaggcgccacctcgcgcttggatccaaagttggcaagtctgtcggcggcttcattattgtgtcgaagaacatgacttagttcgagtccatcgaacttgtcttccaatttgcgtacctcttgtcgatatgccatcatattgtcatcaaggcaggaccactctttcataacctggttgactaccagctgtgaatcgcctctaactattagacgctttatccctagggaaattgcaatccgcagcccatgaaggagggcctcatactcggcgacgttgtgggacgccgaaaaatgtatccaaagtacatagcttaatctttctccagttggtgaaattagaaccactcctgctccagtgcccgaaagtctttttgacccgtcaaaatgcatggtccagtgctccatcttctccgcgggggtatcctcttggcactcggtccattcggcgacaaaatcagctaacgcttgggacttgattgaaattcggggcttgaatgatatgtccaaagacatcaactccaaagcccactttgcaatccgtccgtttgcttcgcggttgtgcagtatatcaccgagtggaaatgatgtgaccaccgttaccgggtgaccttgaaagtagtgagatagcttcctggtagtgattaaaataccatataacagcttctgaacctgagggtacctcgttttggagtcggctaggacctcgctgacaaaataaatcggtcgctggactttctggacatggccttcttcctcacgctcaacgaccaagacagtgctcacaacctgggaggtggctgatacatacagcaacaacggctcctgcaggtgtggtgaggctaggaccggtggctcggtgaggagtttcttgaaatcttcgaaggccttctgtgcttcaggtccccactggaaatcatctgttttctttagtagcttaaagaagggcatcccccgttcgccaagtcttgaaacaaatcggctgagcgccgccatgcatccagtcagcttctgaacatctttctgggtacttggcggtttcatgttgaggatagcagtaactttctccgggttggcttggatgcctctatgagacaccataaaaccaagcagcttccctgacggtactccgaatgtgcacttttcagggtttaatttcatcctgaaagcacggatgctcgcgaaggtttcttccagatccgagatcaaatcatccttttgcttggtcttgacgactacatcatccacataagcttcaacgttacggccaatctgcgttgagaagcatctctggatcatacgttgataagttgctcctgcgtttttcagtccaaatggcatggtgacgtagcagtatgccccgaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaggatttgttgaggtcagtgtaatcaacacacatgcgccattgccctgttttcttccgaactagaactgggtttgctagccagtcgggatgaaggacttctttaatgaagcctgctgctaacagcttggttaattcctccttgatcgcgtccttcctgtcttgtgcgaatcggcggagtcgttgtttgataggcttggcgtcttctttgacatgtaatgagtgctcaatcacctctctaggaataccgggcatatcagatggtttccacgcaaagatatctttattgttctgaagaaaggtgatgagcgcactttcctatttacaatctaactcggcgcctattacagcagttttagcaggatcagagggatctaggggaatcttcttagtcttagcttcgctttctccacttttagaagtcttggtagcaggtatttctccttcgctcgccgtggctgcagccagtcggatatcctctcgggcagacgccatctcgcgggtttgggccatgtcgcaactctccttgtcgcatgtgacagcttgcttgatgtcactccgtagggataggactcctcggggaccaggcatcttcatcatcatgtaagtgtagtgcgggacggccatgaacttggctaatgccgggcgtccgagtatggcatggtatgctgtctcgaaatcggcgacttcaaagctgatattctctgtgcgaaagttttcccgagtgccaaaagtgaccgggagggtgatctggccgagtggagttgcggataatcctggaattacgccgtgaaaaggcgcattgcttggttttaactcggagcgaggaatctgcatatcatccaaggtcttggcgaaaaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacggcattgatctcccgttcggtcaacttttgcttccgtttagactcataagccagggggccgccgaagatatggttgagctccttgcggtggtcttgaaaacctgccggggtgtcgccgtcgtccttcttcctcgacgtgctttgttcttcatcggagttcttccgtgtagtcttggtgtattgatccgcgaactgcttgtagacgaaacaatctttggccacgtggttggagttaggatggtgcgggcattgggagttcatgatcttgtcaaacgtgttgacgcgcgaatgctgtcgagaagagtgactggcggttgcaacaagttccgcaggcttacgcttgcggtccttatgattgttacttccacctcctcccgaagccggcgtatccttttttggcttccaactgggacccgactgctttgacgcggtgacggcgtcttcagctttggcgtactcgttggctttttcaaacatgagcttgactgtcctgggaggcttacgcccgaatttgccaaccaattcttcgtggcgaatccctttggtgaatgcggcgatgatgacgtcgtcggtgatgtcggagatcttgttacgctgttcagaaaatcgccggatgtaatctcgaagggattctccggacttctgaatgacgttgtagaggtcgtattgtgtgccgggacgctcgaaggtgccttgaaagttggcgatgaagtggtcacgtaactcggcccaagatccgattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccatcatacttctctattccagtcggcttgaagccggctggccaatccactcgacgcaggtcgtcggtgaaggctgctactccgtcaaggtcgtcgtcgtggcggtccggcgagtgatgatagcctcgagctgctcggcgctgtatgattgtgtcgcgaagatcgacggggcggcgacgaggtggtgagcgaggccgttccactcggcgctccctatggtgatcgggaggtgagtgaacagaccgctcgtcgtggcccctgctcctgcgattggatcctgcgccggtgatgctgaggcttggatgacggtagtcatgagatcggaagtgggggactcggctgccagtcggcgtatggacgctttcggagttaactgggaccgaagccgcaatcatagtcttcgtctggttcaagatgttgacgacgtgatcggattgattgagctcgttttccctgagtagggtgtcgaggagggtgatcgcggcaaccgcattctgttgaggggtgcgaaaaaccggcgtcccttcaacatcttgctggccgatgagatcacgcgcccggcgccctgcttccaaagctcgctgccgtcgatcctcagcctccttcgcggtccgctcacgctcctgctgctcatgccgtaaccgttcttgttcttgtgcttgatgctcctcttccagtcggcggcgctcagtctcgcgacgcgcttcggtctcccgggcttggcgttgctcctccgtctcgttattggccatgaagacgccaaagtagagaggggtgtagttgtcatctaggcttccgtcgaagtcgtcgagatccgggtcgtggtagcgagagctaaactcgtcgtactccacgatgtcggtggggcgcgagtcgacggtgggagagctgtagtcgccatctagctgatccgtctaaaccgtgccgagtggttggaggatgacgccaacttccctgaagctaggcgaaatcggtattgaagccgacttccgcctaggcctacgggaaagagacgctgtcgtgatggagacggccgtcaaatcgtcggggagcttcatcaggatcggtgggtaagccccatcatcttgatctggtgacgttggtgaaggtgcgatctcgcccgagtggtttgaagccgactcggtcgagatggtcttgaagtaactttcagccgcgtttgggagtccaaacggggccgaaatctggttctctcccgactggtccgactccgagtcaaggagagagatcttgccgaagttgctggtgacgaagtcgaggctgccgaaccgaaacgtctgcccgggtgggaagacgaggtcgtcgatgccggagatggaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttgggaaaatcaacatatgcccctagaggcacccggaccccccttatatatggggaggagtccgtgttacaaaagataatctatatccctaacggaatatgcagatacagataaaatacagtcgtaaccgactaagtcccagggtatttccttgatgcacaagttgagaaacaaacccgagatacacataaaatattctatctatattcggtatcctatattcagcccaaatatcatcgccgtgtagatatgggatatccataatctccacagagagagagagagtttccaagcaaatttgatggcacatatccacgaattgtgattttcaatagtttgcattataaacgcttcatcttgtcctgcctccttttttccttaaatttatttacatggtgtgggaggcagtatttcctaaacacttataagtaggactcactaaattgaagaaaaaacaagtagctctaccttgcttatgatggtccttcatattgcagcacatcttccatgggtctgtagcagctcatcctgctcaaggttgactatgagttttggtcagtgaaggggatacaattagtaatggaattagaacacaggtaacactcgagttaattagtgttttgcttgcagtttcaatgcttacactacaatttcattctctgcaattacattcacattttaagctttggttttcttctctactcccaatcaccgaacttgtttttttaatgaaaacacaacttggtatttgcaagttttctatctgttttttgcaacaggaaaactgttacatgttctagacaaaaatatcatttttaagaactgtaacaactaacaagcttatggatgaactttgacaggttccttgacgaaatttgaagatgtaacctgccacccatgattcgcagccatcgcccgttatggacttgccaagtttctggtggtgcccattgttgatgaaattactgattgcctgaagtactcaagtttcatgagtataacaaagattacagcttgggtatctgtaaagtggttatgttgagataaaaggacaataatgtgagatttctgtttacatctcaaatgttccctttaatttttttatgctactttctaacttcgcctttcagtttaaatttcataatatgcattgtttcttatatccaggattgaatcttctagcctctacaaaactgaattgaggttctgcatatttctccaaaataaaacaagtatgaatgtgctaggcttgcttgtttgattcatgcattataaatcttttcattgagaatactagcatttaaagtcaaggatatatgtgaaaatctcagtagcgtttgattaaatttacattttatgcaaataacaaccaacttgacatcaccttctccaagcatgagggaatgacgtagttttacgtgcaacctgcatctatacgattgatcccttgtggtgatactatgcctgtccatcactacagtttttctctagttctgttacaacttaaaacaagctgtattgttctatgtgatatgattctcttcttgtgcttattcactgttgccctgctagaagcaatttctatgcttactggttacttgatattggaattaggaataagtccacttggactccctcggatatatgtataatctgatttgtatctctcaaccgtaataccggatatcttaacccctcaactatgaaaaccagcgcaatttaactcccttggttgttaaacgaggaatttaacgcggtcgacgaggccggtgccaatgccatgtcccccgctctcatctcctctgctccatcgcatgaaaggacgctcagaggacgagggagtggggcggtgggcagcaacacgatgaagcagaggggtggcggggagatctctagctccccaatgccttcgccggccaggccacaccaaccccgtcgcgtcaccgccgccaatgaactccatcatcaatcaggggatcatcctcaacgccgtcgctagagggcgggcctacccgctatcggtgccatccttcgggtccccaggtcatcaccaacacgccgccgtaaagatcccgcctcgacctcaccttaggcacgacaccaccctggatccagcccctacgataggccgacgctttctcgtgagctcgcagcattcctctcccttcactgctgccgc

SEQ ID NO: 55974 - DNA, 23020 bp, Oryza sativa
  unsure (1)..(23020): unsure at all n locations
ccatcgggcagcctgtccctttgtgtccaccgtcgcagtagccacaagcgacgccctcgctgtcggaccctcgccgccgaacgccgccgtcaccgaggcggaaggggttgagaaccctcggccttcacccgcgccgcactcttgtccttgtcattgtcccaacggctgtgatgtcagctaccatgcaccaagtaaaagaaaggaggagagagagggatagaggttattagagggaggggatggacatgtggggccaactttttttttaatttagttgatgactgggctgccacatagacatcacgtcagcgaaaatcactcttaaaacagccaagagagtctttttacatagtttttatatttttttttgggggggtggttgtcaaatctgtttatacgatttagggatacgaattagattcaacatatattaaggaagtgaaattggactttttccctcgaattatatacacatgtttgtctcaagtcgtgtagatgcccacatgtacaaaacagcccatttataaaggcccacagagaaagcacacaaagctagcccaaacaaaagccccaaatcatgatccattaacccgttagcaaatgtgataggcctactagatgatgcactagccagttagcaaaataggaataaatctattttgcctctccaacttatttctttggttgaatcgcatcccttaaccacaaaatcgggtataacccgtcccccaacccctaaaactattgcaaattgactccttggatggtttcggaagtggttttgtcccacgtggcatctttgaccctgttgactagctgagtcagcttgtggaacccactgccagtgctcaccgtcgtcgcacgcgttccccacgcgttgccttcgccgcctctaccgcatcgcctacaatccaccaccatcgtgtttccccctccaatccgccaccactgtcgccagccgatgccccctcctcccccatcgccgtcgcccatggggagaggagtcgtcggccgaccgcaaattggggagagaactcgccggtcagcctcgcacggggaggatctcgccaggaggccgcacaccgagcgaggagctcaccggcctaccgtccacaggaggaggagctcaacgggaaaccgcgcgtgggggaggagctcgccgggaagctatgcgcgggggagaatcaaccggcggacaacacacggggagaggagcttgtcggctgctactgttgctgcttccacacggccacaggcgcctcctgctgcttggaccgctgccgccgccgcaacctcctatcccgctgtagcagccacatgctacttccacttcgactccgttgcagcagcctcctctctcacgccgccgcagtcgctgcctacagctgttgctgcttccacgatgccaccgccgccatctccgcaacctactctccttccctccctcgtcgtcgccgccaccctctcataccaccgcagccctcacggcctctgttgttgctggaatgtgtgtgtgagagagaggataaatgaagattaattaaagggaagagagatgggaggtgaaaaaaatggtgatatgaggtggaagtcgctgacatgtgggtcccactcccacctgccaactcagtcagtcaaccgtggtctagcagccatgtcagcagcaatcgcttgccaaatgctgaaggagtaagttgcactagtttttgaggatgagggatgcgtatacccagttttgtgggtgagggaggtgattcaatcgaaagaagagatgagggaggtaaaatagacttattctagcaaaataggactggaaattttgaaactttcagtcctgggcctgttacatgatccaataatccattacaaaatgtaactgatttttttttcttgcataattacatgcatgtctcctatattgattgcattagaatctaatggattttctttttcctcttctgttttaaaatagacactaaacaatgcagtcaataatttgcattttttcttatatccacctatgaaatacacaaaatacatgcaaaatcatcatacttgctgaccatcaatgaatcgattggattaaccaaccaaagttggtcttactcattatgcccttaaacatgccgggctttgttgttggccacaatttttttaatctaactgggccccaaatatgctgcattttctcacttgcaatctactaaaaataaagataaaacctcaagaagacttgtcaccagccaagatttaagggtagtgatcttggctgggtttgcttggctgcatgcaagaattatagcagtctctgaatgacccagaaacatttaccgttgtggagattatggataccccatacctacacggcatgtatagtctgactgggtatggggtgccatgtatagatataatatccttaaaaggactcgggttaaattccaaacttgtacgtcaaaggaaatacctgggatcctagtcggttacgattgtatctcatctgtaactacctattccgttagggatatggattatgctttgtaatgcggacccattcccctatataaggaggggtccgggtgcctctagaggcacgattttcacccaaatcatatgatcaataatacactcggcggatcaatccccggacaggagtagggtattacttcttgattaagaaggcctgaacctgtataaaattccttgtctttcaacccatccatttttccagcttgatagccacccccttttagtattgccgaaatcttgtttcgacagttggcgcgccaggtaggggaagcgtcaagttcttcgccgactactgcgatgggtttcgtttccggcatcgacgacttcgtcttccctcccgggcaggcgttccggttcggtagcctcgacttcatcaccaacgacctcggcaagatttttctcctcgactcgaattcgaaccagtcaggaagaggccagatctccgccccgttcggtatcccgaactcggccgagatctaccccaagaccatctcaaccgagttggcctcaaaccactcggacgagatccaatctactacaacacgacctgatcaagatgatggagcttatccgccaatcctgatgaaactccccgatgatttggctgtcgtcttcaccacaagggcgtcttctccccataggtctaggcgggatctggcctcggccccgatccagcctagctccaggaaagtcggcgtcatgctccagcctctcggcatggtttcgacataacaactggatggctacctcagctcccccggcgtcgactcatggcatacgaagatcattgagtacgacgacttcggctacctctacgactaccgcaacctcgacgacttcgacgaagactttgaagataactacacgcctctctacttcagcatcttcatggccgacaacgagacggaagaacagcgtaaagcccgagaagccgaagaacagcgcgtgcgacaggaagccgaacgacgccgattggaagaggagcgccaagcacaagaacgagaacggctgcagcgtgagcaacaggagcacgaacgggctgcaaagaaggctgaagaccagcgacagcgcgccttggatgccgggcgacgagcacgagaacttatcaggcagcaagacgtcgagggaacggcggtttttcgcacccctcaacagaacgcggttgcagcgatcaccctcctcgacaccctccttaaggaagacgcactcaatcaagccaatcacgtcgtcaacatcttgaaccagaccaagaccatgatcgcagcttcggtcccgattaactccgcaagcgtccacacgccgactggcagccgagtcccccctcttcaatctcaagactatcaccaaccgagcctcagcgtcgttggtgccggatccagtcgcaggagaagggaccacgacgagcgctccgtccacttacctcctgaccgacgcagggagcgtcgagctgaacgtccccgctccccgcatcgcaggcatcccatcgatcttcgcgaaactataaaccagcgccgcgcggcgagaggctacatcccccaccattcaccatatcgctatgacgacgacgtggatggagttgctgccttcacaagcgacctgcatcgagtggattggccggccggcttcaagccgactagaatcgagaagtatgatggcaccactaaccctgagtcttggctcactgtctacggtcttgcaattcgcgcagcaggaggagacaacaaagctatggcaaactatctacccgtagcactagcggattctgcccggtcctggctcctcgggctaccccgtggcacaatcggatcttgggcggaacttcgcgaccacttcatcgccaatttccagggcacctttgaacgccctggcactcagttcgatctctacaatgttgtctagaagtctggagaatcccttcgagattacatccgacgtttttccgagcaacgcaataagatctccaacatcaccgacgacgtcatcatcgccgccttcaccaagggcatccgccacgagctcttagtcggcaagtttggacgcaagcctcccaggacggtcaagcagatgttcgaaaaagccaatgagtatgcaaaagccgaagatgccatcaccgcatccaagcagtcgggcaccacttggaagccgaagaaagatatgccgactatagggggggagtggaagtaccaatcacaaggatcgcaagtgtaagcccgaggaacttgtggcaaccactacaccatcctcccgacaacgttcgcgcgtcaatacctttgacaagatcatgaattcccaatgtccgcatcatccaaattccaatcacgcggccaaagattgcttcgtctacaaacagtttgcagaacaatacgctaagaacgcacgcaagaccactgatggagatcaaagcacgtcaaagaagaaggatgatgaagatgatgccccgactagttttgaagaccatcgcaaggaactcaaccacatctttggcggaccactagcctatgaatccaagagaaagcaaaagctgaccgaacgggagatcaatgctgtccagcccgacacacctcaatatcttcggtggtcagagacaacaatcaagttcgaccgctgggatcatcccgaccgagtggtccacccggggcggtaccccctagtactagacccagtggttcgcaacgtcaagctttgcagatctctcatcgatgatggcaatgcactcaatatccttttcgccaagactctggacgacatgcagatccctcgcacggaattaaagccaagtaatgcgccctttcacggagtcatccccgggctatctgctacaccactcggccagatcactcttccggttactttcggcactcgggagaacttccgcacagaaaacgtctgtttcgaagttgctgatttcgagacagcgtatcatgccatactcggacgcccagcgttagccatgttcatggctgtcccccactatacctacatgatgatgaagatgccaggtcctcgaggagtcatatccctgcggagcgacatcaagcaagccgttacttgtgacaaggaaagctgcgagatggcccagacccgcgagatcacgctcgcccgagaggaaatccgactggctgcatctacagcaaccgaaggagaagtgtctgcaaccaagatgtcgaaaagcggagaaggcgatgccaagaccaagaaaatccctctagatccctctgatcccactaagactgctgtaataggcgctgagttagattgtaaataggaaagcgcgctcatcacctttcttcaaaataataaagatatctttgcgtggaaaccatctgatatgcctggtattcctagagaggtgattgagcactctttacatgttaaggaagacgctaaacccatcaaacaacgactccgccgttttgcacaggatagaaaagattcgatcaaagaggaattgaccaagctgttagcagcaggcttcattaaggaagtcctacatcccgactggctggctaacccagtcctggttcggaagaagacggggcaatggcgtatgtgtgttgattacacagacctcaacaaatcttgtcccaaagatcccttcgggttacctcgcattgaccaggtggttgactcaatagtcggctgcgagttactcagttttttggattgctactcaggatatcatcagatccgactaaaggaatccgactgcttgaagacttcattcatcacacccttcggggcctattgctacatcaccatgccttttggattgaagaacgtatgagcaacttatcaatgtatgatccagagatgcttttcaactctgattggtcgcaacgttgaagcctatattgatgatgtggttgtcaagaccaagcagaaggatgatttgatcgcgtatctagaagagacctttgcgagcatctgcgccttcaggatgaaattaaaccctgaaaagtgcatcttcggagtaccgtcagggaagctgcttggctttatggtatcccataggggcatacaggccaacccggagaaaatcaacgccatcctcaacatgaaaccgccgagctcccagaaagatgttcaaaagttaactggatgcatggcggcgctaagccggttcgtctcatgactcggcgagcgggggatgccctttttcaagctgctaaagaaaaccgacaatttccagtggggacccgaagcacaaaaagcctttgaagacttcaagaaacttctcactactccaccggtcttaacttcgccacatccgcaagagctgctgttgttatatgtgtcggcaacttcccaggttgtgagcacggtcctggttgttgagcatgaggaagaaggtcatgttcaaaaagtccaacgaccaatctatttcgtcagcaaggnctttttaggctcgtatctctcaagtatcaagcactattccttcaggntctcaataagtctatttattattggtgctttctgattatccatcaggcaaattatctcactattttcaaggtcactcggtcacggtggttacatcgtttccacttagggatatacttcataaccgcgaagcaaatgggtggatcgcaaagtgggccttagagttgatgtctttggatctatccttcaagccgcgaacttcgatcaagtcccaagctttagcagacttcgtcgccgagtggaccgagtgccaggaagacacgcctgcagagaagatggagtattggactatgcattttgacgggtcaaagaggctttcgagcaccggagcaggagtggtcctaatttccccgactggagaaaggttgagctatgtattgtggatacatttttctgcgtcccataacgtggcggaatatgaggcgcttcttcacggattaaggattgcaatctctttgggaattcggcttctgatagttcatggagattctcagttggttgttaatcaagtcatgaaagagtggtcctgccttgatgataatatgactgcttattggcaggaggtacgcaagctagaagataaattcgatgaccttgagctaacacatgttctccgacataacaatgaggcagccaacagactggccaatttcgattcaaaacgagaagcaactcctttcgatgtgtttgtcgaacatctttatgaactaatcgtaccgaggaaagaaatggtcgaggccacgtacactcaagaagtaaacatgattgaagccgactggagagagcccctcatcaaatttttgaccaagcaagaactccctcaagataaagacgaagccgagcggatttctagacgcagcagactttatgtcatacatgagaccgagctgtacaagaaaagtccgtcaggaattctgcaacgctgtgtgtctttggaggagggaagacaattgccaaaggatatacattcaggcatctgtggcaatcacgctgccacacaaaccatcgttcgcaaggcttatcggcagggttttttctggcccacagctgtgttcgacgccgacaagattgtccgaacatgtgagggttgttaatttttcgctcgacaaactcatctaccggctcaagagttccaaaccatcccgctgtcttggccgtttgcggtttgggggctcgacatggttgggccgtttaaaaaggctgttggtggttatactcatctcttcgtagctgttgacaaattctccaagtggatcgaagccaaaccagtcatcacaatcatagcagacaaggctagagatttttttcatcaacattgtacaccggtttggagtacccaatcggatcatcagtgataacgacactcaattcactagcggagtatttaaagatttctgtgaggacttcggcatcaaaatttgttatgcctccatagcgcaccacatgagcaacagacaagtcgaacgtgccaatggtatggtacttcaaggaataaaagcacgagttttcgaccgactgcatccctatgccggcaagtgggtagaacagctgccgtccgtgctttggtccctgcgtaccactcccagtcgggctacgggccagtcaccgttttttctagtctatggagcggaagcgatgttaccaagcgaggtggaatttgaatctttacgattttgcaacttcagcgaggagcgctacggagaagaccgagtagacgatatcaaccgactggaggaagcccgtgaagtagccttaattcagtcggctaggtatttacaagggatgcgccgttatcacaatcgcaatgttcgatcacgagctttcttagttggagacctggttttgagaaaaattcaaactacatgagatcggcacaagttatctcccttatgggaaggaccgttcataatttctgaagttactctaccaggatcttaccgactcaaacgtgaagacggtactcatgtcgacaactcttggaacattgaacatctccgtcgtttttatgcttaggcattacattttgtatcttcctctctgactgttaacatcaagtttttccttgagttatcagtcgggggctattataataataatggagtgtgatttcttgtcaattcaatttgcttacttgatttatcattgccttgtttgattttttggcttggtcaatgaggactgaaagtttttcaacaacttttgcgggttctaggctcaataaggtttgacaaaaacttttaagaaattaggagctgagtttaaatcatcaagcacggcataaattcatcagtattgtacaaattgtgactccatcatcatcatcattgtcagaatacaacatcaatcagtttcagtcttttcatcatcagagttaccagacccagtcggcctaaggtcgttttcttggaacctctcaactacatcaacggctatcttatcggcagctttctgcgcgtcattgatgaggtcaagagcagcttcttctcttgtcccgtctgtaaagccatcaacggcgtcaatatcaatcttcgggtacaaggacttggtcatcgccaacgccaggcttgctcccatacttccagcttccttgatgttcttaaaatatgtatctggggcaattctcagcttgtcgaagatttcggaagcatcaaatgaactcggaccattgttattaaaaaacatggcttggacgagtggtgtagcggcgttggcgacctcatctctagctccctcaagcctcttgattttgttaaccaagacgtcgaattgggcttgggatttgattttgtgatctgtgcaagtagatttgtatcagcaagtgggcgtgaagataagagtggttttttgaagtttcagctacaagtaccttcgacatctttcagagccgagtccctctgcttcgtcagttcgcccttatccttttccagagccctgtttcgcctttccagctcagacatcttggcagcttgcactgtattgcctctcattggttagttgcacatggatagcggcatggaacaagtcggataaggatgagaattaccttttgatgaaccgctcagctcaaaattggagtcttgaagctaagcgatccaatctctgaggtcatgctcagtctttctggcaagctctttggcttcacacagctggtctctggttgcctcaagggtttcaaggtggggaactaattttttgagggttgtagtctttgcctcattcctaagatggattctctgcattacaagtgcgtctttatttaagcaaagtggccgatggaatgattgaagctgagcgtatagagacttacatttacaagacgagtagcttggccgagtgtccttttcagcagacatacttcctcgtcttctttttgtttgtttatcacaattccctgaggttgcatttcgtcatcccaccatttgactaatatgggtgggcgagaatcttcagccgatcgtatccggaggacctcttcttcatcaccgatcattgggccttaaacagtcatgaataatggtaaaataattgaagagaatatgtcggattaaaacagatttagaggatttgtttacctgttatgatttctggtcggggatgagcaggtccttccaccctgacaggagagttagttccagagccagcgccagtgtttgtcttgggagggctattggtttgagcctctgcttctgggatatctttactttgctctgtacccgactggtttccagtcgggggctcctgatcagcactgaccttagctttagctgactggtttccaatcgggggcttattgctggttgctacattgtcggttgctgattggtcaccactcgggcgatcttcggtagtcaacccggtttcagtcgaaggaccagtctccgtgccagtcggttcagagtcctttccagatggatcgatgtcagttggtttcctgcaaatttgagatattcaatcaacactactttaatggtgagagaccggtaatacgggggaaattgctgaatgactcatacctggatgacttcctgatttttggtatgggacgactggatgttttcttctttggattagtttgccttggctgtttctcagtcgccctttttgtcgcctgccttttccacatcgtcgccctcatcgtcacttgaaaccaacttcctcttacgagaatctggctggttagtcggcttcgaggtgttagattggatattcgactggatcttcggccctccgctggcttggccagtttgctggcgaggtgagcggtgttgagcaattggaggatcagatttcatcaaagcgaattcctgtgcatggtatttcaagtttccagttgaccttacggaagataaaagcatgctttgagaaaggatgaggtgtataatacgtaccggtggaggagggttgaaggcattatatggcacgactggcaataagtgtgaatagttgaccacgatggcattcgagaagattttgtacattctttcctgcataattctgaactcaagagactctgggtcctctcgaactcgaaagctgttcaggatctttctttgattggtgccagccggctcttgataaagtgccgagtaatttattctccctacagaccctgttctttaagtttcagcatcctgtccagcaggtcaagcgcttgggcagcttcttctcccataggaagtgaattccaggtatcacgatataccggaggaagacaagagtacctgggaagcgttggctcggagttttgcacatagaaccagttcgcatgccaacctttgttcgaggtcttgaatggcatggagaagtatttttggctcaaggtccccctcagttgaaaaccggctcccccaacaacacatggtttgctcttgtttggctggggcttgaggaagaagatgcagcggaatagggaaaaatgcggcctaatccccagaaaagcttcgcaggcatggatgaaattggcgatgtggactatggaattggggtttaggtgatgcaggctgatcccatagaagtccaaaattccccgaaagaagcttgaggttggaagagaaaacccgccatagaagaaatgagaaaataccacgacctcatgtgtgtcaggggttgggaatgcttcgccgcatgctggacgccacccaatgatctcttttgccggaagaacactgtgcgccaccatctccttcaggttctcctccgttacatcggagggcgcccactgactctcaaagctctctctctctctctctctcttccgccatggatgcgatctggatgatatgatttggtttggagtgtggctgggactaaatgggagattgatgcggtggttgcatgggagattttcgtggagttttggaggatggattggagtgaatcggtgaaccctagtttcgtcggtgcggtttcgtactgtagcagagaatggggaaagtggcgagagtttcggtggggaagatgaaacgacgcttgaccttcggtgttgtttcattaagatatcgggagtactaatgggcctgggcctaaacagtacttcagcccaatttttctattggcgtggctaagttgtgatcttagggacttaggcatttttgcttcggcaacatttgctcacaacagtatagcaatgttgttaaaatcctttttgacgcagttagataattctttggaactgctacgatgcaaataaaaaggtgcccaacagaaaagtgttataccaattttgtaggcctttttacgctacaaaagctgttcgggttttgttgagatggctggtttttgaatagtcattctctcggcaagttatatgcttgatttaatcatggtgtgggtcatagcctaggctatttagacttgttggttgtcatgatttatatcacatttgatggatctttttaagattttttactcggatttttatcatatgtgtggatttatagacctttagagtgtttctcactcgggcctctttatatctccttttttggtgtattaaagctaaagcagttggctggatgttttattaaacatcgcatatgcttagctgtatgatactttggatgatttggttgtaaaaccactcggttggatgttatttgcaccttgactatatgtttagtttttaactaatcacatagtcggggggctacacctaattaggtgtatctagtcaatgtacccgattttttctattttcagaccttcacagtctttgattttgatactcgggagattatggcagaagaagtcggagtactcggattatcgttttggattacgggagaagactatttcgtcgactgtaaaggtttcaggggctactgtggagattatggataccccatacctacacggcatgtatagtccgactgggtatggggtgccatgtatagatataatatccttaaaaggactcgggttaaattccaaacttgtacatcaaggaaatacctgggattctagtcggttacgattgtatcttatctgtaacaacctattccgttaaggatatggattgtgcattgtaatgcggacccttcccctatataaggaggggtccgggtgcctctagggacacgattttcacccagatcatacgatcaataatacactcggcggatcaatcttcggacaggagtagggtattacttcttaattaagaaggcctgaacctgtataaaattccttgtctttcaatccatccacttttccaacttgatagccaccccttttagtattgccgaaatcttgtttcgacaaccgtaactgtaacctgttgcacttgcactgcataggattctcatttgccagttggtcaccatagagtcagtagtcagaacacattggtactccactgttcagaatgaggtcagaaatcaaatacagagcacgccgatttcaatccgagagagatggacacacactctccctcaattcaactcctcacgattgcaaaataactaatcgaatttatgtcagaaagtttgtttaaatggtgttttttatgttcctttttgtttggcggaccacttaaatttggggttcaacagataaggcctggtttagttcccaactttttcttcaaacttccaacttttccatcacatcatttcaatttcaatcaaactttcaatttttgcgtgaaataaacacaccctaactagagcctcaaaaagagtttgacaaattaaataaatttcttctcccattgattgttctgcttgtttggagtttggacaacaagtactagtagtaatagtagggccatgtttagttcacatcaaactttccctaaactcctaacttttcatcacatcacatcacatcgaaaacttccctactcacataaattcctaacttttttttcaaactaccaactttcttcaaactttttcctaatttcaaaaactaaacacagcatagatgaagaacaccacacagcaagacacaccacatgacactgctatctatgcactgcagccacatgctgcctattagcttggttcagtgtcactgtacaacactggtgcaactaccaggcaggcagtgtatcactgtatccagtgtccacatcatctcagcttggcagcagcctttttggaatcctgaaaaaaatctaaacattagctttaaaaaaacacaaagcatcatccaaagagctaaagtgcaaaattactgttcctaaaggtaatttcaatccccaccccactcctgggcatccggagtactatctttgattcagaaaatgctacattgatctctgtgcatgctcatcatctttgaagccaggggacatcatcccccttttgcttactagctttcatgtgaggaagtttcccagagcatcttggcatctcatccatctcaaagatttcatgtttccctccttccttttcttttaacctttttctgttgattcatatgctcaaatcttctagggtgagagaacccaaattcaaacaaaagttgcatgtcaaagttagagttggtgttgaattcactgcaagtttaaaaactgtgcaggaagttactttggatagcctaaagtttgcattggccggtgttatcttttgcccaaagatgattgtgtggcttcgtttgttccctccccctcctcttttctaccctgcttttgatgccaaattgctactaattgctgcatcgtcagagtgtaacacgatgattagttcaaatatatatcaatgccaggtcgttggcctctgatgtctgacagacaatcagcaggtttaatagcaatgatacatgaaagaaagccagtagccttggaccaaaagatcattgtaggagtatatctaggggatgaaatcataaaaaatggcctacatggaccaccctgggattgaatgacatcagctgttccttgcgattccattaattttggatgctgattgcatgctttttctcagttttttcttctgtcttgagaaaacgtgatgtcattgctagctgcacccacgcaatagaatgagcctgccacattgcgaatgtgtcaaacatatatagagagagagtttacttgtccatctctaaatgttattctttaattctttttcacctgccattgcaaatgtgtcaaaaggttttccacggttaatgcacatgatcatttgcatctaacgctgtcattcttgcagacataataaattcttgcacagtatatctgttgctcacttagcctggcagtatgcatgtgttgctctgtgaaaataatgtgaagcggcagtgtggcggcaacatttgagaaagcagccaactcacccggccactgcacagtgttgagagttggaaattcgtcggtgactcgatcggtgtagggtagcagatggtagtagctagctagtagctagggttcaattcgcctgtgatatgatgatcgaaagatccattgcgcatcacccaatcagtcacacaagtaacgtgtgcagcctctttgctttcatgtgctgtccggtccatttcccgcctttttgcattgctcccaagtcccaacttttagaggtaaacccaaagatgtgttttgttaagtttggaaaaaaagttagaagttcacgtgtgtaggaaagttttggatgtgatgtgatagaaagttggaagtttgaggtagttgggaatgaactaaacatggcccaagggcatctgcttaatttaggaatcttaataaaatacatggagttaactacttcttatcatatgctccctctgttttaaaatatatgacattttgttttgttaggacaagcatttaaacaatttaaataatgattgcttcattaatatattatttatatgataaagtataatcgtatgactttgaagacgaatctaataacatcaatattttactggttaaaatctaatcgcaacgaaacatatatcctatatttttaaaatggagggagtattaacttcagcaagatcgtttattttaggagacggaaaaaatcagctaattacttcctgttatcagtcaaacacgattgttttaagttaactaactaggaccctatttagatgggactaaaacttttaagttcctatcacatcggatgtttaaacactaataataaatattaaacgtagactattaataaaacccatccataatcttggactaattcacgagacgaatctattgagcctaattaatccataattagcctatgtgatactacagtaaacattctctaattatggattaattaggcttaaaaaatttatctcgtgaattagctttcatttatataattagttttgtaagtagtctatatttaatactctaaattagtgtctaaatatagggactaaagttaagtctctggatccaaacaccacctaagcatcaacattcagtatttaagttgatttcggaaggagtagacatgcaacccagccctcttcaacacagatactaacaaaaagcgtgtctgcgtgtgtgtgatggcaacacaacggtgatcgatcgagccggtcctgcattttttgcagtagtcaggcagtcagtcacggaccattgccactgtagtgacgcagtcagccaagccaagctccactcccatgttggatcggcttgcgcaggcaggaaatcggtcatcgatcaggaggtggtggtggtggttcacgtgttggctggccaccgatcgagcgccggtcggtcgatcgatcgatcgccgtgcgtgcgtgcacacacagcgtgcggcgcgcgcggctgccggaggaaatacgtacggcgcggcagattcaacccgtcacgcacgacggcagcggcggagaaccggtttggactcggacagttggacggacgctgctgatgctgagagagagggagagagactggatgcaagcgagcatccaggcaggcaaacggacttttttttcccgcttattctacttttatttcttttataaattttataataccatataaaaaaatagactaataaataggttttatacggtagcgagacttctcacttacattctattagaagaggacggcaacaacgatgtgcgcgtgtgacggacgaataacgatgatgtcagaggattgcagtgcaacgacagcagcatcgtcgtcatctacctcccctcgctcaggattctctgcagctgcccatgctgccagcagcaatggagccggcgcgcgtgcgcgcgcgcgtgcatcccgatggtctagtgtactctagtggcggatgaaacaagaaaatctgaaacccaaggcaacgaacaaaagaaatgaatttggatgcgtctcgtgcagtactaatctggctatttgaaacgtggatgaattaaaatctttggtaatgacatcgatcccctgcgaccgattctcctccgcgttgtacaatgggtttgagctgagctaacatcatctccaacagagttgctatctgcctcttcaagtaaaattttagcaactctaggtgaaaatcgtactccaataaaattgccatctcactctccaagctattccgctagcaaaataagcccttggaatggccaaccttggagagtcatcttgcctgaccaaacgtgggtaccactgctccatcccatctctctctccttgccataacctcgtaagacggcagtagaccgtgcgccgtcagacgatgtcaccacgctgtcgcccatcattgtctcgcgccaccactgcttccccttcgatgccgatcgcctctcctcccatactcgcctcattcaccgttgtcaccgaggttgcgtcggctgtcgttgtcagatccacatgcgacgaagaagcggctgtcgacagatgcatctacgagtgaagccgccactgccaccgcggatttttcatgagtagcagtgtcaccgccgtcgtcagctccacatccacaggcaacatcgccgcccgggtcaacatcatccttctccccctatctcactagagttgctcgcccttctatacgtatgttgaggtagcgatgttggcttgggtggcgccgagacagttggctgtggcgggcggcttgggcagaggcgatactgcaggactcatgggtagccaacggtgaggagaggaaagattcgatagagaaagaagtatatagagactaatatatggtacccattgttagattggatagtgtaaataggaaggttgttggagtggaaaacaaaattggctctctattctactgtcaaattagctaaatgagcatctggagagtcatatttaaagagactgttggagatgctataagggtgcgttagtttcttgtggttgaagggatatttttagcacacgcaaaaaaaagttcattagcatatgattaattatgtattaactattataaattctaaaaaaaggatttattaaagttttaaagaaactttggtattcatttttttttcacgaaacacattgtttagcagttttaggaagcctgctacggagtaaaaaaaaagcaggaagttgttgtgagtgaaaattaaaaaatggcctaattaccatgagcatgtctccccaactgttaaacaatgtgttttgtggattaggttcctatgcagttcctagtgtgactgcaacttaagcagacatatagggtctattaaaactccatccaacggttgagattgtttaagcactgttcatggaaaaaaacatcacatctactatagccagtggcactgtagcacttaatctacacccttcgttgggaaaatgaatggatgagatctcatgcagtcattaactttcagtcgtagttgtgactgtatttgatctcaatccgtgttttgtgctaagggcaagaatgtttgtgactgtatgtgtatgggtaataaggatgggacccatgagcaatagttatggacgtgtctataatagttaactcttttgaagaactttatgatgggtccactgaaaaaaaaaagcttcctaacaagccagagaaatagatattgaacagtgaaaaaatatattaatattttcctgtgatcatgccttaagattaaggctatctgactatgaagcttaaggctgtgtttgacacattgagttggggctaatccttgatgcatacaaaatggggtgactcattagcacatgattaattaagtattagctattttttaaaaaataaatggattaataggatttttaaaagcaacttccctattttttttgaaaaaaatgcacggttttgatttggtaagcatgcgaccagaaaactaggtagtgaagttggaaaagtacacattccaacacaacctaaggtgagctcccaaaataactaaagtcacaacacttagtgctttttggctaactttttggtatatttttgttgtcttaaaactttatacagagaaatttcttaaaaaataataaatctatttttagagtttacaatagataatatttaattaataatatgtaatgacttacatatcatttttttctacatctaactagctaatcctaaccactatagagaagatatcactactgaaaaactgatctttaatgggtcatgtataatctacattagtcccggttcgagtaggaactttgtgatatcttctctatagcggttaggattatttagtcctagttcctactcgaactagtactaatgtggattttgcatgacccatcaaagatcagttttccctagtaatatcttctctatagcggttaggattagctagttagatgtagaaaaaatatatttagtcccggtttaaaattttacgatctttagtctaaagatcatttttagtcccggttcaaaataggtcaggtgtcccaccaactttattcccggtgcaccgtatataattcctaagacttatcctcacctcctcctcatccgtaactacctttcctcctcctctctctcttctctctatcttatctctatcctctcatcctctcatctttaactattttctagcggcgaggtgcagtgccgggcgagcagccatgtcgggcggcggcggggggccggtggcggcggccagcgccacgccgggcggggagcagcaccgggcagtggcctgtgcagagatcggaggcgggctatgtggatgcaaatttttcctgtgaatttgttcatactgtggatatgtgaatttgtgatgtcaatttgagtatgtttattggatctgtgaatctgtggataattttgtgatgttttgttaatggggatgattttgttgttgagattggtttgaaatcaatataagtagaaaaaataattaaaaataaaagaaaaaaaaggagtacagatgggaaattcagccacgtgggaactaaagatgatttttggtccggttatttcaaccaagatctttaatccttgattcatggtctacagtcataaatttacggtcccaattgtataatcggcggttgtataaccatgactatattgttacgaacggggagggaaggtcctttctccggcagtgtatggaacagctactcaagtcagaaagttaatccgtattaataagctggttaattcaacattttttacgtgggcgattcatgaccttttctccacctgttacttgtatacgttgaatagtgtacttctgactgatttgctggtgcgataatatccttgacagcctggaaacatgttcccatatttagacaccagaaagtaagctgtacacgcttcttaatctgtccaatacaagacggagacaaaacatgtccatttaccctgaacttcgatatctagaaaacggactatcaaaaaaacctttcacaagttatttggatattttttaaaaaatataactataattataatagttaacttttaacttatatataactggtatataatatactacaacccactacttttatactgtctatatattagtgcccaaaattttctgatattatgcaatagtctaatatgtgtataaagcaaattaatatcatatatttaaataaacagacaaacaatactagcatatttgataaatatatgtatatattttgcctatgacatattattatacattttttgggagttttgggagaaaaaacttaaggatgatatattttttcttcacatcatcccctaatatataatgttccgtttcattgattgatgtatggaagttgatatacttgactataaggataagtttactatttatatatttttgcatgttgcctaccaccttatcataaaagccccaacacccctccaccacccaatttttgccaacacacattctttaccctactgacgggcagaccacatttctccaagagacctctgcacgccgactccattgtactccctccgtttcgcaatgtaagtcattcgtttcgcaatgtaagtcattctagcatttcctatattcatatctatctagattcattaacatcaatataaatgtggaaaatgctaaaatgacttacattgtgaatcgaaggaagtagccgccatgtccacatgaatcaagagaggcgacttttagccgtcttagtttctaggcaccacctccacccctatcttgaaactcccccgtgaccatatttggaagctgatgggacatagtgaggggcaccaaaggagagaaagaggcatgtctagcaattgagaggactacccactgcgatcatctgtattgccacgtcaccacaagggcccaactaacctaatatgccctttcgtggcctagatttagaccaccgcgcacagttagtcgtccctaccaacttacagtagcctatcaactaacatccatagtgacccggacggatataagataagattagaggagggactcaaatctccttcttagtcattcagccccgctactctctctcctctctctctcttcttccctctcccctttctccttctattaatggtgatccagcagggtagggggactcgagtccccccagcacacatactggatccgtctttggacctacccacaccgagaagcatgggccgccgcacattcactgtgatgcttcgcccttattgtcttactccctaccatctcgggccctcggctcttttgtgctatcaccgcactatctcacccgcaccacttgccactacccctgatgtaagatggctcgtcacggcgtcgcctctaatgtctttgttcctgctcctcgctcatgccatttctaaagctcagacgctattttgaatcccacaatcgttagttctatgtgggctttttagtagctcgctctgcgacgaggagggcatcggtggtggcctggcgggtagttagacatagtttgccattaatatcatctttatttagaagatgcttccaccctatatcactcgagtacttgcccatcaaatatattttttttgaaactacaaagagtaagcaattaattgaatgtggctgaaaagtttggctcttcatctcttcctttttccagatttggttctccatgtgatatctctggcacgctgaaattgctgccgcaagtacaacaagagcgtcaccaccatcgatcgccagctcgcgaaaaccagaatcgtagtagtaggagcaacgtgtgtgtgat

SEQ ID NO: 55975 - DNA, 2975 bp, Oryza sativa
ccacccttcctcttcgcttcgttttcttctcctcgacccgccgaacagcagcccgctcttttgatcttttcctccctctcttcttctccctccgaaccacgagtcgccgccaatggcctcctgacaaggcctcgtctcggttctctgctcgtggttgggggcttcttggcgttcttgattttttggtttgggtgccttggtgctcgttcttgaggcgttcgttttcccttggtttgatgcggcggcggtggtgagggtgggagcagccgcaggtcgggaatggaaggggacgagggcgcggcggcggcggcgaggataaggctagtgcggtgccccaagtgcgacaagttcttgccggagctccccgcctactccgtctacgtctgcggcggctgcggcgccgctctccaaggtgcgccgcccttctcttcattgcctcgccgtgtggttccctttcgcagccaattggttgaattttggggccttttttttttctgtttgatcgtcgattgcattcgtagtatagtttgcatgatttttttttcttctcgttttttctgttcattctcttgcgacccattctgcaaagaatccgggttaattagttagttagttaattaattgattggttgattgattgatttcgtgtgcttgctgaactgtgatggatttgggaattgtcgggattattggtgcatcaaagttcgcacatggactttgtctttggtgacactgacacttgcggctgcggaaaatttttgatttgctcaactagtcgtcatgtttgcagcaaattttaggaagactttgtttaatgccgacaaatattgtcagctgttttatgctttcaagaaagttctgtactttgagggtttaatctgaattctcaacttgccctctttgaaacgaacttttttttatcaatttcaacctagtgccttattacaatgggcagatagtgtttactcaattcttttggaaaaatgtaaatttctacactgatgtaatcttaatatttgcgaaaaaaatcttgctcactgaaacttgaaagatggctgccagtctgccaactacaccattgcagactcgttctctcttcttttgcagttacttctatgccttcctgaatagattacatggggcttgacaaacaaaacatgggttggatttgacctaaatatcttaagattttgggtgatggttgagtagtttttatataaatcctgtggattgcgattattatgggattctagttgcattttagtccccaattgtgcttgccaacgttgctttggggggtcaatcgcaatgccattggtgctggggcttggagaagtggtcttcttgtgcagcacatccttgtcatatcctagttaataataacataatttgacttgcatgagttgcatcctttaaccctcctttgttaggaatgaagtggtcaattgaatattgagatgacatcattcatcttctgaacatttttcagcaaagaagaagtactcagcccaaggttctgataactctgataatggacatgtgaagtaccttgaggtactagagagtgttgcggaggcgcctgaagcaatggatggtgctaccgctgatggtagatctatacccaatagaatttcagctttgcacagtagatcagtttacaaccatgaagacaatcgaatggcaagaggtccaagtacttcaacaggtgaagctactattagaaacgatggtagggaggcaaagtacatgcgcatccgtaatgtggaaaatgctgacatgatgaaatcagtaagaggaagaggtatatctgacatatctccgaggtctccaatcgatggaattccacccacctcttaccaagcggaaagccttgtcaactaccaattacagtcaaaatacagattctccaacagggagcatgccaatgatagggacttggatggtccaagcagagttaggggccttgagaaagatcgtgctgagctcttgaagatgcttgatgagttgagagaccaggtgcagcaatcatgtgaggttactgatgcaccaagtagaagtgctacaactaatagacctgcagatgcctcaagttcacatggtgcgcatgatcagccaaatcagctgaggcatgatccatctgtattgcattggaatggttctcatcactcgccatccttgaatgtgcaaagtcctaatatcccacaagtccatgctccattgcctactcgacagaatcttcatggatatgcagagcccatcccgcatgcgagagcctctagctatcatgctggtgctggttacccctgcagaaatgttgataatttcttctttggacatcatgatcctgaccctttgctctcatgtcaccatgaaggcttgtaccatcagcccgtctgttcttgcttcaattgttaccaccgagagtttttgcctgtacagggaactccccttggttttactgatcaaagggcaccataccttatgaacagttatggagcatatcctgtagagggtcccctatatggtcagcagagatacacttcaagaggtactaatacttctttacagaggaatcacctgaggaccaatgtaaggaagaaaccggcacaaacttgtgagccgattgcaggtggtgcccctttcaccatatgctacaattgctatgaagtgctgcgaataccaatgaaacattctttgttgggaaaggagtataagctgatgtgtggatcatgctcacatgcaattctagtcaaccttgatggaagcaggctcaatgtttcagaacctgcgcccggtataaatttatctgctgcactgcaaaatggtattggtgatagcatgagaaacaatgggcatgctaatgctgatgagaggttgcttccacaatattgtttttctaatggaagtcatgaatctcaagaaaaagatctagaatcaaattcaagtgaatcagatagcaaacacactcctctagg

SEQ ID NO: 55976 - DNA, 2037 bp, Oryza sativa
atttactgaagttgcaaacggaactcaattaaagatgtatgtgtagccaatgagacacagtctccagtcgatgagtttgatgatactttatatgcacaagatatgctaaatttgccacaaaatgttggccatactaggtctacaaaggcaggcgattcatttctaaccaatctcattaaaaggagcttcaaaatgaacaatggaacacgcaatggaagagcaaggatttttgttaatggctttcctatctctgaccgtgcagtcaggaaggctgagaagctagctggagaaatctgtcctggtgattactggtaaaattcctcaggctgcagagtgctaaactatgtttggtttatattttgattcctgcatttcagttatgcttcagtaatcttgaaaagaaacttaaatagtcgcctacattaatataacaaaattctattgtgtactttctttcttgtattgaatatttgagtatacaaaattttgatctgatgttctgttacttaggtatgattatcgtgctgggttctggggtgttatggggcgaccctgccttggcatgatacctgtaagaacacttgtcttggatattgttcatttcttcctgtatgctatcctatcgataaaatctctaagttgttttttttccttgcagccttatattccagagttcaattatcctatgcccaagaactgtggtggtggaaacaccggcatatttattaatgggagagaacttcatcagaaggatttggatctacttgtgtctcgaggactgtctgattcccctggcagatcttatatagttgaaaattctgggaaagtttcagatgaagtttctggtgaagagctttatggccttggcaagcttgcaccgacgtaagtatctctttaaattctaatcattttaaattctgcaaaagcaaattaatctagattatttcggtagtcaaggctagctcctgaactgcagttaatatgacagatgctattgctataatcttgtttgcgatgcctcttaattcctgtggtgatacaacttaatcctggaccattttttttaacaacataggatcatataatctatttccaaggaacttattctacaaatccaatgacatcatggaaaatatgttaatggattgtgctcaccattagctcttttttagagtcatctatttggacacacagtgatgtatatgggttatatagattgttagattataatcataatgccatgttatgctacagctacacccatctgcccagtataatttctaaacctttcacaaaagaatacagcctaacaacagttgagttggtcagaagtaattgtgggcttgtggcactacatttttttaatttgatcaacattccctaaaatatgtccaggaatcagggtggtaaaaatagcaagatttgtaagtgttagaaggattgggaatcttgttgtgaagtaatgccctactacatttcatctttgcttattttttgtggccctattctttttttcatattaatatatactccctccgtttcacaatgtaagtcattctagcatttcccacattcatattgatattaatgaatctaagacatatatatccatctagattcattaacatccatatgaatgtgggaaatactagaatgacttatattgtgaaacggaggaagtacgtcattatggtgaactagtgaatagaaatgatagaaaagcattggcctcagatctataacgtgcctggtgtctagtgccaccaccagtaggcaattccaaaatcatagttatgcatagtttcagaaatccttttgcaaaaatatgtcatcaatatcagagctacattagtcgactatccttgcgactaaacaagtgttgtgaagataattcatttcatctccagttgcctttatgtactgcaaaatcctggtacacaggatactgaatctctgatactcttttcaaggattgaatttctgcattagtcttggaactacattatgttctttatttgttgaattggtgtggttttt

SEQ ID NO: 55977 - DNA, 13254 bp, Oryza sativa
tgacgaagtatttgacacattgctactgacttggaaaaaacagtcctacaacgtggcacaataacagtagtccatgagactaacagcctcagttttgagatcatgaagggatgatctgtattctttcgagataatggaagctttagtaaattaagttaattgcatcaagatgtacaatcaaaccgagtcacttcttacctctatataaaatgcacatggccaaaaaaagaagaagaaagaaacaactagaaatatctcccaagcgtaaaagtttaaaagaaacatatatcttagtggttatcaatcagtagtctagaccaccacccatatcctggataaaaaaaactcctacgccacttggtccaactgtcgtgataccactgcaatagtatcctgtagtctcggtccgtggagattagtctagatatgtagtcaccggataacttaagtttggacttaagattggtgtaaatgcaatttacgtttatacttgtattttttttattaatttagagaacttttagcttatttgatgattttgactttcctacaaactaatccattaaaccccctagaggcctaggctatctcgtgtgctagatgaaattatatacacaatattttcaacgtaacttgtctctgtatatgttgtttatgaagcaacaaaaatgaaacaatattatattgtatggactattttaaccatcaatagaaaatttccacgcctaggactgaactaatgggatctcaaatatttttataaattacatagcatttttcaagattataatggggattatggagctaggtatggggcccaagccctagctctgcctcatgcctgattccgccatttaaatatcttatcgcttgtatggtactttttataggaatataaatatgaaacctccgactgaaaatagcgttaccgcccgcggatgaaatggaggtgagaagcggacttggaggagattctgtcggcggcgtgaacggcaacggcgagccgtcgacgacgtgccctttgccccctatccattttccagtagcgcagaagttggggggaggcttatcatagtgggccaggccagctcgtgaaatccacgcgaggggggaaaagcagacaaggaataatggctcagcatccagcaggccaggcccaatccataaggcctaaatactacttgtagtcactgcacagcgttacattacaactttgcatctaagaaagcacagcaatttacgaaggataaaaagtctactttaactccctccaatatatgcctgatccaattcgtatctcaaccacgaaaccatatatatcgcctctccaagtattgaaaccagtacaaaataactccctttgacagttttcaatatggtttcaactaccaacatggcatggttgacatcgtcttcaactgatgtgtcgcttacatgtcactagaagtaaagataaaattaaaatgaaaaaaaaatgagaccccgtgtcagttggacttagatttgaaagaaaaaaatacagtggacccatgtggtgttagtgtcccttctcctcttcccctctcttctattccctctcttttcgacaccatgagtaccttaacaacaacgctagtggattgacggtggggatgcagggagtgcctcggtacaggggagatggtggaagagagaggtcggggccccaacctgtttagtttgcttcagctcatgtgtgtctttattatagtatagatctagcttcttggtgcaattcagcaattagttgagactagttattttaggccttaaattgtgtaaaaccgttttgatttacgcttccgcatatataacttattttagttaaaagttttaaaaccgccaattcacccctctagtcggccttcttgatcctatgacggggactctcccggggattagctcctaacgaaaagattgctattataataaaatctattatattttaggatagaggtaaactatagtaggctagtgtagctaggttttattgcgctccgtcaaaggttgagcacggaggacgcacaaaataatggccgtgtcccaaccacaataaatcaattcgtgatggattatgtctcaaaggtgtaactaatgtctgcttgatatgattgtatgtgtgggccgggttgccataactcacaatctattcatgtgtcatcttgtgccccctcttctattttctgttaatatatgctcgcactgtatttttcatcaattttcatgtatcatgtatattattatctaaaaaaatgtaccatgtatattaattgagttttacataaacaagctgcagatatatgcatgaccatctcatctttatcacacaactttatgtgaaacttagcatagtatatatccgtagttttttcttttacatatcaaattaggataggatgaatgtgtaaatctatcttaacaaaatttcgaataaaaaagttcaaatacttatatgaactactatcatccaatagtagcttatatagtagaaggtaccatataagtaaaaaacaaacacctaacttatcatctaagagtatttacaacgggatgacatggcgagttaccttatgctttcatatcgaatatgagacggcatcttagttatggaagttgtcgtttccatgctagatccgccccggatggaatgcttcttggagacgtaaattaaagccgatgtcggtgcttactttggatgccacatgctttctttctctcctttattaattttctttttcagaaaacaaaaatgcatgacgaggctgtgccatccgtccgtagcgcacgcgcaaagaaatgagatcagcggtggggtatggcccacgtgtcagcgctatcatgcatacgtgtatctccgcggtaaaggtgatccctgattgtttttttttgtttgaaaatttcaatcaccttgacggtacctgcgcacagctacggaagaggcttctctgacgtagtgccctcttacgtgggtggctaacatgtgggtccattatctatggggtctacatgtcatcctctcaaagttagaaggcagtatgttagaggatcacgttccatagcgtactactcattcataatcttttctttcctatacccttaatttctcttaattggtcatcttctcttttttttttacaatccaataatgcaaaagaacaaagccggctttactggaataagaaggtagatcacgaagtaagcttaactcaaccaactaataactaattagattcttttttaacctgttcatctccatgttaaaaatctaacttaaacacaaatattcgtacttacgatgatgtgcaagttatagacttgacatgcatatttgtattcatagcttattatttttccagtgctagatgatatactcatcaacaactttctcaatccaaggtataccggtctagctatagtcccaaagggtgctaacatgaatagagtgtatatacatatttatatggataaatgtgcacgtaattaattatactagcgtcgggattgtattgtgttttaaaataggaaaaagtacgaattaccccctaacaattgtggtcggccgaattacacccctaaactcgaaaaccggacattttacactctcaattattgaaaccagacaaataacccccctaaacactgttttgagtggttttgattagaaattacacacgtggcgccaacgtgacaatccagtcagcaaaaaaaaaaaactccctgagcccacttgtcaaacctatccctcaacccaatcctgtgattcccccctgctctctcttgcgtatgtcagcggaggcggcaggcagccggcggtggaggcggacctcgcctgggtggtgggtggcggaggcgtaccgggcagccggtggcggaggcggacctcatctgggcggcgggtgacggagatgaacccaacagccagcggcggaggcagacctcgcccgggcggcgggtggtggaggtgaacccggcagcaggcgacggaggcggacctcgcccgggcgacgggtggtggaggcgaacccggcagtaggcggcggagcggagccgcctgcctgagcgcgcacacgggagagagaaagagagcgatcagggagagagaggtatgaccggtgggtccaagggagttatttttatttttatttgctgactggattgccacataggtgccacgtgtgcaaactctctggtcaaaaccgctcaaaacagtgttgaggggggtaattcgtttggtactaaaagttcgggggtgagtaatgtctggttttctggtttagggggtaattcggtcgaccacgatagttcagggggtaattcgtactttttcctctaaaataaataatgaggtagagtcaactatgctcgctggtagaggttttttccttgcggagcacccggtaagttgggcttggtctaatggactaacaacaccttcggtctatcccaagtgtaactggtccaatacgaaaagttattcaagacaactctatacgtatttatacgtataaagtgtacacatataaattttatataaaaaaacttttaatgtagaacattttataaagaactatttgaatccgacagtcgcattgcttcgcttatttaattatatgattatctgaatcgcttattggtaaataaaaaaatatttgtgagtataaattttatatatgtctccttagcgacttaaaagcaaatgttgtaatttgtaaataaactatgatgaaaaaaatcaaattcaaaattaagttctaaaatttaaattttatcttataaacataagcctaagcgatacaatgagacttcgaatcggaatcggatataaatttggatagataaacttatcaaaatttaacatggtgcaaaaagaaagtgtaggcattcgcacacttagacttcccacaaactttcgtgcgatagccctttgatagagttatatatggagacaaatgcttcttatttgattctctcagaaatattaggttcaattcaataaaaaggagtttcttattcgatggttgcataattgttttactactctattgtcgattaattcctggaaaatctagtagatcacatggaagcatatagactttatatgacctcattctctctccattaccgtgaaatcacaacctaattctcttgccccgcacgtctcaccatgcccgctatgtcggtgagaaccatcggccacaccttccccgtgacgtcttctccaaatacttctttgcaatgccgtcgtcacccctcttcacaagctttggtgagtttctacatgcttcctttctcctcccctatcaatctctagcagcaccgacaccaccaccacttcaccgacgactcatctccaccacatccttccacttcttctccccatcctcctttgtgatgctgttgtcacccatcttcaccaacgttggcaagtttttgcatgctccctttctccttctcctcccctatctctagtagcatcgacaccaccaccgcctcaccgcatacccatctcctccatcccattgtcggttcttcaccatcttagctttccttctaaacctgtccttactagccatacctcctcctattgaatgcttttgcccaatctcgagattcaatatgacgtacgtgatggaggttcgacgtcacagctattgagagagatgttgccgtggagagctcatcgaggaagtcactgttgacttcgctggtgagttctccccactatctccctccctctctcatgtatatcctactttagttatggtgatagtctaataatcagttacaaaactgtagtataatattatattcactaaactgaaaaccatgaatattaagcaacgcctttcatagcctttgaaattgtgttttttccattaaggacttgaatatccattagaccggaagatgtttgaatccgaacttgcttattttatatttagaaaacgtagacgcatgagatccgcacattgtttcttagagagaggggagagagttataacatgagtagaataacactcataataattcctccctacgatgttatttgaggcttcatgttacttaaaaatttaatgtaaatatgtagtaatataaaccatgtttaaagccacgataaaataaataataattataatatttctaaaatacaaatattattatgaaaattaatagcgttatttttattagtttaaaggtggaggaattgtcctcctcacctaccatcgtagtttttttttaagaaaaacgcctttcaaatgaaaccgcctcatccaaaaaaactcaaataaaaaactaaacacagtagtttcaatcccattacaacgcacggatacgacacaagtgtatttaaaaacggagctaacacactgtatatattactccctccgtttctaaatatttaacaccattaactttttaagcatatgtttgaccgttcgtcttattcgaaaacttttgtgaaatatgtaaaactatatgtctacatataagtatatttaacaatgaatcaaatgataggaaaaatattgataattacttaaatttttttaaataagacaaacggtctaacatatttagaaaaatcggtgtcaaatatttaaaaacagagagggagcattatatagtgccatggctgattgcttgggtgacgagagattccagagatcgagtagtgatctgatcgacttggtgcacgcacgggcggtgggtgatggactgatcagatgaccaactcaccgagatgagcacgcacgcacagctgcaacgcatcacgtgatgagtacgtgatcttctttcgggtcatataggacatgaaaccgtgtcaagcttacacgcgacgtgcatattgtatcacgttctttccctcggttctggagataatacctgttggggccaaggttatttcagggaagaagaaaaaaggttttaggtacgtacgtgctgatgattcttttttttttctgatttttttgtcactttacttgctagcttacaaaattaagtgtccacatactatttaatttttgtgaatttggtcgctttatcagactttatgcatacatacgtcgattaactcttctattttttttaatattttttttaattttgtttctaagtatagttttttacttatttgctaacttacacctgtaccttattaattaggaggggtcatctcgttgatcaaccatttatatagatagttccctacaacacgagtacttaaaaaatactccctccgtcccaaaataagtgtagttttacactatttatgtttaacgtttgaccgttcatcttatttgaaatttttttacgattaatatttttattgttactagatgataaaacatgaatagtactttatgtgtgactaacttttttttaattttctcataaatttttcaaataagacggacggtcaaactttggacacagattcccacgactgcacttattttgggacagaggtagtacaagataattaaaaaagtagaaattttggtttggaatctactagaaaaactactccacaacacaaggtttataatttacaataaaaaaatattgtttagaatataatattcatttttaaaaatatttcttttaatgtaagatatgacgatatatcctattactgttctaagataggcaaatacattaaattatatgtgcctatttcttgaaataaaaacagattgtggatcacttcgtcagctttgtcgccttcagctaaattgtacaatattaaactatacggataaaatatatacttttgcctacgtcattttaaagtcaaacatactttgattgaactgtatggataaataatgaactatcaccaacataatccagcatgtcaccatggttactctacacataatttggtttacatcaggcaataataattcatgagaattatcatttacttctatcatcaaccagaggtacatagaaacaacaatgagagtgtatttggataatgggttaggagaggtggaattggtaaatggaaatgaatggagggatacgatgaaatggagcgagaagaatgaatggttaggattgaaacttatcctttgagagataagaaatcatatcccaaacctattacatggtctgaagtaaataagatacttgagccacagccacaaaaaaagtcatggtgaaaaaccacagagtgtgctgttactctgcagtgcaaaagaagggagtagaaaataacctgaaaatgaatcgagcggtgggtcacacaaaaagcacctgcccactgccttccccttcctcgttggcagcttcccccggcgccacctatgcctcgccgcttcaccctccactctttcccgttttgcccctcctcctgcctcttcttcctcttcctccagccaccgaactcaccaacaacgagacgactcaggggagatcaacctgctctccactactgtggactgcagtggagtccgtggtgagtgaggcacacacacgcgtccttctccggcgaacgatggggtggggtgagccgccggcgccgcagcagaggaaggcggcagggggcggcgggctgaagctgctgctgtccgtgctcctcgtcggcctcgccctgcgcctgctcgtcaacccctccgcgtacctcctcctttcgtcgtcgtcgacgacgaccaccgccgccgtcgcgctagggcaaggggacgacgcggtcctcgccggcggcggctcgctgccttccaacggtgagatgttcttgggatcgatgctgttgttgctttgctccttttcaaccgtttgtttttcttctttttttttgtttctttactttttgggttgtttctcgtgacatggaaacgcagctgaaggaaaggaagtactctagtagcagtactagtggaggagtattagtgtgacttttcgctctcaatttgatattttggcacaaattcagcatttttttgatcgaattaaggggattcggaacatgaaaagaaattgtatatatcttttttggtaactgagaattttccattgattgaacttgaagatggagggatcaccggatccttggttaaacaagggaagaaaatgctgaaatgtttattacacatgagagtaaattgtaaatattttcttcttcgataaaacgatccaatcatttctgaatgagagggttaatttctcccttcttatcatgttcgcgtgatattatagttaattactcccgatatagtttattgttcaggtgccaggtctgtggacctcagtcttgattcttgtgatttgtgtctgaccccagatgcagtttgaacaataggtccagtgtcaccttgcaatatttttgagcgagagatgactcctgatgactccagctgtaaggctttgattgatcactttcattagtttagtgaaaaaaaaatgaggttaaatcctctatggaagtgtcggtgtgggatctggagctatggaagctttccctttttaatatgccaaaagggctctctttgcgtgtaccctcaatttgttccatactactacatgtttagttacatatacttatagtattattccctttgtaatttaattaccatacatttcctgataaatgcaggaagttgtgatttattccatggtaaatgggtccctgattcatctggccctgattacactaacaacagctgccgcttcatcgagactccgcagaactgtatgacaaatggaaggcctgacagtggctatctttattggagatggaagccctatggctgcgagatgtcgcggtttgagggcgagaagtttttggaggccatgcggggaaaacattgggctcttattggtgattcaatcctccgaaatcacgttcaatcgttgctttgccttcttgctaaggtattctgtggtttatgtgatgaagtctttaatactttatagttcagaaaaaaaaatactgccatcgtgtagtaattacaagatagtatattgttgaccaatctatctctagtacttcactaataagctcaacctatgttcagtgaaatactagcaaaataagcacactggcatactttttaccagctagttctaactatactaccatttgcaattctccaggcaaatttcgtgggattgaggatgtgtcgatgattttttttatgtgaacgctgagtcagagctgaatatgtttttgttattactgaaaaacgacattaatttctgatgttggtggattagttctgcttttttgcacatgcagattttttagagcaatgctactatttatattgttaatgtgctatcagctgtgcttgcttgaatttgtagtaatagtacttatcaacaaaccagaaattcaagagaagtgaataattttataatctgatttaggttgaagagcctactcaggtctaccatgacaagacattcaaatcaaggaagtggcactttgctttgcacaacatcacagtctctcttatctgggcaccgttccttgtcgaagctgaaatatttgaggatgatgatggagtatcaacttctgagctccaactgcaccttgacattcttgactcaaactggacaaggcaatggaacagcttcgactatgtcgtgatatcgacaggccaatggttcccgaaaaccgcagtctactgggagaatggagctgtgaccggctgccactattgccaggacaagagtgtagcggaactgacttttgagtatgccttccgcaagtcactcagaaaaaccttccaattcatcacgtcctcacctcacaagccagtggtcttctacagaacatggtcaccgtcgcattttgagaatggtgagtggtccagtggcgggacttgcaagaggacagttccattcaagccaggggaaaccggcgatcgagaatcggacatgaagatgtggaggatcgagagagaagagtttgccaaggcagttgtgcacgacaggcacaacaacgccggccgtctgaagctgctcgacacatttgagctctcactgcaaaggcctgacggccaccctgggccttaccggacgtatcatcctttcgagaaggcaacatcggccaaagttcagaacgactgcctgcactggtgcttgcccggtcctattgatgcgtggaacgatataatcatgcagatgttggcaataaactgaaacctcctgaatcatctaaattttgacaaaaagtgttgattcagacctgattattatacataggtaaacttcttagcataatcaagtgccttcttttttggcgctcattgaagaatttccagtcggtaagtatcggtctcttgttgtagcctgtctgattgcggcacccatctgcagccataggaatgtcccctggccgtaattatcagttatgaacttgggttgtgttgtacaacttgagatagttgatttaaagagtcaaatataagtctcatcagctactcgtcttctgttttcagctaattgagctctgaaatgatcagtccttttataccttgacaagttgaaaattgtaccacctgtaacgtgaaaaataagataatgatgtaaaaaattggaaaccacttgtaacgtgcccatcattatacagtgtaaataaaacaagagaatgatgtagaaatattatacctgaattgcttctaacgtaaagaatagttggtaaatcgtatgaagaaaattggcatgtcatacggagcggagcaagttggatgacaaaagaaaaacaggcacatacatgctcgtgcatagtaagctcgaaatttattgaaagaaaacctcttttgtaaaggcatgatgattgcttgcgacatgctcaccgtcatgaacaaacgaacatggctttcgtacagacatacgtcctgcattggtgcactattgttgtgacgtattcggcaccgaataattcgatccaagcatacaaagaatgataaataccaaaaaaaaaaaccaaagataattgggcaacacttattagatttcagcagcatctcgtccatatttacaggatactccaaaggcttcactaaacagtaaggccacgtattcttattctgcagatactagaccaaatatacacaacaggcgaggaagatgagataagtgagcagtgtcttgcagtcaaaagtgtacaatgtgcatttagcacgatgcagaattcttcttcttgcttgccttatcttcgctttgcccattacggctaattttaaatttgcaccggtgagtagcaaggactttctgctcaaaagaaacctcaataaacaagagaacacaaaaaatgactgtgttttaagttgcactgagaagttgtggtatttgtacatattttgtcatgtacaatttcaacctaaaaataataaaactttgaagatatcattattcatatatatctattgcagactgaggtaaataatacaatgacacagaaagtacaataactagaccatatgaatgtctgatatacagaagtgttcactaaatgatgctgcgaacctcacaaagaggcatagtagggtttaacataaaatctagctgtagaccacattattttaaaacaatataaaacattcatggatcggatagtcgatcttcacaattttatagccaaattgctagtctttcaattggtttcatgaaaagcaatcaataattcaaatataattttggtgatgttttaggctttagctatatgcacatgtaggatgtttccttactctgtcaagtattgtttgctcgtgctaactgtacaaacaaatcaaatcagtgtttcttatagcttagtggtattttgtctataaaacttatcctaaaaaagggtttcacacaataccaatgttttaaaaagtggtatgcggtttcatgcggtcaccccaccttgtagcgcttatgcggcataatcagacacttaatgtggtataatcggccgcttatgcggcttaagcagtacgaggttggggcacccgttcctgtatgtggccatgtagaccttattctaaaacactgcacaaaaccataaccttaaaacaactaagtagaattaagatggtcacttgttcactaaataccaaaaatgtttaaagaaagctatttggaagcgatggattgccaaagttacagaaaacagttccctagttatgtgtgatggaccaattaccattataagcaaaattttaatcaatgctgataaatttaagtcataacttaacagaataaagtcatgaacttgttctactataaattgaaggaatctga

SEQ ID NO: 55978 - DNA, 951 bp, Oryza sativa
acgtccaaacaatatcgttaattaaactttagtactaaaatagtacaatttgatataataagaatcatactttcactcaacatttatgtaatcgaagtttagttcaaaaagaggggaagtgatggagctaatgcagatttccaactgcggcatatcctatttatccaaaatgttcaagaaaaaaatattgtctgatttaacctattggatactcttataaatctgaaaacaacatactatagctttatgtcacaaacaaaagcacaacttcataagcattagtttactagctctcttactagcagtactaataatgtaagaagatgcctaaactcctctggtcaatttaagcacgtcaaagactgaccatatcatggtcacgaaaacatactatttaaagagttgacattgcaaacctaaatggccatgagttgcataaagtaccagtggggctgtttggaaggccagaaactgcggctggccttgtttctgaggcactattcttgctggctgcagcgcaacagcaaatgaagaagccgaacagccccagtgtcgccaatatttttgcacaacacccatttgtttcacagcatccttttgttaatttgtaagtacacagaaagtagcaccctactcttccctagaactcataactaatcttaaacacaaaaaccacccaaaccatgcccaaattgtctttaccagttcttatcgaaactagctcaccagaatcacagatagtcttgctacccaaacacccccattccattccaatatgggaatatctaccagcggatcaagagctcgaactcgccattcttttcaagcaaagaaataaataactctgaaaaggcaagaatcgaaggggtttctcaccggttagccctcctcctccttggcgttggaggcgtggtgctcggcgcgggacgggagggggttggagcccttgac

SEQ ID NO: 55979 - DNA, 2972 bp, Oryza sativa
tgtccaccaaaatgccattttcgttccatttggtgaatagaaatgtttttgctcaattttattttttcccagatcaaaatacccctaacgaaggccccacttgtaatactctttgatctctcggtttcccctctccctctctctcaacgacaccgtcgggagcggagcgtggcggtagaggccggcagacggtggcgggcgtggcagagcagggcccgcagaggagtggctcgaccagccgcctcgacgctggggtgccggagtttgcgccgcggatcgccgccccctgctgccgctgccagtaatctgcgcattcgccgcggcgcctcctccgccacaggcggccttcttcacgccgccatcgctgtatcatcgaccgtacgagctcatcatcaaccgcagttgctacgagctcgagccccagctgttcgacttcctcaccggcctcttccggaaacccaccatccccatggggatcttgccgccgaccaacctcgtcaccgacgacgacgagccactgccgaccgctccgaggtcatgcaatggctcaatgcccagcctcgtcggggagcccgtcgactagtggctttgcaacctccgtcgcatctggatccatttctgtctcctgctcctccgtggtggcttgcggtggcttttggtatttcttaacctcatagataaaatccgcaagcgcacggaatataccgatgtagcacttcaccgggagtattcttaggtatcgatttccataggactataaatcaggttcatccaagtacacgaagctacgagtaggcaaaaggatagagaggtttcaccggtgagaaacagtgtctacataaagcttaactttaatcctaacgcgatacttcgggcactggccagctcgttgctgccaaatatcgctctactgcgcacccggacagggaggacttcagtgatattgagggttgtcaccacctctacacccgcctcacacctactatgggatgcggagcaaacaccgaaaattaactacctagataccgcgtctaagcagattaattacttactttaatactagctacacactaaagtaaatcactatatttttagttgattatagtgaacgataatcccgtatgctgattacgcactaactaagaaataattcttaccaagcaaactaaattacttaaaatatatttctattataatcagactaattaacagagcaaaagaaataagaagaggattgttgacaactccgaaactcctccgaattcttctacgctactctctccctaatctagtatagagcctcttataattcagctcaagcttggagtgtgtgtgaatgagggagaggagaggggtatttatagtgtggaggtgacttgagagagtggagatgctaaggaatattctaaatggaatcttcactctctcttgacaagtgtcccttcggatgacggttttcaccggtattaacagccacaaccgtcataggatgaggagtacaactgccacgccgaagttgggctagactgggccagctactggttcagccgaaccctttggttcggtcgaaccctggctagcccatccagcccagccctctctctggtgttctgacatgtgggccccactatatgttccactgaagattggccaagataaatgtatcttattgggtttgtgggctcaaaactccataggtttggatatggaagttatattctcatccttcatgtacatttcatctcaattttggtagcttgtcacctgcatacgaatatacaccaacactcgtggaaattgttagaaataaaccctatcactatgttggatgttttatatttatggtcttatgcaggtattgatggcgttaattttgtacttagcagccgtcaacagtggcggcggctgtcgctcctctgcaagccttgctccgctacgcccgccgccggccgccggccacagcccgcctcccggctactgccgctcccgacggcgtcgtcgaaagagagaggaagagaggaaagagaagggtaagagagtatgacaggtagggcctgcgtcaggggtattttggtctggaaaaaaaacaaaattgagcaaaacatttctattcacaaaaagaacgaaaatggcattttggtgaacctctcttagtttaggatgacattatagtgaatcagtttgaagtgatggcattccagcggaaccactcttttgcgatggtataatcccattttctccttaaccagggaccgaatctgattcgtatccgtaatatcgggtatctcgacccccaagtactaaaacctgtgccatttgacttcctcggtggcttaaagggtggttttgccaacgacaagtagagtatcctaatcttctttgtcatgtggggattagggtagtaatcaatagcatagacgcaatgtctaggctagaggttatctttgtttgttgtgtgctccatggattatagagataggcgacaggtggtgacatccctgtctgtcctttgtaatcctccatgctcggatacattttagagctataggccggagtctccttggcagactaggggtaaaccggtgcccgaagcaatcaatagagttttaccttaacttaattaagttaattaacccataggaattctctccatcccaagcctaccatttagttattgtccttggaagaatcatgttcttagattatacacatacgttccttgtggatacgataccctgaaatactcttgagtgaaggctacaacgttatctgtgcacttgcagattattccatggttgtaataaataccaacaaagatacacttctagcctcgaaaggcctcaataaaggacttgctgtagattgaaaaagcatctagctctactgggttttggctaattgatgacaaatgattaatggattaatacacttattgagtgtataagtagggtattagttcgatgaagagatga

SEQ ID NO: 55980 - DNA, 3215 bp, Oryza sativa
tggtaaattgatttcgctgtgaagtgtttttcaggagcgcctatttaccccctctaagcgacatgaatgtcctttcagttctaggtttgcactacgtatacgtgattgcattacatatttctcactcaagtgcaacctgccctacaatttacgtcagcatcagatattagcaccaaacgcatcaagcactttgaagtatatatatgctgccacacaaaacaatcacaagttacaacaagtcaacaacacaatacagaatgaaactagctcatttatttatgtttttccacaaaatatatgtgttgtaccagttattactgcttaggtggcttgaagtatgcataagccgcaaagaagctctgcatcatggtgagtgcgagcaggatcactgctgcggcaagggacgtggccacccatgggttgctgaagtagttgcgcaccagggcggcgcgccaccgcggccacctggaccgccggtaccgattcacctcaccgatcacgccggcgaggtagttacggtcggcagccaggtgggcctcgctgcagagccggctgaagaaccccgtggggtcccggtcgcggttcatgtggttcaccagcacgccgctgaggtgcagcagcctcatgtcctccggcgaggtgacgaggcagtccatgaagacggcgtaggcggtgacgtggccgcgcgtgtaggggtaggtctgctcgaaggcgatgaggttgcggaagagcggctcgctgtagtcgtacagctgcagctccgggatctccaggacgccgccgtggccggcgaacctgacgtcgaggaagctcgtcgcatccttcctgggccggaacgtgacgccggcctcctccagctccctggcgcatggtatccactgcgggagctcagacggcggcaccaagtgctcgctagggtcgtcgtccggcgccgcggcggcgtccggtggtggtgggaagccgacggagaggtagaagaggtgcaggaggtggtgcacatgcacatcgcggcaggagatgggcgaggagtagagcttgcgtggtcggagggagccgaatagccgcagggcaccagcgacgaggacgtcgctggtgtcgtcggcgtccgtccggagctgatggaacagcttctggacgacacagaacgggatctggttctccagaagcagcaggtcgcacgtgacgaacgaccacacccagcacctcccaaacagcacggcccggtcctcgtcgtcatcttgcccgccggtgccggaacgagaactagaggaggaagctttagctcctgattgttcttcactggcaatgcgcgcgaacttgagcaggcggcggaggatgaagcacccgtccagcagcatgatgcccaggactacatgtctctggccgacgtcgagcgcctccgcgtcaaaattgtaggacgccaggatacgtggcaggaagccgttgatggcgctcaggcaccggcgcagaagctccggtgtccgggttggctcttggagaaggtggtgcctcccgatgaggctaccgacgcagcgccatttgtacagttcgaggaccctgtagtcctcctcgcggctctgctgccttggatagcttagcaagccgatctggacggcaactgggaggtagctatagctgttaccctcctcgtccctccttttcatctcaccagggactctgtagatggttggcagccgctgctccggctgattgggcccgccatatttctcaaccaccagccttttcaaatcctgctccatactcttcacgaatccctccgatacaatattgctgcctggatttttgacatattggccattttagaaaagcttattttataagtagattatcattaaatcaacataatagtataggatttatcggttcgaatccaactgtgtcacgatggtttagatgaaaaaaaagaaacaacaacaggatatctgcaactaggtgacagaggagaggaggctgatacgtggaaccggcggataaattaaaaatttaggcggataaattaaaatgaaaatttaagagagtggtatctagatatgtgcatatttagattgggttatttgaaggctaagttccctattcgatagactaagttcctacttaaaaaaagctgtatatatccggttggatataaaggccgggtaaaaaaagtaccctcctctgaaaaaagatgtgcatattcttccaccgatatcgatcctcggcgcaggtcaggtctctaatcccctcatctcttcgtcctcagtttgttgcagccttgccggactggcgagcaactcgctaatccgtccacactaataatctctcccgtacctgatacctcgctttgcctggccacgcgcgccgtgcctcgtcctggcagctctcctctcgttcgacgccgtgtcgcgccattcctcgtcgctttcctcagcacgtcgccgattgccaggatggaggccgatgtggaacagccatagcgcaggaaaaaggccgacgagccgcgacgcctctggcggcgttcggattgagaaggtcaggaggagggtctgcagtggtggatttaacctaaaaattattttcatagattcatgagatatgagagctgaaggctctctagtttgtttagcccacgctgtcatagttatggataccacatacttaatagtacactactacaaaaataatttttctgtacgatgactcatcatttttccatgcggaccataactagtggcgtctgtaaaaatcgagggccattttcccatactgcttaagtggcccgtagggcctcttaagagggccgcatgcaaaaatgagctcatttttttcatacggctcacttaagcgcccgcatggaaaaatcgatttttctatacgggccatttaagaagccatatgcgaaaataaaatttgaaaaatttgaaaactagtgtatctcactcatatgaactccaaattgaatgtttttttcctaaatgtttctaaaatcatgctctatcatgttattgtgttcttactggtattattttggctattttttcttgtgactttgttttatcaattaaaaatttaaatttcaaaagttcaaataatattttgaagtagtaaatgattttatctgaaaaaatcatcaataacaaagttgtataactcatcaaaatctataacttctattttggttattttttcatccgagaaagtgatttgttagattgttc

SEQ ID NO: 55981 - DNA, 11171 bp, Oryza sativa
tccccgctggtcgacgacgacgggccgagcgcgctccgcaaggcgcagtcggagcgcttcgtcggcagcaagacggcatcgtccatggtgcagttcgatgtcgtcttgtagccgacgctgctctagctagtctctgcacgacacactacttacgctgtactatatagtactgttcatgtcacacctgtaaattaaattagcacgaagtaaaaattagtatcaaaatcagtcgctgatttagttgttatggaaagtagctgcaggcttgagggtcttcaagcagtgcaaacaatgggggattattgagacattgtttgttgtggtttgaacaattggatacaggaatacaggtgtggaattttgggagaggttcaaaattctgggtggaaaatttctgatttcttttatgtcggtcaagaagattttcgggacaactgtaatttgccaagtttccatgcgtgaatgatatatctgcaaaatattattgccttcatatatatgaatactatccatgacatgtataaaaacaataaattataatatatgtaattagtactaggagcttcccaagacaacacgaaattttggaatatgttgttaggtttaaaaatttagcttgaaattttcattcaaaagttttggaatttggttatcctcttctgcacctaccacccagccccccaaaaaatggtagtctagggtgcatgatgtgaaaatatgaaggcgatggagatagagacggcacaggccaaatggttccacaaaatgtgcgcgcgccgacgctccatgttgtggcagggttttgaaaatagaagcaagtagctaagcttagtagttggggaggttgctttctagtttgacatcaccagtgaggtgtgcatttgtttttgtgattcctacgtaatgtgagatactacctccatcacaaaatgtttgacgccgttgactttttaaaaatgtttgaccgttcgtcttattaaaaaaattaagtaattgttaattctttttctattatttgatttattgttaaatatacttttatgtatacatatagttttacacatatcacaaaaatttttgaataaaatgaacggtcaaatatatttaaaaaagtcaatagtgtcaaacatttagagaaggagggagtactatgcaggcagttaggggttgtggtgtttgtgctaatcttgttttatctggcgactcctccggtaatcgtcatcgccatgtttgaattcggatcacgtaactaattaaacatgtgaatgatttcatgggaaaatgatctcattgaaggatcgggatccagaccggccttgtgccggattacatttttatgaatggttccgctaaaactgtcgccacttttccggaatatataaatctcagtgatattttttgaccgtacttgcttagtataggtaggaaatgttgtgcccataatcatgtttttcatgatgaactttaagcttctctctctctctctctctctctctttatctctcttgttttttttcgtttctcttatgtgctaatttgtaccataatacattttgttcttaagtaggtcatcaatcatttagagtcttagttctcatacattgagttttacaacaaaaaattgcattgttaaatttgaaattcacaggggcggtggccgcaacgtcaccaagctcatggcggaagcattgagggcgacaatggggaaggtaggagctaaaggtgatatataggggtgtggggaggacggtggaggtggaggtggaggtggagacgcattagaggaggaggtgggagatagactgaggtcatcggagttggagtcggagggggttaggagatggatggatggccaacgattggagatctggagaactggggctcaaccggcagtgggtggaggagaggaggaggacctgctgttgcacggcacccttaaggccaccatcctcggtggaccacctcttcaacccaacccgcgccactagtggtgccccctaggatcttccgcaatgtcagttgattgcatccatgggagattccattttcttcaagcttaaaattgaattagttttcttaacagtagactttgacaagggggtgacatggctatactcgatgatcaccctcggccaggcatgactgggggcaaatgtgggtcatcaacaacaaggtggtgaacccacggtggtacgtacgaggagttccacatctactcagcccacttcgctaccaacatcgtattctccgtcaatgctgcacagcccatcggtgccacgctcatcgcctgcacctacctccccattgagctcctgtccagccaggacattgagcgccatcccgacatcctcgatgctagcaggaagaggatctcatatgggtcgacaatacatgtccagctacagttccacgtctgaccttctcctcattgacatagatgctagggcaatggctggacgtcgatcgaaggggagaagataggagaaagaggggcagaggaggaagaagggaaatttcaatgacaagtgagtcccattttttttgtaattgtagcatgtaacgtgagtgtgacgtcagccaaaaccgccatctataaccaccgagagactcaatttgcactggttttagaagatgaggttgcgttatatctggtttgtgtggttgagggatataattgaaactcgacccctatttgatggacctaaagtggatttttccattttaaaggaataagttcactttaaatcccttaatttatcaccaagtttgaaattcgtctctaaactataatgccaggtataacacacccttaatgtgcgaaactggtgtactcgaggtcccatagtaatatattgcccgggttgatgtagcggctgagttagtgtgggacccacatgctagggcaatttagtctggattaaaaaataaaaattagtggactccacatgtcagtgacacatcctctccttctctctatttctctccctttttcttggtggggttggtgggaacagggtgtcggtggcgtgggagcaggcactgtatgtggcacgcgagggcatagggagtgggcagcggcatggaggatgaagtcggcatcggtgatgaaggtcgtcatcacctagggagcccttggccatcgtgtgcgcttgcacctgcctcccctcctagacagccctcctagcgacgacgaggtcgagaacccagccgtagtgctccatgggagggtccaaccccgctaccaagcgggtggtgagtaggtggaggacctcccgcaggtcgccttcccttaagaatgacaacatctgccactggagtgtgtttggggatcgaatcgtctaagcagctagaatccgccctcatcaccgaggagttgcgatagaagatcagcagcaagggtgccgttgttccgagaagatggacatgtcacgagataaggccatcatgggggccctctacgtcgagatctcgcctgcccctccgcaccagccctcgcgactcatggatggtgtaggcactagacaacaggcatcgacgtcgatggccgagtccaccgaggccatccccaacctcgtatgtgccacctgtggcaagtcctgccgctcccagaccatgagatccccttgcccgccccccccccatccatggttcccaccagtagcagccgctcaatccactgccaccccttttccatgacaaggtgtgcccgtgcaggaccaagcctcgctcgcacggcctcacccgaccaccgccaccgcacaaatcgaagctggaccaacttcggttgctttccaccgaccatgaacaccaccttccagggaacacctccgcctcatcagtgctgccaccactaccgcagttgcttgctggctcatcaacactgccctccatagtcgccgcttacatcactagatcgcgatttcgctcctttcttcaggtccctcgggcagaacagcggcggtgcctgcgcggaaagggagagagaggaggagggagagaaacagggaatgagaggggggtgatgacgtgggccccactacaatttcttttaaccgaacactcactgacatgtgggtcccatgaattttttctgacttgaagtaccaagtcaacgccacgtcagtcaaaaaacagtccaaaataccttaggaccttatttgcactggttttgagagttgagggacgcgccatatttggtattacgattcactaacgaattttagactccacaacaataaggggcctaatgtgaacttattcctattttaaaacttgctgcaactttcaatcccgtcgaaaagaaaaagcccacagaaccacgcgctcgttagcctcctcgttccgacggcccatgtgatgcacatatggcccatattgcctgggaaggtgacactatcacagcggcgaggcccactaaactcgagctcagcctctctcgctcgtcacctctcttctctctccgcatctcccgtctcgctcacgccgccggtcgccgccggcagcctcaatctccgctggcccttcgtcggctgaaggatcaaggattcaaggccctgaggtggtatggcgagccaggagaagcccacgccgcctcagcatccgcctccgcccccaccggcgccggaggtcgcgcctcgtgtgcgcgggttcggacgggcccaccgggcgacggcggaggtggttaccctaacccgccggacgcggcgatccccgacgccgcgacgctgcgggagcagtggctgttcgcggtgcggcagtacagcaggtggtactcccacgcctggggcaccgccatcctcgccggcgccgccttcttcggactcggctggctcgtcaagggctccaaccccctcccgtcccgcgctgagccccacgcctccaacgccaaggaggagggcttaccggtgagaaccccctctgattcttgccttttcagagttatttatttctttgcttgaaaataatggcgagttcgagttcttgatccgctggttgatattcccatattggaatggaatggggtgttggatagcaagactatatatgattctgctgagttagtttcgatatgattggactggtaaagacaaaaattggtggttttttgtgtttaagatgagtaatgagttctagggaagagtggggttgctactttctgcatacttgcaaattgacaaaaggatgctgtgaaacgcatgggtgtcgtgaaaaaatattggcgacactagtactttatgcagctcatgaccatttaggtttgcaatgtcaactccttaaatctggttgttagcttccaaaagttccatattggaaatgccaacattgaatttggagaactatctgacaagagggatgagctatagaaacattgacctttttatataatgttgaatagtagaacatgaacaagtccagtcctcttgtataaagttgctaccagttgcttcagattcctttagtttatagtagaacaagttaagaactttgttctgttaagtttcgacttaaatttatcagcattgattaaatttttgcttacaatggtaattggtccgtcacacataactagagaactgttttttgtaactttggcaatccatcgcttccaaatagctttgtttaaacatttttggtatttagtgaacaagtgagcatcttaattctacatagttgttttaagcgttatggtttcgtgcaatgttttagaataaggtctacaaggccgcatacaaggaacgggtgccccaaccttgtaccgcttaagccgcataagcggctgattgtaccacataagtgtccaatcatgccacataagcgctacaaggtgggggtgaccgcatgaaactgcatactgctttttaaaatattgggtattgtgtgaaacccttttttagataagttttatagacaaaataccactaagctataagaaacactgatttgatttgtttgtacagttagcaagagcaaacaatacttggaaacatcctacatgtgcatataactaaagccgaaaacatcaccaaaattagatttgaattgttgattgcttttcatcaaaccaattgaaagactagcaattttgctataaaattttgaagatcgattatccgatccatgcatgttttatattttataaactcatttaatgaacagttctgtatatcagacattcatatggtatagttattgtactttctgtgtcattgtattgtttacctcagtctgcaatagatatgtatgaataatgatatgtgttatttgtaggttgaaatcgtacatgacaaaatatgtacaaatgccactacttttcattcaacttaaaacacaaagtcatttttggtgttcctcttgtttatggaagtttcttttgagcagaaagtccttgcaggcgagccctccccgcgtgtgagccgcagccgccgagcttgtggagctccatctcgctcgctactgccgccatccacctgagggtgagaaagagagggtaaagaggaaggagacacgtgggcctaaaatttatttttgttgttttactccactgacatgtgggtcccatttaaggcttggtgccacgtggatgaagaccaagtcaacctgccacgtgggataaaaccgctcgaggagtcgatttgcaatggttttgtaagttggggatgggttatacctggttttgcaatcgagggatgtgattcaaccagggacatgagctgagggaagcaaaatagacttattcattgatattacacaacgaaccaagaaactatgcatgcaatacagggtacattatcttagtacatcacatgaatgatttccaacagatagagtgactggggagatatgtgatggctacgatgttcactgatcatctttgaggtgagaagggagcattttatcttcggccaatctttcgagttgaagggcgggacggctgggatggatgctgacggagtgcaacaatgccgcctccgcctccttgacgtcttcttctttggctaagtggcagagcacaaaaacctttactgtgcgaagagaactcgggaggtgctccaagccaatgtcaaaagcaattttcctgtccttgaagaagtgcacgtccaagctgaagtgaagtaattccaggtatggcatgactgagacaggtgttgtgacggcagcactagcagcaggaggtggtacaaaccggatggaggtcgtggccatcgtgcagaatctcaacttgcggaacaacagggtgtcatgaatcccaattcttataattgcattccccatcgcaaatagatcgagtctgcggagcattcgcagcctgccaaggatttccatgtccgcctgtcgcaaaacctgcaacgacagggacaggttgctgaggtttggcagaagtgacggattaatccacggcggcaggctggtgaaggtcaaacacctcaggcacaggaactggaggcattgaggagtgacgaatccttgctcccacggcacacactgccccaccgctgcccaacggtcaaaggcgtgcattttctgtatcttgggcagacttcctagagactcgataatgtccgttgcgggggcaccctcgaactgagtacagagcaccctcagatcctcgagcttgcccagctccttcacaaactgccctgcagctgcagcatcaggccacatccacaactcttgcagggacgtcaggttcccgatccaatccggcacccttgttttaatatcggcttgtaggcacagcaactgtgtcaacttgcccacgctcgacggcacttgctctatgccagtcccccacagatccagcgtctctaggaacctcagacgtcccgctattccatttgggagctcagaaagaggtgtgtacgtcagtgcaaggtatcgtaggtgaagtaaactgccaatatgctccaggccgtgaaggtcctgcaatgattcacaattttgcagtgccagtacacgcacagcttcaaatttcgccggtgttggcagaacatctatgtatgacaaaccattggcactaaatgaccggattgtcacttgtgactgtgccgttcccaggttcaccactgggggtaatccattcttgctgcttaggatggctatccttcgaccatagccctggtgagatgtgttgtattgttctatacccaatacggtgacaaagttttcactgcttgacaatgaccggatcagaccgagcaccatgtcatgaacacgacagcctagtatgtagtcttcattctctgcctctattggcatgatcatacgtcgttttacaagctcgttgaagtaaccctctcacacctcatataagtctcttccttcttccttacagacaaaaccttcacctatccacctccatatcaatgtttgtttaccaattaaataatcctctggaaatgcgctcaagtacaataagcatgttcttagatgataaggcaaatgatagaaactaagagacaatatcttcatagtattatccacatgccggttgtcttttgcgccaagagcaattgaccgatacaactcagaccagtcctcccttggtttactctccaacaaactagacgttgtaacaatggccaatggtaccccttcacatttcctcaaaatttcatcacaaacctcttccaaatcataatcatcatcggggcattggtcttcaccacttaatattcttctatgcaataaccttctcgagtcaacatcagaaaggtgttttatttcataaacatgaccgacttcctcagcaatttcagaaatacgagtagttatgatcactctacttccacaactactgtctcccaggacttttgcaatcatgtcccaagcatcgaatttccaaatgtcatcaataacaatgatgtacctatcaagaaaacagtgcaagagtttagcaatgtataaatacacgttttgctcctataaatacaagaaacgtgccaataacgggaaaatggaaacaaacaaactggtttcatctctgaaccctgatcaacaaatgcatcatcataacgtatacacgagtgatttcatgagcaatactataatgttgtaaatatgtacaatgttatgatgatgcttagttttttttactatagttaaattaagtatctgttctatcagaccttaaatacaattttgtagtacatgcttttgtcaccacttatattagtttgagagacaaagtggaatttttttatgatgattgttgaaagtagtttgcccttcaggacaacccaaaaatcagattgcctatccattcatagatcaacaagccaacatttaaaatatacggagtagttcaataccactccacctcaaaatataaggtctacaaggtttttacacagtccctaatgtaaaagtttgggcgttaatttcttacatgatatattatcaacaactaccagattaacatcatacgaaagtacttcaaagtacaaatctattgatgtcaaatatcgtgaaactaaagaacatatatattgagagtaatttttactagtcaaaagttgaaaatgccgacttctcttaaacaatgattccttataatttggcacatactaggtcgtacatgcttttgtcaccatttattagtttgagatataattaaagagttatgtttgttgatgatcgaattagttttccttcagttattgagaaacccctaccaataacctccaagcttgcgaatagagtacttaattaccagctaataaaagttaacgaaatggaatacaaaaacattttgccgcaatttctatagtaaaaactaaagagaaaagaagtttatacaacaaaaacattatctagaggtgatgtttaaatctcctttaaaatcaagatttatataccaagtaaaacaaaattcaggatttctacagagcagagacactttttagaggaatttcaaaaatttcctagaatacatttacccaaagcacatgctcttctatttattcctatagaggcatcattttggcactctaaaatttgctcgtgcttgatttatagtaccatggtatgaaagtataatatgcgagggtaattagaataagaatcatgagcgcacctcttgttttcaaggaagtcgtagacctcgttcatgagtaaccttacatccttttttgtgctatggatattgtcgaacttttccttgtcaagatcatttagaacgtccatgaagaccctcttcaagtcttgattctggccaactggcacaaatgccgagcattggaatttccccttaacactgtcgtacactgctctggagagagtggttttgcccattcccccggatccaacaatggaaacttttatcatcttccccaagggcaagttgtcaccctccagggaaaggatctttatgatgtcattccttgtgccatcaataccaacaagctttgccgcatctgtattcgataacaggatgcgaggatcatgggtggacaattgtgtggcagctaggttagcctgaagatcagaggctatgtatctttcacgcgccttggacacctcctctagtttggtgttgatgtcttggacgacgccagatatctgatggcgaaccttgatcttggtgaacaagccgcacatcatgtgcacaagccgttcgaggcaaccggggttggcaggcacactgccatctacacgcaccagaaaggcgtcgatgacgtcctccatgtcatacgacagctcccggactttgcttgcccaaatcctgacctgctcatcaagcaggtcgggatgcatgctgccaaccttgcgaagggcagcatgcatgtcctcgagctcactcttgagaaaattgattttctccctaacgcccgtttgcagcttgtactcctctttgagcagctcggtcagtttggggacaaggctccccatcgcctcagccaccagcgccatggctcgctcaacttgctctaggtgtgcgtatcagtagtgtatggtacgctcggtgggatggcctgctgcctgcagtgggggagtagaggtatatacatttttcttgcatttaaaccctagctggcctgggaacgaacgctgcgtgcacctcgatgaaggtcggaagctgtgtcatcgatccgttacttgcgggtggggcacgtgcaccaaccggccagctgctctcagctcatcacgaattcatcgatatgcatgtcagaaag

SEQ ID NO: 55982 - DNA, 1892 bp, Oryza sativa
gtcagaaagtcagatcatcacgatccagctgctcatcagcttcctttcttttcttgacgtactaaaaaaacgaaaccaagtcttaaacaaatatcatcgtgatccagctgcttagcttcctttctttcttttcagaaaccaagtcttaactaaaggaagtcagatcatcacgatccaagtgttcagattccttattaattttcttgactgaaaatcacaagttatgtttttccttttcttcttgactaaaactctgaagtcttttggttaataaattgttgccgttaatcctacaataaattaggtttggttactcgtgttcgatcctacacaatattattgcaagtttttagtttattaagccttcagagtttgtaggatcaacgacaataatttatttacacaatattaacgaacacaagtaaccaagcctactatacaagcgtgaatggtagattacgtccgcggaagtcaaattatcgaactttgagagataaaaacataccataacctcaaaaactaatggaatagtatggtggtctatccaacctactagggttagtttgaccaaggcctggcctatctgactgcaagtcctctcacggtctagccatctgcgtggaaatagcaagacagtacttctataaaaacatgatttctccaataccaaccgttggatcgtgctttaatcttcataaaaaaatagacaaaccaaggaacaactccaccaaacagattttcaaacaaataaacagtttcagtgtttctaataaacagtttaagagaaaacaccctgaaagtcagttgtgttagaatttcagtaaatcttaactaaacctaaaacttaagcaaattcgaatctagcaagagccaatcaataaaaccttctaggtctgatcaatgaattattaaaatggttttagatgcgttaacttgaacaaaattgcagcaaaacaaacaatcacaagtgaatatcaaaaccgaacaataacgtgaaacttacaaaactggaagagatcgtcaatgccttaatgattgtatatgatctttaatgcttaagtatttgttcacagggtgcagccacaacaccctcataagtttctcacaaaaccgtaattcaaatgctctcgactcagtaatctctcaaatttaacttaccctcaagacatagcctccctatctatttatacaaaaacttctgactcaaagtaaaactcctagttaggactcaaacactcaatttccaaactttttacagtttaccaattgtcactctttatttctctatcaaacacgcagccacagccagcaacagaaatcccggctctggatcggacacctctggacgatcgacacatgtccctagcatcttgtttctatttcacatgattagttgctaacgtttcaaaagatttgaaattttagcaccattgagaacatgttggttttcatcatctcactagaattagtggttcggatcatgttcgtggttttcatcacctctgaacgatctttatttggtttgttcatcgtgttgtcatgttaaaatgtttgcttcttcacatgcttctgatacttctgtgatgaagaatacaacaataggtttgttgacggaaaacacggcggcctgggagatctgcttagctcctgtataggtccaaggctgtggggatccctgttggtatttcttaacgacattactagaaatataattttcagcaatggcgcagaaatacttctggtatattatgtttacagagtttatgcgcaagcgcacggatataccattgtagcatttcacccgagagtattccaagggtatcgtatttattttatcccgtgggaagatcatgtagagagaactcaactaataattaaggggatccactagt

SEQ ID NO: 55983 - DNA, 1387 bp, Oryza sativa
cgagggtggcaacgagaggctcagcacctccgtcccagccgccccgaggcagcggatgatcacgtgcgacgaggtcccggtcaaggaggttgccctgggcgacggcccgtccaagaccacacgaatcggtggtcttctggacggcaaataggaagacgcgcttgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcctccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgcactactcgaatttctttgggtagccagataggacgcaatgttgaggcctatgttgatgacttggttgtgaagacgcgcaaccaagagaccttactctcggatctagcggaaactttcgaaagtctccgctccgcccgcataaaactgaaccccgacaagtgcgtgttcggtgtgcctgcgggcaagcttctcgggttcttggtctctgcccgaggcatcgaggccaaccccgagaagatacgagctatagagcggatgcgcccccccagcaagcttagggatgtgcaatgcgtcaccggctgcatggctgccctaagtcggttcatatcgaggctgggagagaaggcgctacccctatttaagctcctcaaacgctccgggccgtttatctggacggaggaggctgagcgggccttcactcagttgaaggcgtacctcagttctcccccagtcctggtcgacccggagccagatgagccgctgctactttacctggcggcaaccccgcaggtggtcagcgcggcgttggtcttggagcgcgacgaggacaaccctcactccgcgcatccccaccctgtgtcgactcgacccgggagagagcagggaggagaggcccccgagtcgaacggcggcccgaggcccccgacggccggagttggccctccgccagcttgtccgacggtgtcaggcacccccgacccc

SEQ ID NO: 55984 - DNA, 6456 bp, Oryza sativa
gcgcatcgagtcacggtggttacgtcttaccccctcggccaaatcttgcataaccgagagggtactggacgggtggtgaaatgggcaatcgaactctctgagttcgatttacactttgaaccacgccacgcgatcaagagccaggccctcgccgactttgtggcagagtggaccccggcccctgagcccatctccgcccccgaggccagctcgggcccctcgcagctgcctcacaccgcctactgggtgatgcagttcgacggctccttgtctcttcaaggcgccggtgcgggggtcacgttgacctcgccgagcggagacgtcctcagatacctggtccgcctcgattttcgggcgaccaacaatatggcggagtacgagggactccttgcgggactcagagtggcagctggactggagatccgccgcctcctggtgttaggcgactcctagttggtcgtcaaccaggtctccaaggagtaccagtgctctgacccgcagatggacacttacgtgcaccaagtgcggcgtatggagcgccattttgacgggatagagcttcggcacgtgcccagacgggataacgcggtcgccgacgaactctcgaggctcgcttcctcgcgagcccagaccccaccgggcgcctttgacgaaaggcttgcccagccgtcggcgcggcccgaccccctaggggagacgacgcgcctgaacggcccccgaggcccgtcggagtccaggcctcgggacccgaggggagcgctcccagctcccctagattgattgcttggatcgctgagatccagacatacctcacagataagactctccaagcgctacgtgctggtggaagggaccctctatcggcgcgcggctaacggagtcctcctgaagtgcattcctcgggaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcgggttcgagtatctgtatgtcgctgtcgacaagttcactaagtggcccgaggcttacccggtcatcaagatcgataagcactccgcgcttaaattcatcaggggcatcactgctcggtttggggtgcctaaccgtatcattacggataacggcacccagttcactagtgagctcttcggcgactactgcgaagatatgggcatcaagctctgcttcgcctcccccgcccaccccagaagcaatggccaagtggagcgcgccaacacagaaatcctcaagggcctcaaaaccaaaaccttcaacatcctcaagaagcacagcgactcgtggatcgaggagttgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagtttcgcagagatgacctcgactacttggaagagcgaaggtggcgcgcggccctccgagccgcgcgctaccagcagagcctgcggcgctaccatcagcgccacgtccgggcccgatcactctgcatcgacgacctcgtcctacgccgcgtccaaacgcgtgctggactgagcaagctctcaccaatatgggagggtccgtatcgagtgatcggcgtcccccggccgggctccgttcggctggccacgggtgacggcacagagctgcctaatccgtggaacatcgaacaccttcgtcgcttctacccctagtgggggtcgggtgtcaggtctcgggctcgggccaaccccgcgcccccccaggcgtgcagggttggccgggggctaccacatgcatatccttatcttttttctcttccgtatttcaataaaagcattttcgatttcctgaggactgtgtctgtgccatcgtttccttttgaagaatcttggcttgaattagcatgctcgtgcccgaccctgccctcagtggcccgggccggctaaaatcgccaaacggggcccagaaccgagccgtgccccggggcgtggtgaactccggggggggcatcggcaaaggcccacaatcgggtcatccataaccctcggtcaccacgttcctggcctggccagtctcgacacgcggatctccccaggcactagccccgacccgcgccgcatgaggttgggacctaggcacgagccctcgttcaagccaagacacagaaggaccgcggcacagaccatcctcatctcatacacacagcaaatgaaattgacacaaaaatttcctctttatttgattgcagattgaattagtttatacaggaagggggcccgaaggcctcagaagaagaaagaaaaagctatttaagattggcgggggcctgggggctcacgccaatgcgcccgagtcgccggcctcatcgtcgctgtcatccgcaccaccgtcaccgccctcctcgtcggagtcgagggcgaacgcgagccgaggggccgtaccctcgaagctgtggatgatatggtcggcggcgtcccgcccggcgtgcgcgcgccgcctctgtctcccggacggactcctcggcccggcggagtctggcctcctcccaaacggcttcctcagcctggcgagcccggacggtctgcagcttctcgccggtcagcttcccgcctccgggcctccgcggttgccgtctcctcggcctcagaccggccggacttggaatggcgggaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttgggggggagatgaggtttccccggcatggttcggtcccccccatcttgcggagccgcttcttttttcgctccccctcgggctgcgacgtcggcacagcaccctccgagcgcctgctgctggcacgcaccgccccgccccctcggggaggagatggggagggggtatcctcctgtttcctcttcccccgggcgtcgacagggcggctgccccccgggcccccgtcacggggcccagaagcacgaccccctcccggggtagattgttcccccctgcggctcccgcccgcgccatcgtggcctcgaggagcccgctcccctgacgccccgaccgcctgcatgatggtcaggatgttggcgcgctctggaccgctgcagagggggaggacaccttggggaatgagggatgcctccacggagctgagattcagcacccgttggatcaccatcttgaagtcttcagggacccagtcccatttgaccccctggtgggtcctcatgtagtcctcggacccggtgtactcccaggcgccccgggcgcgccgctggagcggcgcgatccggcgacgaaggtaatcgccgtacaccatggcccccgtgagcccctgggatcgcagaccagccaggcggtcaagaacggcgtcgtagccgtctcccagatctaccggcacccgccagctggaggcctgcgccgggggctggctcggaagtcggaggcgcgcttcgtcggcgagaggggtgtagaaccagtcgctcttccagtcgtcccacttcttgcgaagaacgcagggaatgtagcggttcagcaccggcccccgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattacagcgttgggggtggggtgcgccatctggagatcataaagctccagaacatccatgaagaaagaagagaatggcgggaccagccctgccattgcgaaggaaaggaagaatacggaccgccccgggtagtgtggcgccgggcatccctcgcccagcgcaaccacctcccggccggtggcagattccggcatgaatcggcgcggcagcccggcctgcctctcgctcacgatgcgagaaggcggcagcacgctaccgtcgagcggtgcggagccccgtgccatgacgccggcggaggaggggcttgagagcgagtgagtgcggcgagggtagggcacaggaaacgagaagttagagcgcaagcggcgaaggcaaggggaataatggcgagaggaaggaaacgaatctcttcctcggcgtctttatacccttgccaacgctatgcccggctcctcgcttcccgcgcccactatctcaccccctcgtttctcgcacccactcctccactaatcccgctcgcccgtttgcggcgcacgaggcggatgtgcggccgtggcggtcgagatgggacatatcgtgcgcgcgttaactacgctcgccgaccgatgcaccatcatcacatctccaggcgaaacgaaccggctcgtcccgattcgcgcgctactcaagtaatgtagcggtcttgaagaaagccgctcattattgtcggtcggttttcccttgccgatgcgcgcgatttgcgaccactggattcctgcccgcctgtagagaccggccccacctatcaccaggcctaaggagtggcgtcacgcccgagcgctttctcgaggagggcgatcgccctggcataacgccaggggctacagtcggtgacatgggaccgggggtatcttgactagatgttttggggcagccgcggtcacccacgtggcctgaccccctcgggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagtgccccacgccgcatttaatgcagcgcagcacactcgttcggtccgtgacaggtcacagtgtgtgaccggtcacagaccggtcagatcgcgggttaggtggcaacaagcggcctttcgcacgcctcgccccgtcccgtcggaatgatgagagcctctaggcactcgtccctagccggagccgacgtgctaactcctggagtcagcacgtcagtcccggctagattcataccaggcttcatcgcaaccattacaaggaagtcattttatgaagaagggctgacgtgtggcatgctaaactgacgtgtggcatgctaaactgacacgtggtagacaagaatgaccggtttgtgactggtctgacgccggtcacgtcatcggcagacaaccgtgctcccacgttacgcctgcttccggccgagtggaggtaggtatggcccatcccatcggagggtcattcggacagcagccatggcaaatctccgcccattaatgagggagtaacagggagatccccggtgtcaggcgagtgatgacgctgggcctcactcaaagacaagctgtgatttagcttccaggcgaaggcgcaagccagtttttttttggaagatagggtgagtccccacccaaaagaagagtaggtagaagtggtgtatgtggtatccccttgagatataaaaggaggaccttgcccactaaggaggaaaagggaaaaaaagaagaaaaaaggaaaaaaaggagaggaagaaaaggagagaaggagaaggtggagaacacctgagctggtagaggagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacactccacagatcgagggcttagaacctcacctagtgcccccggccgaaccggcaaaggggggcccgcgcggtctcccggtgaggagccccacgctccgtcatctggcgcgccaggtagggggcgcgcgtgtctttctaagccctcgtcctctttcgtgtgcgccaagcttctcccgctcagcccaatagccgaacgggcagtggcgcacagcctctctccgagcgctagcggtgacgacggggagcagaacccgcgccgtcgagctcgtactccaccgcccccctctcgccaaagtcttaggcgggaggaggcgctcgagggggtcgaaagatcc

SEQ ID NO: 55985 - DNA, 5942 bp, Oryza sativa
cgaaacactccacagatcgagggcttagaacctcacctagtgcccccggccgaaccggcaaaggggggcccgcgcggtctcccggtgaggagccccacgctccgtcagttcatcttattaaaaacttttgtgaaatgtgtcaaactatatgtatatataaaagtatatttaacaataaatcaaatgatagaaaaagaattaataattacttaattttttgaacaagatgaatggttaaacatttttaaaaaagtcaacggcgtcaaacattttggaatggggggagtaggaaacattaaaagtatcttccgcaacctaaaagatacaacaacacccttatctcctctctctgtacctagctgttgcgtagcctcgcgtagtggctatcaaatctgtcttagaacgcaccaattttggctcgtcaatgcaagggccacctttgcctacccatgatgatctattggaggtcactaggccctctccctatatctgggatttgtgcctcttccagctcctcacgtagcctagatatctacacctccgccatcggctagatctggttggtaaatcggttagatttgtgtctctttgcttggtattggtcactccatcggcagcattaattgcatgatgaacatgcttggaattggtcgctccgtcatctacattgtcaaggctagaagggaacacaataggcggagaaaagagggagggagggagtgtggacgtctgattttcttttcacttaatattagatactcgatggaaagcgttatgaaaagtacatattaataagagaaaagataaagtttacatgtaaatcgtgctcagaatgaattatagtggtagcaatggattaacatagttttgtaaaaaaaaaaggaattgcatttgtggaaaataacaagtgctttatatataaagagaaaaaaagatccaaacaaagtttttaaaatctgctttcatcctccgaagcaagcacttaatagtttaccttgcgcgctgattttatagtaaggtttgaaaaagtttccgtttaccctaggaagatatagttaggtccattgaattcggtggtgatcgagttaactaatttctttgtcctccctgagactcgccgtgcgcttgttgtggtctcctgctagcagctaataagcaccatggacctgtctctgatgacttaggcactgtctataaatacaccatcaccatccccacactcctcgctcgcctgcctctctgttcttaattagctagttacctccaaatcaatccaatctcaattcatatatatgcgatcgatcgatcgaacaagcaagtaatcgtcagtagtcctagctagagagacataaatatctagctcaattggctaattacgtgcccaactcaactgcaattcagttcatccgatccagcacagaaattagctataagtaagggccggcgccgccggcaagaagaagtaaagaatatgggggccggcgaggtggtgcaggggctgaagccggtggcggcgatggtggtggtgcaggtggtgttcgccggagtgaacatattctacaagctggcggtggtgtgcgacggcatggacatgcgcgtcctcgtcgcctaccgctacctcttcgcctccgccgtcctcgccccgctcgcctacttcgtcgagaggtccctccctaatataattccctcttctcttctcttctcttcttttcttgagactattattgatcgagttgtttgcattatacaatatatttctacaacttcttcaattcaaagataccagtatttctttattatttttcctaaaattaagtatctccctttctgtataacatcacttgaataattatttttttttgttttccttcacgaccgccccatgcatgaattgaatgaatgcaagttttattctgtggcgaaaattaattaaaccatcagccttttgctgcgaataaaaatcaatggcccagctcactcatcctagctttttctctgcctacatatatatgcatgttttattttaaataatttgtttattctgtggttagtcaattactgaaacaatagcatatatgcaatctgttaattttaggtatgtgtgtgcgtgatgcaggaagaacagaacaaagatgacgtggagagtgctgatgctgtcgttcgtctgcggactctccgggtaattgtttttattcaatcacgctgactgtactaaagtactaacatgcagttaattagctacatatatatagtactcctactagaatttcacttaactatatagcgatacccaattcatcgagataattaggcgttaattagctttcaatttgaatgcccatgctgcttaattagctactactccagctggctatatatactcgaggtcaatggaggctaagcatgtgtgtttttggtcggtgggcccgtccgtcacgaggtgcttgccgatgccggctgacaaaaacgtttggctgcctcaccaccatcctttactctacatatatagtacgttgcttatatattttctctgcataaaaaaaaaaagcaatcaagcatcgtctaaagcctaaagatagatggatggatggatggcgcacatgtacatgacagaagcggataaccacttagttattggacaacacaaattaaccacaagcttaattagctactacctccagtttgaagttcaaactaattttaccttgttaattaatgccatatatatgctaccacgtactactagcagtagcagctggtacgtaccttcctgtgtttgaaggtaagcgttaagtgtttgtgttgcacacgtcgatcggtcttcactttttccttgcttcttttgcactttagtttccactatcatatactgctaatggaaattccatccaacacactgcatgctttctttaattttgacccttaattgatctctaattaatcaaaaccattagaagtaacgtgacgttggcagcatatatatatatacagccacgcacgcagctgtgcacacatcgatgctgacgatggcgtacgccctagctaagttaactgactagtaggagtaggttgcacacttctaggaatgctaatccattcacccacgtacgcgcgcggtgtccgtacgtatgtacatacgtatcacacggacctcgatcgatctgatacgtatacgtacgtacgtgtataattagctacgtacatacctagtggaggaatacgtgtcaccgagcttcaattctcggtgtcagtgcctgctgacgtgtagttgaattaatttgtggtcgatctggtgtgcatgcatgctgacgtgtaaggtaattacgtacgtgcagggggtcgctggcgcagaacctgtacatctcggggatgaagctgacgtcggccaccttcgccaccgccatgaccaacctcatcccggccgtcaccttcgtcctcgccgtcctctgccgctacgagcgcctcgccatccgcaccgtcgccggccaggccaaggtcgccggcacgctgctcggggtcggcggcgccatgctgctcaccttgtacaagggcgccgagctcaacccctggcacacccacctcgacctcgtcgccgccctggaggcgcgccaccccgccgccgccgccgccaccgggaataacgaccgcgtgatcatggggtcgatgctggtggtgggcagctgcgtgttctacgcggtgtggctgatcctgcaggcgaagctgagccgcgagtacccgttccactacaccagcacggcgctgatgtgcgtgatgagcggcgcgcagtcggcggcgttcgcgctgttggtggacagggagcccgcgcggtggcggctggggctggacatccggctgctgtcggtggtctactccggcgtgctggcctccggcgtgatgctggtggtgctgtcgtggtgcgtgaagcggcgcggaccgctgttcgcgtcggtgttcaacccgctgatgctggtggtggtggccgtgctggggtccctcctgctcgacgagaagtatgcacgtcggcaccctgctcggcgccgccctcatcgtcgtcggcctctacgccgtgctctggggcaagggacgcgagaccgccctcgaggccgccaaggtcggcgacgacaacgataaccaccacatccacgtcgtcgtcgtcgtgccgccggaacaagcgcagccgcagccgcaccaacaagcggaagctgatgctgatgccacgacgacggcatgcgaacaaccatcggattcggaccgggcgaatattgcatcctctttacgacacagccatagatacttccatcgttcttgcgggttttaattaattaattactctagctagctcaggctcagctagctgctaattaattaactcgcacgtacgtacggcctgcttaatccatgatctctgttcgagggtaactaattaattaattaatcagcgcgagtacgtagaaaccaattaaccaatcaacaagaaacaaacaaacgagagcggtcgcgatcaacaagctatcgatcgaccgtgcgtacgtaggatatgcatgtatggtaggtaggagaggagattaaatatattgttgctctatctctgatcattaatatatacgtacgtacacatgcatgaacactacttctccaatttctgccaaattcaaattgtaaacttgcaatgtaacccggccagagtggggtgccccttcttcttgagttgttattcatcgccatcggattggcacaacaagtaggcagaggagaatattggcaagggaaagaagatgggttgggctacgtaccggaaagaattgctttcgattccgaccagttaatgggctacttttggtctcgggtatatcatgggctgagctgggctgatttaaatcatggcagagttgggctgggcctaaaaccaagtagtcactcgtcacaccctcaccattcaccaaccattgattcgttcgtccattgatagtttggtgataccgcggcgatggcgacgacgactcggacaaaatatgcaaacaagtataattccgtgcgtgtcaacgtcatgagcaacgaacgaattaaaggatgatatggatgcggagcagccggcgtcacacatactacgtacgtacccagggcagctatagctgttgatttctcaaacggttttggttttgaccatatatacaagctgtcaggttgatttctatccattcatcacccaagctgtctgcataaatgattcacttacgtgccgacgttttcttcttaaagatacgctcgatctatcccaaacgacaaacacaacgtatttctctgcacaaaaataaattaatttattaatatcttttttttagataaaattaatttattaatagctagctgctcctcctcatgaaacacatacatatacatgtatgatgattctaataaagacgacaaattaagctgtcttattcccagccttccctagttcagttcactccaagctaaaaaagtttaatccactctaaggccccgtttaaaatagctaagattgatggatcgatgctttgtttttcctttgattagagttatatatagtattgcacgcggtaagttacgagtgttttgtaaatctagagcacgtggaagagtgaataatctagtttttatgatagttatttaagaacgaatttgctagaaaactttcgcaatttttttttgaatggattaactactgaaaggttgctttagaaaagtattctaaggagatttaattttatatacattttttttcctgaaacacattgtttagaagattggaagcatacaaactaaaaacaacaagtacacggcaattaactgaaagaaagtacttcatgctgcgttggcttgtgttttttttttaaaaaaaaagtccaatgaagcctcagcattattaattagcagtctaattacttcagtatattgttcat

SEQ ID NO: 55986 - DNA, 4249 bp, Oryza sativa
gggttacagcatgcaacaataaagtagggacacgatatatgtgagcgatatatacttgcaccccaccggactaattaattaataaaacattattcttaaacatatagagatatggtagcttagcattagatacgcccacgaaagcgagtaaacaaatggaaagaaaccacgggtcgaacgaacgaaaaaagttcctccaacacgaagcatcacgtacatacatatatattcttcaattcgcatatataagaagcatttctgcttgactcaatcacaacgcgaattgaatcgttacatatatcgatcttgctggtggtagtggtcgctgcactatctatctatatatatctgcagcctttagcaagcagaggcagccaaggtggtgctggttgctgtctcatggagtacttccacctagctagctcattttgtgatctttccgggtggagaagaattaatccatcatttcagtgctggtgggcatgacagatcgcgacatttttaaccttatccggcgagagatgtgtttctgccctctcttaatcactcgtgtgtctcgttttgtttaatttccaggggacctggcctactgctacttgcagtactactcattagcattaaacaagaaccagatgcagatttagtagtattgttaatttgcactatgtaaagctttgttgccctcatgcatttgtttaattatctgcctgtttgtttgtttgtttccacgtgatttcgtatgcatatgcatgcatttcccccaacattattatttgacttctatctgcaagtgcgaatataactatgtgtatgagtggtacgcaatatgatagatattgttagctgatatgattgagcttatccaatgatttgtgctgcttctggtgaaatgtttttggtccaagttaacaagagaccgggagaagtaaaggattaaggaagagtaaaaaaagctaccggcatgcagcaataacagcagcagcaaccacatttatttggagttttggaccatttggttagatgtagctatcagcagttccatgatgcttgcttgcttttattcatccactgctctatgtttatatgcacagtgactgatatttgtcttggtttgcctgattaggtcatcgcaatgatatttggcagctaattaatcaagggctacttttgcttaaatagtactagtaccaatctctgagagatcgataaccacaaggtattaggtggtggttatcttaacaccgccgaactgaaaaggatgatcaatttctctccctttctctgtcatcatgaaaagtgaactcgatcgatgcaggaattgaacagttgtatgcataaatggcagataaaaatcttgagatattttttcccattccctttcctttcatcatgtggaaaaagtcatcttgtgttattgccttgtgctttccttatcctgtttatttgatggataagtacactagctcatatccctttttgtttcagagatttccacttggctcaggcacttgctgtggtctatctcttctgcatattgcaagcattttagcagaagaggcagcaggtgtgatgtgagtataataatatttctctgtatacattgctgatagtgctccactgaactaaatgttttaattaggttttcgcctcggctgctacatttttcagatttctcttgcggctgtccaggtcgttaaatatctgaatcgcattagatatttagttagcaggacaatggtatagaagaaaatggaatgaattacaagtgttaacagcctatcagagaatcaatgccgggaagcaagtttcaagtaattttcttcagagagcaccgaaaagtctccggtcaggttcagtttgtttacctgtaacagacagcagaatactagtagtagcagatagttacgcaaaaccgccttctctgctcgcagttgcagcggtgtttgggaggcagctaagctatcatgtcgctctgtactactactggaccagattagatgctcgagaggggaaaagttgcagaaaaatttcagtagatccgacaaatagggattcaagattattctgaattactcaagcctgaagcttaggtgtcctactttttagtaaagtctgagtttcagtggaatgcacatgtaaattactatgtaaatgcaagagcctagctgactcgatgcatatataaagattgattactagtgctacatatcgatccatgcattgcttgcctcccaatcagagaggaacaaatatttgcaggaggaatagacaagatgcgatctttttcagttgtctccatgctcggggagcgattcatgtgtcttgagcagccaggaaaaacttttgtagattttttatctagtgctctccatgtcggattatgctcgccaaagtggagtatgtcgctgtagactgtattgcaaggtggatctctctctctctctctctctctttttcaaaaaggcaaacgcgcaaagtggatcgtgtttaattcacttttgcctcttatggctccactaaccaatcttgttgccttgcctcatttctctaaactatttcaccatcgtacataactcacaaaatattctacctcctccgattcatatcgattctcttataaatttaaccaaatttataaaaaataatatttctaacacaaaacaaacatattatcaaaatatattctatattacatttaatggaactaatttaatgttataggtgtacctaatttattctacaaaattaatcaaacctaataaatttaacttaaaaaatcaaaatgacttataatataaaacgaatgtagtactagccagctttacttagtaccatttcgatgccgttgactttttcataatattttaccattcgttttatttaaaaaattatgtacatatcatttattttattacaacttattttaccattaaagaaactataatagtaacttatacttttatatatttatattaaatttttaataagatgaatagtcaaactaatacgaaaaattagcgacaacatatattttgaaacgaagaaaatattattttaaaacggagagtagcattgaagtacttgctcgagctaatggttctctgttaattagcctgcgtaatccaatgaaaaaagttattagagtttgtactatgtatttttaaaaggtttcatattatatcattatttaactttttttcatttaacaacatctaatttcacatttttgttttaatttggatcaccccattctatctatctccaaatccggtgactccaccttcgttacacctacaagttcagtaactctacaaccacttcgcgcactaattatctctttcccctctgatggttgaggaaccgccggatctagcaagtaggagcctagatttagcgtctctgctctccaacgggtctgactcctgcctccccgagtctctgcaaacccgacacccttagccttaacgacgaccatgaaaatagtgtacattacgacttgggaggagaagagacataccgatggctagagggtacgacgacgcatgtgaaggagaagaggaacaatggtgtatcatgaggaaagagcggtagtgattgtggttggggcggcagttagtggttattagggtccgaaaagtttactatcgatataatctctaagtgagttttttgtattttttttcttagtaccactgacacgtgggtcacgaatcatcattgttgataaagaatgggctagtttttactatgtgaaaattttgatataaaaggtagagcactcgagtatctcccccttcacttgcataaaagaaaatcccccgtctcgtctcctccgctccttgtgcctgcgcccatcgactccatctggcgactcgcgagagcagagcaggggagggggaggggaagggcgccgtcgtcctggtgagcatccccatcctctgccttctgatttcatctctctctccccccatcgggactagcttctcttctagatctggaagaagctcttctcttaattttcattacactgaacccccatgtctcaagttggatccgcccaaccatgacatcatgtggccatgcatacatacaaacaatctttggacttgagcttatcaagatgtagtataattatggcagctctgttttttatattgtccataagcagtgcctctgatgatgagtgaggctgagctgatttcagcagatttcgatgaccggtgctattagttgttaattgcagcttgtg

SEQ ID NO: 55987 - DNA, 2182 bp, Oryza sativa
tgtgcaaagatattgtcaggaaccctgaattttgtggaaagcttacatttccagtgtctcttaagcaggtaaccactgaatccaatagcaaataactacaatacgtaattcctattacaatcattattccctgagcggtgctggagttcccatcatgttcttttgtatttctccaacctttaatttcacaccacactgttagtttacattggtttacactagcagacagtagtgccatttggtccaatgctacttccaggttagctcttctagagtaaatgagtgaaagacaaatatgcgatatacatgtgtggcctgccccatggggcttgggcactgaacaaaatttggacctcggggtttttacatttcttgggacctggctgagactgaatcttatgcgtaacctgttttccaattatcgtaccaatcactttcttgatgaaataactctgcattgatgagatgttatattcaagtttacccctttggtctcatctctttatccttgttttcttgttgagatatgatatttcctctgtcttttaacaatgtttttcatctcttgtgcacagcctggacctcgagatggagtaatccaatgtttcataaaaagggacaaatcaaaactaacttatcatctctacctgtgccttagctctggtaagttcctgtaatctttttccacttacccattattgctctaatcggcactatttttgatattataacagatctgtttgttggcagataaactagacagtactcataggagtatttgttttgttactattttagtccttaactttgtcaatccttatcctagcatccagtgactgtctttatctattcttgtgtaaaacctccttgtagaatcaatttttgacttaatgcttggcgtagtagaattttggtggtcattttcagtaattttgaaaaatctgttttagtatgaaattttagtctgttcaaaagcgactggaaacgaacgtactatagtataaaccgattcaacttgctgtaagaaagtgagcttgttgagtgatcgaaaagaatatgattactcacgcatgctataagcaatatggtaattattgccctcggaacagtcttccataaactttcttctcgtccgttgattgctaccatttttgtaaacgacgtatactagtcctattgtctctctgaaagcaatgtatcttggtaattgatatgtagatattgcagttatgcaaacactcacctatcatttaatgcgtagggatgccagcactggtcttttgtggctctaatgatgctgcttcggaacctcccatataacatgatttttaagttaaagtaaacacgtgatgtgccgtagttccatgttttctgctgtataaaggacttcttcgacacaattttagagattacctacagcattttcagataactcgttacaatactctgagtagtatattgaagagaaagctagaaattgcactaacaattttaattgcatcttgtagctgtgcttgatgagactggaaagttcctactatcagctaaaaggagccggcgaacgacacacactgactacatcatttctatggactccaaaaatatctcccgatcaagtagtggctatattgggaagttgaggtaaagttcctttgccatcaatcttcttgcacccacattgtcacatacacgtggtcacagatacatgcataataatctgacatacaccatggtattgcaggtcaaatttcctcggcaccaaattcatcatctatgacacgcagcctccatacaatgctcggacactttgctcacaagaacggacgagccgtcggttctcctctaggaaagtttccccaaaagttccaacgggttgttatcccatcgtgcaggtgaattatgagctaaatgtgcttggaacccggggaccaagacggatgcaatgcgctatgcattccatcccagcatcagcagtagagcctggtggcattgtgcctggccaacctaaagagctcctcccaaggttatttgaggagtccttccgcagtatggcaacttccttctccaagtactccatcacagatcattcgacagacttcagtagttctcgcttctctgagtttgggggaggggctctgcaagggcaagagcaagagcaagatggcgatgatgtgaacaagga

SEQ ID NO: 55988 - DNA, 2339 bp, Oryza sativa
acttgtgtgtattcatgtgcagttctttggttgaatccttgtgttcctccggcgtgcgtgtttgttagaagtgtaaaaaggggattgaagtgtagatgtctgtaagatagaacaagatcttgtttcttgtatgttgggcttaaaaagttttgagcaagagaatgaatgaatggttgagggagccgtcggtctgaatgtggggttaaaatgatggagatggtgagctttgagcattattatggccagacagcaacagctatcaatcaatctgattctattgtatcttgggtagctactgactgtctgatgtggccaaccaaccggagtgaccatttgtccccgtgaaagaagtcaggtaccgtgctacagtagtactcattgcttaattaatgacgagtttagtttaatacaattagaaaaacctagtgcactcgtagtataatactcccaccatctacttttaatagtcatatttcatcttggcacacagaccaatgacaagcaattctacttatcatccatttaaacatgctaatggagagtcacgtattaaatctgagaaagtcattaagatgataatttgttggattgaaatatacctattaaaaataaattttccagatttagaaatatgacaaccaaaaaatagattgagagagtattctactactagtactagtacttactcatggaggataggagttgtgatgtggctaatttagggcaggagtacattattaatcagtagaagctgtagtagtacgccttacaaatagtagctgtcagtagcaatgtcagcatcattacattaatctgttgcttgtaggagtaaaagataatgttggatggatcggtttgtggtttgcttaattaattaattaaaggctggcctgcagctgcaggcaggcatcgaaacccaaccgcaacagacgagaaatcgccgccgctgcattggcagcgatcgattagaaaacaaaaccaaaaccaaaaccaacctcgcttgcctccttcccatgaccttgtctgccaattggtcgtatttggtgttaagttcgattagtagatagagtaatcaaaacaaaagagagattagcggcggccaaatggcacgtgccgtattctacgccgcgagtctagtactccgtactccgtattgcagtttgtatgggagtcggacacctgggctcagctgtcagtgacacactctccggttgagcagagctcgtcgtcgacggcgaccacggccaatcaatcacgtgcctttgacctgtttttggtctacacgtgagccatgtagtagctcatagagccacgtgtagagaattcttgtgttccagggcgtgacggcctccggaaccggaatggtcgtctcccttctctcttgggttacaatcgcatgctccctccgtttcaaaatatttgatatcgttaactttataacacatgtttaaccgttcgtcgtattaaaaaaaatatgaaatatctaaaattatatgtgtacataaaagtatatttaacaataaatcaaatgatatgaaaagaataaataagttaaattttttgaataagacgaatggtcaaatacgtacttacaaagtcaacgatatcaaacattttgaatacgtacttacaaagtcaacgatatcaaacattttgaaacggagggaggatgtactactcttgtcatttttttaacggaaaatagcacagtagggcctttccgttaagaaaaaaatacattcatgctgctgcctagtgaaaaatctgaaccgtactagtataaaaataccgaaattccaaatggagctgcgtattggccggcaagtggagtacagtagtaaatatcaagtcgatcgttggtacgcatgactaatcaacgtcgctacaaggtccgagaacagtcaaaacgtatactacaccacaaaaatattgagacgtacagtacaaatataattatacagcctccaaaatgttgctttaatccaggtgggaagagttgttggtgtgtcaggttgtccaatggaaactacagggaggctccaaattatgtacaggaacaggatgatatctgcatagtgtaaacattactaatactcagcgttttaaaagcttgattgagattagcgtgcaaaacacacgttgggagtgtacacaatacaggcaggcgtacaccagggcagtagtatagtagattaatggtagggagggaaggccctaggcagccagcaacgcgacaggctgagccagggtggagacagaccacccctgaccccacctcgtcagtcagatatcaccagcagcgctactcctccaatactcacagacggacagacagacaa

SEQ ID NO: 55989 - DNA, 1584 bp, Oryza sativa
tctcccgcacatggtccgccgcgcgccagctgcaggccatcgggggaggcctcacggtgccccgcgcgaacgacatcgccgccaccggaggcctcgcctccgccgtctacgccatgggcgccgtgctgttcgtcgtcacctgggcgctcgtggcagcaatcccatgccaggaccgcggcctccaggcgcacctcacagcggtgcccaggaccttcccctgggctggccccctcatcacactcttcgaccgcatcctcgacgagtccaagaagaaggaccgcaagcactcatgcggcctgctcaaggagatccaccagattgagcgctgctcgcggcagctcatggaggtcactgatgctgcggagttccccttggccgacgacaaggattccgaggtgcaggaggccacgcaggagctggtgcaagtttgcgggtcactcaaggatgggctggaccctcttgagcgccaggtgcgggagatgttccacagggttgtgcgcacccggacagaaatcctcgactacctcagtaggccgcacaacgccgggtgaggactcattgcttgatccaactttgtgtgaaatgcagccgctccaccgaggtagcttctctgtaaaagttagcatctacatatacatgtctctgcatgaagaaggcctggccttagttatgatacatttgagttatttctttcattttttttctctccttttgtagcttgtgaatccttacttgagcagttcttcgtactaatggtctaatatcatttatttcattcattgcttgtcctggtaatgttgagcactctggttggtttgtttccatgattagtctgtggattaggtttatattgtaaaaaggcgtgggcgggagtaatttatacaatcggataggttagctcagatattgagctgtgaggttttgatatactgctattcccaacattttgtttgttgatgttccaacaaatgtgtatatgatcggaagaaaaaagaatacagaattttattgattattgacttgtttttgttctagttcaaaaggccgaacaatgctccttttctttcttctgccctttgttttgttgtgcgtttagatttgaaaatggccacattcatcgtgtgctccgttgacacagtctatgatcaataacgcaaaacaggaaagcccaatgggtattacatttgggatgaataagtagaacatccgcttgcaaatgtctgcttctgtgtcctttattgagcttagatcaatattagaacaaattgtttggtattctctatttagtactattagttatataatcaacacacatatactcttctttcttgcaagaagtattgctttgttggaatgattatatctatgtagaaggttcaattttaaggttacttaacttacgttcaaaacttatgtacacatttacatttttgttgtatgaaagttgtattagggataggaactagtatcactaaatgggatataaatttgtattgttattgtcacttattccctccgtcccaagataagtgccaccgtgaactacactttcgctgcacttattttgggacggagtgagtatat

SEQ ID NO: 55990 - DNA, 1644 bp, Oryza sativa
cccataatataagggattttgagtttttgcttacaccgtttgaccactcgtcttattcaaaaaattttagaattattgtttatttttttgtgatttactttattatccaaagtacgttaagcgtaactttttgttttttatatttgcataaattttttaaataagatgagtggtcaaacagattaagaaaaactcaaaatcccttatattatgggacggagggagtaacaaactgatatgtagcagttcgcggatgatgatggtaacaaatcgttcgtgatgtctgaccacttgcataatgcatactagtgctaacttcgtaactactcctgttatgttgctctgtacagctgatatgtgggtgttccatagtcagttttaggctgattccacggaaaaaaaaagttttaggctgattgatgggaatgattcgccataactgtagatgtctcttgtgcagtaccagagatcaatctaatggtaacaggctaggacgagagcaattttatcgtgagaaaaaatggtggtgattgatgcaagaaaagaaaagaaagtgaaagtgtgaaacttgaaagtgagagtaatattcatacagtagaggcagcagggaaaaagaagagtgatatattataggctgtgctgcctggcccattgactgaagtgctataattttggaggcccaaacgaagcccgtctgagtatcctcgtatcctggggttctgttcttggcgtggttgatatgattgtgctggtcaagctctccagtctccaccatgctgcgggccaatcatcaggaggtgtcatccaagatccagatgcagaatgtactacccgtctttcttaaggtttatatatacagtagtatagtatatataaacctttccatttgtttatttccaatgctatatactggctacttctacctctcttttctaatgctagcacgttgtaaaatctgctccaaagtagtagtaatatcttaatgaactaaggctgattgttttgttgcgcttttatttgctgagttattggattcctttgtcccaaaacattcacatgatcatcgttggtgtacactagtgatggtgtgcaaacgtggacgactttgaccaatctaccttttgtcccagattcagagcatctagttatgcactttaactccggtgggtgagtgacttctgagtagtcgtactcgtgtcacgtatgcttcccggtcctgtgccagcgctgtgcaatttaataaactacactttgttttgtttttatctgattaagtgtcgtgctatgccgaacgatggaaacattaattttgggtttatgctgtgacaaagacagttgtgatgatgtagcactaactgatgatgatgatacatttgacatgcagttactctgtcccgaccgaggaatcgagtagtaactttactttttatgaagcaaaaccattctaactaagcagagaatgcatggaaaccaaacaccacgcgcagatggcatcctcttaattattattactagcacaaaacataaacataaaacgatcactaattactccataagttaattaggcgtcggcggcgaagccttggtcgtcgtcggcagcgttgaggaggtcggaggagcggcggttgggagcggcgcagttgt

SEQ ID NO: 55991 - DNA, 1333 bp, Oryza sativa
tatgttaatatactactgtagttactaaaactcggtatttaatttgttttttttttatgtattgccatctgtaagaaggaggcaccatgcatcaaccgaaccggcaactactggagtaaaatggtagtaggacgtgcctgcgggaagcagtcgtggaagaagatgcggacgaggccggcggcgatgccgatgtcgcggcggagggcctcggtgacgtgccacctcacgatgccctccaccgacgggcacgacgtgtcatagaacccccaggagaggccggcgacgacgggttcgccggtggtcaccacggccgcgcaacgggcagcaaagaggcccgagatcagtagcacaaccatacccagcttggacgccattgctcaacactctagctaacaaagatcgatcactctcagctcgacctctgcctcctgcaaatggtccatctctccatgccctatatatatactggactggaccctatcttgtggaaaagtggaatataatgtatactcctactacgtgcatagtatgttggtctaggattgtggcttgattgctcaagccagcacattatcaagatgtcagtttgctgtttctaattaattgttatgtccaagcccgatctgatccacaggaggcaggcatatgcctacatcaaaggcagagatcaataattaatatatcaccacctaaccttgcagtatgttaactatattcaaagaaaaataaagctgactttttcacaaagataaagctgaccagctagactcatttcttttagttaccatcacatctttaatttgtgttgtacaataatactgcctctgttattttaaacctcacatttttgtattttcttgtggtttccagaatacgacttgggctaatccatttaataactttgcatcaagatcatacaaagattatatttgtatgaacagattttgtaacgaaaaatctaattatatcaattttataaatcaaattctaatagtttcaaacatgtcagtcgtcacactaataaaatatttttttcagcatggattctcggatcttaagactccagattgcaagaagaacgttgcagtgggccatgatgttgatcaattaattagcaagtggtctagtgtatgaaaagaaatccaattagcaagtggtgatggtgcaattaattgcgcttgatatctctatcttacggttgcacgcccccaccaattagacacctcccaattcccatttcttttctttccttctttttaaagcttcacgagccagttagtggtacaaactacaaagcagtccagagaggaaaaaaatcaatggaaaacaacca

SEQ ID NO: 55992 - DNA, 840 bp, Oryza sativa
gctttgctacctttccctttttcccttttcccttttaactataactatgcaatgcacatatatatattagctagctagctgttctgtatgtatgcatgtggccaaccgttattgataagttggaacaaaagaaaggccagtttggtggaaattaggcaagcaccctcaacttctcacccactatagatatcatcagcaaaccaaacgggaaaaacagtacaattaactcagatatgaaaacaaaaaagtgtatgctctcttctcagttctcatcatccgatatttctgttgctagtgtagtagttgctctttatttctttcatttcatttttttagtgagaatgaagtcttcaatccgggacaaagtagaagcgagagagagaagaagaagcacatgggccagactgtgcggcccataaaagatccacttgaattaggcagatgggcctaaaccaaggcaacctaatttcttcttccacttctcgcggaggagaggagattccgatcgagaagcggcggcgggcggccggccggcggcgagggagagggagaatcgaatatactgtagcagaagatgcttccaattttcaatggcgggttaggaggaggagttggcgaacacgctacctaattagctaggtttcctttgcttctccaccatatccgttcccctcttctccgctacgatgcaggccgccgcggcgccatggagggccgtgctacggacgacccacctcctcgtcgatcccacgcgtctcgccgcgtcctccttccactccacacccgtctcctccgccaagtggaaggacaagttcgattgcaaggtcctttctttccctc

SEQ ID NO: 55993 - DNA, 4273 bp, Oryza sativa
ccgattcattcaccatgtgcacaatgtgcccaaagaaatggcactgagctcaccggattgcaacctgtaatcacaggagtaaggaacatacccgccggctttcgtgcccgtgctgctctttgatattaggctattagaaatgcccggctactccgattctgttaaggtactttcaactgtgctaatcgatcgatgcttattctgcaacttggtattttcagttcccaaaccaaagcatctcaaattctcagatgggatgctacaatacccagccaaacacttaattgccaaacttggaatctggaacaagccataaggccatggattatgcctcgttagttttagtaagaaagaacacacatatctagtttgcccatagacattcaaaatatctatactgttacgtcataattgcaataacattctaagtaactagaccatgtcaatgatatcaataagtgatcatgaacattgggttcattgtctctagaatcacgaccattttacttgatagtgtgataaatacgatttacatcattcatgttttgcctttttccctatatgcatagcttgtgtgctaacacaatcttcttgctgccaatgcattattcagcatgaacatggagcgcggaagctatccaaggtatgatctgatatctttctttgtaccgaccacctgatggaactgattaattgttaacgtccaactctctcgaaagacagaaactcaaattagcagtttgggttgatgcttgatgcaagaaaagaactagtgtattcaatatcagtgctccattatgatactaataggtgccacaaggaatggttctcagatgtattttattaatttgacatttttcttcagggtacctgctttctcatatgaataatcaaaacctttttccttcaattaaattttatggttttctagctggactaccaaaatatggttttgttaaaaccatagtcacaaagttcctgggtcgatgggatcaaggaatggggtcgaggaacgtgatacgctacttgcgagaggtttttacaaggtggggacgaaaatgaccccgcgttttcgggacggggacggcgttcccgggtcgaggatcgctgccaccgaccccgtttcctgtgactatggttaaaacaagtataatattgatcttctagaggggttggcaagtagccaagccgaattatgttaaggaactgtagcacacgagtagctggccttttatttatcttatcaataatatcaatattttctgcccttcctattatataagccacattgattatgcttctgaatgttgataatgcaatacttttgtttcattcttgcaatacttttgaccttccaaactctcagtaagacgattgttctgacaaataattttgcaacagaactacgagaggtatgttgttcgtcaaaaacgagcagaaggtaaaaaggccctaaaagattatcttctatttggaaagagttcacctcatttacaggtgagaatttctgttttgagttgtcatttccagatttttgtccttcctctaactagcacaaataatctatttactcttcaaaaagcttttgatggtaatactttatttcttttaggataagatatttgcaaaaacaaccaataacatttgatgtcgcaatattacatgtgtttatccagggtggaagtacgggcagctttgctaattcgcatgatatcccacgattcaaaacctttaggaaaggatctcagtctcatggctcaacaaagtcgcgacaaggtgtacaccatcacagaaaatgtatgttcctcttccaaaacgaaaatagacgcgtactaccttcacttgaatctattcgtctggttttgagcatctctgatgtatcatactatcatgtatcgcattcataatttatctgccgctccagtggtatcttaaggtcatccgtggtcggttaactttatcatgcattagtatgattacaagtctgaactggttaagttgaggagtaggaggtgtctgtgtgggttgaacccctaaccgacatattaaccctgctccttaaaccaaatgcagctctaggctttttgctatgttatttctgctattaccttttctgcatatctgtaactgcacatatcaggatgttatttattgacttgaaaatggtgcaaaaacatactggtctgttcatacttcatattttagtgacctgcagagcatgcataattcgactgcagtttgttgtgtcacatggatttgtgctgttgctgtgacccactcagatcacttcaaattagtttacagaacaccataaatgtcacataggtgagaatgttcttataatattttgcaggtaaaaaagacagggagaggttctacaatttcttccgtgaggagtattatgtgcatcctgacaaaatctttgaagacatgttcggtgagaatcatcgttttacctggtcccatatatcgtgggagagttttagcttcagagattcatcgtccagatttcgaaggactggtgaatcgaagagagaaagagtttgtagcgatagtgacgatgaaaatgaggatgaaacaaccaacattgggtcacatgcacaccgggctattcttggactaccagcttgtggtccactaactctagatgctgtcaaaactgcgtaagttgtgaatttttgtaccattcctcgaattattgtcttgctatcactaccatttctgtatggcactacaagtaggtgctccactagcgttcacctgaattactttcggtgtgcagtttccgggcatctgctctgaggtggcaccctgacaagcacccaggctcatcacaggtaaccctttccttcttgtttgatttggagtaaacaacagcatacgacattgtcttgatgcagccaatgtactgattggtctgtaacaaatcaatgtgcaaaacaacggatggtaagttggtaaacactaaacagagggtataactgcatactctgttttacatgtgcccaggccgtggccgaagagaagtttaagctttgtgtcaacgcatacaattctatctgcaatgtcctcaaggctgcttagctttcctcttgcatcgatggtggttcaagcttgcagttgctggaggctgtgaactcgcagcaacagcatttcaaggcttgtagctgacaaggccaagcatgaagctgctgcattgtttcagagcatcaatcggatgacacattcagttcaccaactcaccaagctcagagaaggaaggggatttgtgctgttgtaacaaacatgtacgtactactaatcactgtaacaaacatctattccttcatttgatttgatttcctattccttgagcgaataaaacaaacactgttcacagaaacacacttttacacaaacaatatgagaaaagttgattgaagagcctatcacctgtgtttgccgtttcttcttgtgtcatgtgttgtgcggcactgtgtaacaagctctaactaatgacgatttgattaacctaaacaattgtctggacgatgtggcgtcatgttgtctttgggtttatgttatgatttggccgggagaaagcaggactggaaccaagaaatatgtactattggtacaatgaaatcgtcgccgtggtacttaaaagcgacgttggttgcataaacatcaataatgatagcaacaagcttggcagcttttactcacaaactaaccaatctccaagagagatcatagtactagatactgtagttaaggataaatacagttgcttttgccacagtggctgctggctgctgccgcgatttgagcgagtgaatgtgacactggctgacaattgagataatgcatgtgagggcctctcgctgaagggcaattaacatagaacattctactaataaatcacaatgaatacgacaagaaagagaaagagagggagggattacagtagagataaacaacgaacgactcttccatcatctgatctgatgatcaatcaaaatctcctactagtaagattggattggaggagtagtccagttgagaggagatctgagagctagaagcagaggatggcgacggcggcggcgacggagaaggcgaaggtggtgatgaggaaggcgaagtggatggcccagctgcgcttgaacttggccaggtagctctcgggcggctcctggtacggcacctccacgtcggcggccgccaccacgtcgccgccggacttgagcatccgcagcctgtccgccgccagcgccagggtcagcttgtggca

SEQ ID NO: 55994 - DNA, 6472 bp, Oryza sativa
gacgtacgcctcgcccatcgccatccccatccgcatctccaccatccgctgctgctgctgctcgtggtgctggtgatgatccatctctctctctctctctctcttagatttctctcttctcttaccactactagtatagtgctcgctcactccctcacctgcacaagcagcagtccattgctttttactgatgaatatactgagatgagagaggctattagcgttagcagcaaaagctgatggccagtacagtaataatgagaagagttgctactaacactagacgccatccatgccacgacgaccaccaccatgcttcctttctgttccattcgctgctgttttacctcttcatttcgcccatggagtacttttctagtgtctgtaactgtaagcaagcaagtactcgatcgccttgtagaaagaaataagacaagatgataattaatttacgactagtactggagtataaattctgtgtatgatccatctccacgcttgtactagctgagatgggcaagtaggagtactagctaggtaaggaagagtagtagaagagagagcactgcattggatgctcgagcgtcgtgtaattatttgcgagcctccctggagcagtaaacttggctgttgttacctgtgtgaccgaccgaccgaaaaaaccgagtttgagtccaaaacgccatggaatcgcaatcgcaatcgaatcgatatacagtacagtatagtactagtatggtcgagctatctatctatagtcaggagtgaggaggcaaagcctgctgctgtcaaacatgaatgagcccacatgggggcatgagaattggactactagcacggtcactgtaccatctctctctctctctctcgatcacttgtggaaaagtttatcataaccaactcgctaggatctcaatctataacccagtggtggaaaaaaagggggcaattataaatttattattggtttgaatcgttattataagattaccgctataaaattacaaaaatatcgtcaaaattatcgttcaagtggcatccttgtaaaattaaaaaactcggccactgatttgatcttacgatctaactaaccgaattttattcaattaccaacctcagttaactagattgactgaattactcccagcaggtccaataggcccattaacagttcgatacattacacaagcataccaaatacctatatctttacctagcgctgcgacaccgtctaatcccgatgtccgcaataggtggtggcgactctacccaactcaaatgacgtccccgcctttaccttctttgcgacgaatccgtcccattgggccgccgtctctgcctccacctaaggatgaaaacggagcggatacggtcggataattctcataccatattcgttttcatttttttttaccggatacaaaaacgaatatggatagctcgaatacggaaacaaatacggattatctcgaatacgaataagaatcgaatgtgatcggacacgaatatggaaacaaatttttctcggaacacgaaaaccaactcaacttctaatagaaacaaatatcaacatatataattagctcattttatataaaatgaggtataatttataaatatttcttaaaatttaaataatattaatagtatggactagtgttaagagataaactactattaaaatctataaaggtatattgaaggttatagagttagaaagaaatgaggtatgtctcatgggtcttgcggatatccgaatagcactgttcaccggatatccgaaatattatccgtatccgacggaaaccctgatatcatattcgtattcgtatccgggaaaaaatattcgtattcgtatccgtatccaaaatatctaaaaactatccgctccgttttcatacctacctccacctccgttgtgagccggcaacgtctgtcgacgctttctttacctcggacgtcgtctcaagtgagccgaactcaggcacaccgcacactgacaaactgcgcgtttcctccaatcttatggcgacaggctgcactccaacaacgccttctccactcgagtctccaacaacgttgctgaatcacgacatgaaaaggtctagtacctactggcacaacggtgaccactataccttctttttgtttcattttttttccgttgccgttttgcttcttcatttcgcccatacttttgtaatatttgtaagcgagacgctcaattttcacatttccacacaagcaagcaagaaagaaagaaaataagataaaaaaaatcctaataatttactactagagtataagggtgtgtttgaggaaaaggagattgggaagatatgcaaaacgaggtgagccattagcgcatgattaattgagtattaactattttaaatatcaaaaatagattaatatgactttttaaagtaactttcctatagaaaatttttgtaaaaaaacgcacccctatatcacacgaacaaacgcagtcaaaattctgtgtgatatccactcttgtagctgagatagctgagtagaagtactacggacaacagaagagagcattggatgctcgagcgtcttgaggatcagaaaagagcatcgtgagaaggactatgcagcttggagcggtcaacctgccttctagtttacctgtgtgaccgaccaaaaaccgagttaactccaaaacggcatggaaatatggaatcgcgatctaatcgaatccacttgaactgagcttggcgctgtcaaacaagagcccacatggatggacatggggatcgattggaacactgtactaccaaccaactcggcaggcaatgtcccgagccctttttcgaatgttgatcggcctgtctgcgaatgcgatgaccaacacaaaccgcatcaggtcaactttaattcagtagtgtactagttgagcaggtgcaagtaatttcaagcaattcctctcaaataaaacattttaaaacaaaagccttgaaagggacatgattttctaccatcacaaagaaagaataaaaagtttctcccttagtgatgagtatataaagttcaggggcgatattggatattcccacttgctgccaaaacatgggagctcccagtccaaagattggcacacaagacgcgcactagccttagcacaagtacttccattaggggctcattttgtattaaaacgttggaaggagggagttaagtagaaattgtcatcccacccgtctttaatactgtttcctcagacggagggtgcagtgcagtgcagggaatcatttcatttcttcttcttcttcgccgccgccgccaccttccaccccttcagccgccactccaatccaaggtatcctctcccttccccctcctcatccgcgctatttctcaggacttggatttattttctgtgggttgcgtccaatctgagcggaagctatattacatcgagtttagtttgttgcggatttggtttctgcttccaaagggattgggtggggttcatacatgaccctggatctgatctgagtgtagtaggtaggtgttaagatcaatcggatcaacgactgtatcttgttcggatgctcatctcatggatgttagcctcaggtcagggggttgtatactgtatacagcttgactgtatttagttccggtaggggaaaagaaagcaactttgcaagttgcaactctgctttttgctagatgtttgctcgacctgctaggctgcagctcaagctaattaaaaatatattttttttttcattctgatagcagctatattgatgcttgatctatggttcctattatgatatgatcataggaggatgagtgaagaggacaccaatgctgctgctgggcagcccaggcgcgcccctaagctcaacgagaggatcctgtcctccttgtcgaggagatcagtagctgcacatccgtggcatgatcttgagatcggtatggaactgtctttcccatctctctttatggctcacccacaacactatgtggcatgcatcatctcacttaatttggttcaacaggccctggtgctcctgctgtcttcaacgttgtaagtgtcatctctgcctttacctatacatatgatgccagagtgcgtgcaaaataagtttccttggcgggctgtaggctgcacaattttgccgctagacgggttgaaacatgttgaaatcggaaataatatctgtccaattaatatcgactctgtagaggtccgcgacagcttttggtgtttgctaaatttacagttcaataggtgttgtactttccagttacaaagaagtaacatgacactctcaaggaataaagaaattcactcaccaggcaaagagcatgatgaatgaataattagaattcagctcttcataccaatttaatcaggcaagagaatgggggccactgaatttaagttaaacaaaaattaaagacagttgcaacatccttggtattgcaccaaacctggaactttaagtggattgatcaagccatggaacaacagatgccaatcataaataaacctagttggaaaagtacttacatttataagttcttaacatttctaaaccttctgctgatctccatcagtttctcagcaactttgttgatatcatggcatcaagcatctatcttttgtgggcgcagcatgtgccttctgtaaatcttggtagtagcaggatgatgtgtattaggtggcagactggtaggtgtagccatatgctgccatgggaattttatgcttcttgaactgtttatacctttggataaattgtagctaggattttgattcgaattaaaatagaaccactagtagactcatgggcacgttgtgaatttcacctttccccctttttctactattaagattttcactgaatattttaactttactgatatttgattctggtgcaaacaacaaggattttttttttgtgggggtaaacaacaaggaatgttagtctgctgggaaacaattgcttatgagtcaaaacaagtgtgtcgagtggttttgattgttctgtttaacgattctagaagctttatctacagtcggttcctgacagtgcatgcaacctacatggttaatggcttccatttatatcacaccacaggttgttgagatcaccaagggaagcaaagtgaaatatgagcttgacaagaaaactggactgattaaggtgtgtgttctatttgtaaaatgattgcttgcatatcattaccacaactctatttcaagaacaatatggactaatttcataattattttttgtgtacttacgtaaggaattaaaagtatgcaccaccaccatgtacttgtgttactgtgttgtattatttgataggtctgcatttgtaagctgtaggagtttattcttgtcaaagaatattacatttttgtaactgtgcttcataatttgacaggtcgaccgtgtcctatactcatcagttgtgtatccccataattatggtttcattccaaggacactttgtgaagacaatgatccaatggatgttctggtcctgatgcaggtaactccattgtgcttcttttcttttaaacatgcaaaacagtcctttgcattattaactgatagtgtctgagagcaggggatcagcctgcaagtcctttggcattgacacttttgaacaagcaccagtagttttttagttgcacctcaaaaccattctcttttttactacagtgtggaatatattgtgccattatctcgtggtaatgtgttcttttaatccacacaggagcctgttattcctggttccttcctccgtgctagagcaattggccttatgcccatgattgaccaggtatattttctactgttctgtttgtagcaaagggaaaaagacctgcacgggttcactctttttgttttgttttttttttactgacgatattggattttgtgatcagggtgagaaggatgacaagataatagcagtatgtgctgatgatcctgaataccgtcattacaatgacatcagtgagctgtctcctcaccgcctccaagagattaaacgcttctttgaagactgtatcctcatagtccgttttatggtttaaattgcatatcccatatagtatagtattggtcatgcatacatctgttattgtccttaacaatatgtttttagacaagaagaatgagaacaaggaggttgctgttgatgcattcttgcctgccaacactgctcgtgacgccattcagtactccatgtaagttctctgttctgcagtgaaatataagtccataacaagatgtgattgtgtgtgttgtggaataggtatgaagataccactattccttttggcatatattgacacatatttgttgtttatttaatctcagggacctgtatgcgcaatatatcatgcaaagcttgaggcagtagagtgctacccgatctttatcgtgaaatattgtatttgtgccaactgcaaaactgg

SEQ ID NO: 55995 - DNA, 4687 bp, Oryza sativa
tatggtacgttcagtaaagctgctttaccaatacccggaacctagatatgtgcatcgtatacacacgataattgttgggaccaaatgtcatgaagaaaatggggatagctagctaggccggaaaatactcttctccctgtttatccataagataaaagtgaacccgaggagtattcattggtactcatcgctactgtctcggtaaaaatataatctggtcttgctacagaatccagatggcttttatatagcctttcaaagatataatagtatatatctatattattatatagcccttcaaatctcagtaaaaatataattctgcacattaggacgactctctggacctctagctagtatcagcgtgtagaaatggttggagttgtccccctgcacctactaatggaatattaccgccgggccacgtagctatatatcaggcctcctcctcagcctggcaagttctatttgccctcctatagcaagctcaaatcccttctttctataaagttaaggtcaaaagcttaaacctcgtgcttccacgtcatcatcaaattatgaaccgttggatgaatacattagatcgcttctcagacgttcgatggaatgcagcatagagcccaacccatgccattagccaccggatgagtctcttcgcctcctcagtgccaaatgtggcccacatgaacacattggcccatctccacacacatctacatgtatccagcccatcaatccgcataaaagaactttatggctgaacacgtcttcagttgatatgtgctacctaaattatctataaattttggatagggttgctaaaaaaaatttctccaaaaaagctatttgtttctgccgtttcttcttaagattgtacctactatgtaacaaatgtgcggggcattctctagtaatatatgatgggtaaacacccagactcgaataggatttgatgggtaaacacaactttctcttgaacaacttctcttttgccttcatctaaacctgctagggaaacttcaagaagtattagccgttggttaagagtagctcgatgtcgtgttttggtcgaatacgtgaggtgtggcgtctagcctctgctacaataataatatattgtactccttaaatataagagattttggatgaatgaaatatatcctaatactactattactatgaatctatacactgtaaaaattcatagtacaaggatagtttgccggcccttccaaagccagcttgctagtctacatcaaattgaggggaaatgtacagaatctgactcaatgaaatgtgtttaatagtgagtaaaatctacacctcccaataacacacttgcgtggaataaagggatcgtatcttttttccaggatttggttctgatgtcagcatatcaatgcgccattgctagctagtagaatataatgccgtttaccctggaactgatctcttttgtggtacgacgtgcaaatactataatctctctaaaacttacattaccagggtaacctttcttttcatacggcaaacttgtgcgaataaatgatgaaaatggaggagggacctatgcattctatactctctttttttttcataacttattactccctccatccctaaatatttaacaccgttaacttttttaaacatgtttgaccgttcgtcttattaaaaaaattaagtaattattaattcttttcctatcatttgattcattgttaaatatacttttatatatacatatagttttacatatttcacaaaagttttttaataagatgaacggtcaaacatgtttaaaaattaacggcgttaaatatttaggggcggagggagtaattaattgcatcattcgtggctcatctcatagcatgcatactgcatactatatactagtacgaccacatatgtcgaaattaaagcggttgcaacttccctgaaagccatgggatgaaagctactggtagcacagcatgaagaagaagacaggaacaggaggggagcactttttgtttgaggcagacaagacgcatcgttttcatgctgcaacctcctatcaatcgatctctcaatgcacgcgcgcgtgtactagtgttatccatgtttctatgtggtttcatgtaagtaatctgcgtctatttttttctcttcttggcatgcagttgtactgctactagtgtggtagtatgattgattcaaacacatgcatggtgccacgggaagaaaactagagatgtcgtgtcacctttttttaaaatggggaaaagcagaaatttaacatcggtcggtcggtgtgtgtatcgtgcgtgcatgaatgaatgatgtgtataagcaagaaattaagcatgcagtggatggatggatcatcatgctgaatttggtatttgcaacctatagctcgcaagttaattaaagtcatgcgcgcgacttcagaagaagatcggatcgagcaaattagagcacgagttatggaatcttcacgtgcatcctagctagtccttcgtgttgattggtctgttgttgtttgatttgaataccatctcgatcgatcaccaattatgtacgtacgtatgactaacaaaatcacccggccggccggtcaccatgtacgacgacaccaccccacgtacgccaggtagctatagcagctattgaccaatgaccgatgactaaaattttgtgcacttactttaatacaaaattgacagttagactttaagtgattttgattaaattttagcttaaacgtcaagcatatataaccagagggactatatattatcaacaagatacatgtagacacctagccatgtaagagaacatgtgcatgctatattcatatatatgtccattattttcttcgacaaaaattggacgaagattaagattttcgtggcacactttttaaactgctaaacggtgtgtttcgtgcgaaaactttctatatgaaagttgctctaaaatatcgtattaatctattttcaagtttgcagtaattaaaacttaattaatcatacgttaataccacctcgttttacataaaaaaacataatctttatatttatctttaggagaaaagaacaccacctatggtagtataattgccccacaaaatacactgtattataaactgtcttttctttcccactgagctagtagctcgcaggagatgtcggtcactccataagttttaatcctttttatttttacacgagttaaaaaagacacgttagtacaaaaaatgaaggattccgatcacgggccacacgtgacaattgattttcactaaaaaaaagaccttttacgaggcctgtcctatttttattgatggccctcttagaatcccacctaataaattctaattttcacagagaacacccaaaaaatattgcctgcacactagaaccgcattaaaatagagcgccgcacagtcaaatacaccaagtccttccttgctagctctcactccctccttttctctcccctctcttgaccataatggcacctcctcctttctccagcttcccacctccgaaacgatgctaccagccttccttcacgctgtcctcctccgctctagtcttcctcttttgttgccctcgtttgctgcagaggattggtggccaccacgggtcatacaacacggttcaacggtaatgtgccagggaagatcagatctagcggctgttaatgaccaaatttggtaaattctatcactattggcgttgaaggtggaaatcagatcgaggtggaatccaagatgaagatcgttgcggaaacagagtaagaatcgactgtagtccaaatcggctaaggtcaggttggcagagttcgagtcgggcggggctagccgatacagccgattccgataatatgactcggcgtatgtcgtcgggttcaagttgatgtgcttcaaagatgactgccacgcatggatagagtcctaggaaggcaattgtatctattaattaggatattttgtgtaattttcttagagatatgtttgggcaaaagtctgccgtaaagacttatggtatcttagagtttgttagagataatagtcgtgtccgttatggacgtatcttgtaattctcgggtataagtagacccgagccctatgcaaaaaaaggactcatccaatacaatctcggcgcatcgccaccctttttgctttacttttatttcgacgagttcgtgctctcgggttgagctgcatcggtttcgatcttcaacaagaggtaaaacttgtcatgacgatttatgttatcaggattagtgcttccatccttatgatactctaatcttgtctatataattcgtcgagttatcatatatctcacataatcttcgataatatctctatctaacctataaccggctaacatctgttaatggaaggcagccgattaggttagacaatgatgttaacttagattatgtgatatatctaccactctatgaaacttccagcggcttgattgtctagatattgttcttcttttcatacttaatgctgcatcagttgagtttgatctattaagtcgtgcttagatttgcaatctctagcctgctttctggttgccgattaggtagtatcggagtttcagccgatcttatctgatttaactacttttattctatatgcttgatctatgtgttaaatctgccttttatgttaggatct

SEQ ID NO: 55996 - DNA, 2913 bp, Oryza sativa
atcgagtggactacgccgtacacaacggtttgatcaatcaatctggagtgttagtcaacaccttgtctaacatgatgaagacgatagccgatgggtcaatagccgagcatcaagctgcaggcccggtctacttgccgagaggtgtttttccgaattatcgatctttgattactgatgttcagccgcttgctcaggcagttcttccaggtgcactatcggctcagccgatggcatcgccattgacttctttgcctgctccatcagcgtcgacaccaggtcagccgattaatcctcggctattgatgagggagtagccacagcatagcgggcagacggtaaatcggccagcacaggatcaggtggctgctatgtttccgcccctccaatctactgtcaattcgattcaacagactccactaaggcaataggttgtaccgccagttcagccaacagctccaggacaacaaactatacagccgattccgcagcaagccttgatgaatcaatcggctgggcaatcggctggacacgccctgaatcaggttgttccagagcatttggttcaccatatacagccagatggtacgatgatgcctcaaattgtgccggagcacttggtgcaaagtattcagccaaattaccagaattaccaagggggcaatataaattatcaatatcagcctccttcccctcaagttcagtatcagcaaggagggctaacccaaccccagtttgcttctcaatataattagtttgaaccaatacagcaacaatcgcaaggagcagttcaacaacgaccatgggccgatgtaattgccgatgtgatgagagaacaatttgggcttaagccgagagatactggaaaattgtatcggcaaccttaccctgagtggtttgagaaagtccctcttcccaaccgatttaagagtccagacttctccaaattttcgggacaggatggtgtgtcaacttatgaacacattagtcgatttttagctcagtgcggcgaagcatcggctgtagacgctctcagagtcagattattccgattgtccttgtctggatcggcttttacatggttttcttctttgccgtatggatcagtcaatagttgggctgatttggagaagcagtttcatagctatttctacagtggagttcatgagatgaagttatccgacttaacggcaattaagcaaaggcatgatgaacctgttcatgagtatattcagaggttcagggagatgaggaacaagtgctttagcttaagtttgactgatgcccagttagccgatttggcttttcaaggcatgattcctccgattagggagaaattctcatatgaagattttgatagcctgtcgcatctcgtgcagaaggtaatattgcatgaacagaggtctgcagaggctaggagaagctctaagagggttaatcatgtctgcccttacatgtatggatcggatgatgacgacgatgactccgaaatagctgcagtcgaatgggtaaggagtaaaaaggttataccttgtcagtgggtaaggaattctggaaaagaggagagatatgattttgatattaccaaagctgacaagatttttgatctgctactccgggagaagcaaattcaactccccgctggtcatgtaattccatcggctgaggaactaggcaaaaggaggtattgcaaatggcataattctggatctcattctactaatgattgcaaggtctttagacagcagattcaagtagccattgaaggggggaagattaagtttgatgattccaaaaagccgatgaaggtcgatggtaatcctttccccattaacatggtgcataccgttggtcggacagccgatgtgggacgagcgagaggttttcgcgtgaattcggctaaaattataaataagtatcagaggaaatgcgacaaacaacaagagaggcattatgaagaagataatgatggtttcgatcctcattggaattgtgagttctttcggttctgctggaacgaaggaattaggttaccatctattgaagactgtcctgggtgcagtaatattacagagagttcaagccgattgtacaaaagaggcaattggctgaagcaagccagagttcccgttcatcaaaggttgggcccggtaaatcaaaatgattacttggagggagacgagaacgcgaagactcagtggtgtccttctggtatttttacaaagaatcagaaaagaagggttcaaaggttgaggagcagggagcgctttcaggaggtcgaacaagaaattggtcatcggctgaggaaagcaaagccaaggaaggagtggcatgttaagaatcaagttcttggagccgatgatattgcagccgacgaagctaagaggttggcaaaagggaaaagtattgtaacaacgccaattaacatggtctttactttgccagccgaattcgggattgatcaggccgatgttgacgaactggaagaggaatcggccaagttggttctatcaccagaacgagcagtctttgaaaagcctgaggggacagaaaatcggcatcttaaaccattgtatataaatggctatgtcaatgggaagccgatgtctaagatgatggtcgatggtggggctgcggtaaatttgatgccttatactacgttcagaaagttaggtagaactactgaggatctcatgaagacgaacatggtgcttaaagactttggtggcaacccatcggaaacaaagggtgttctgaatgtagaattgacagtcggcagtaaaactatccctaccacattttttgtcatcgatgggaaaggttcttatagcttgttgcttggaagggattggattcatgccaattgttgtattccttcgaccatgcaccaatgcttgattcaatggcaaggcgaca

SEQ ID NO: 55997 - DNA, 2334 bp, Oryza sativa
attttgagggcgtcgtggagggttcaagcatctacgccaaggacacggtagatgatctcgatgacaagcaaggtcagggttttatgtcggccgatgatttagacgaagtggatataggtccaggtgatcgaccaaggccgacattcattagtaagaatttgtcttcagaatttagaaccaagctgatggagcttttgaaagagtttagagattgctttgcttgggagtattatgagatgccaggactcagccgatcgatcgtcgagcatcgattacctttaaaaccagggattagaccacaccagcagcctccgaggagatgcaaagccgatatgcttgaacctgtcaaggctgaaatcaaacgtttgtatgatgctggttttattcatccttgccggtatgctgaatgggtttctagtatagttcctgttatcaagaaaaatggtaaggtgagggtctgcattgatttcagggatttgaataaagctaccccgaaggatgaatatccgatgccagtggccgatcagttggttgatgctgcttcaggacataagatactaagttttatggatgggaacgcggggtataatcaaatctttatgaccgaagaagatatccataagacggtcttcagatgtcctggtgcaatcggcttgttcgaatgggttgtaatgactttcggcttaaagagcgctggagctacgtaccagagggctatgaattatatatatcatgatctgatcggatggttggttgaggtctatattgatgatgtggttgttaaatccagagaaatcgaggaccacatagccgacttgagaaaagttttcgagaggactaggaaatatggtctgaagatgaatccgacaaaatgtgcttttggtgtatcggctggccagttcttgggatttcttgttcatgagagggggattgaaatacctcagaggagtatcaatgcgatcaaaaagattaagcctccgggaaacaagacagagttgcaggagatgatcggcaaaattaattttgttcgaaggtttatttctaatttgtctggaaaactggaaccttttacaccattgttaagattgagagccgatcagcaattcacttggggggcagaacaacagaaagctttggataatattaaagaatatttaagttctcctccagtattgattcctccacaaaaagggattcctttctggttatatttgtcggccggtgataagtcaatcggctcggtcttgattcaggagcttgaaggaaaagagagggttgtgttttatttaagccgtcggctcttggatgcagaaacaaggtattctcctgtggagaaattatgtttgtgtttatatttctcttgcactaagttgaggcattacttgttgtccaatgaatgcactgtggtgtgtaaagccgatgtgattaagtacatgttatcggctccgattttaaaagtgagagttggcaagtggatattttctttaacggagtttgatcttcggcacgaatcaccaaaggcgattaagggacaggctgtagccgattttattgtgggtcatcgtgatggttcaatcggtttggttgacattatgccttgggtattattctttgatggatctgtatgcagtcatggttatggtatcggcttggttataattgcgccttggggggcaagttttgaatttgcctatgctattacacaccatgtgactaataatcaggctgagtatgaggcggttttaaaagggttacagttgcttcaggaagttgcagccgatgctattgaaatcatgggtgattcgttgttggtgattagtcaattggcaggagagtatgaatgcaaggatgatacattgatggtttattacgaaaagtgtcgaacgttgataagtgaatttcggctggtgactctgaggcatatatctcgagaacagaatatagaggctaatgatttgtctcaaggagcgtcgggatataagccaatgacaaaagatatcgagatagagattgctacaattacagccgatgattggagatatgatgtgtttcagtatttacagaatccatctcaatcggctttacggaaattgcgttataaggctttgaaatatactttattggatgatgacctctattatcggacgattgatggggtgttgcttaaatgtttgagtgccgatcaggcaaaagttgcaatcggtgaaattcatgaagggatatgtggtacacatcagtcggctcataaaatgaagtggttgctccgacgtgctggatatttttggccaacaatgctggaggattgtttcagatattataaaggttgtcaagatt

SEQ ID NO: 55998 - DNA, 5267 bp, Oryza sativa
cggcaaaggggcaagccccctttctccccctccttttccccttttcctcctcgccggcgtcatcctccctgtcgccgctttggccacgaccgccgagcgccagctcgcgcccttgaccgcgcaagtcggttcccaaaccgacattgccgcccctttaaacccccagcctcccctttcccttcctcttccattcgtctccgctccattgccgccgcccccgtgctctgtctcgcctccgccgtccttcgccgagcgccgggagagccggtgcgttcgaggacgcggaaggggactccgggcgtgccctcgcttcttcctcttcctcggcccgaggccggagagattactcccgcgccgtcggcctctcgtcacagcgcccctcctcttctcggtgatgcctctctccgttcttcctcctcgctccatctcccccctagctttcggtagtagcttgagtagcctccccgtagttagccggcgccgccccgaccgttgccgtcgctcgccgtgtgctcgccgccgtcgccgcccgagctccgtagcccccgctcgtcgccagcctcgctcggcgtagttccgcccaatccgacgctagcgtcgagttcccgaagccgcgtggatgctctcaccgccgggaatcgacccctcgtggcctcgtcgccgtttccctcttctcccgccgccggttgccgccgccgcaatccgccgccgtcgagcaacctccggcgaatccgagccgttggctcgtctccccttgtcacgtacaaccacccggtgtgctcgcttttgcccgtatcgccgtggttcactccgccgctcgccgtcgccgcccgccgtccaatcgcggccgggtcgtcgtctacctcccgccggcccgcgaggcagccacgtaggcgccacgtcggcgccagctcagcctagaccgggtcgagccgaccccggtcagcccctccccttgcgcgcgttccaccgcgagccgagaggctgcgcgtgggcccgccgcacccgcgtccaccgcaaaccgcgcgcgtgcaccgcgtccctccagcgcccgcgcgcgtgcgcagcatgctcccacacgcacggtgagccgagccgctgacaagcgggtcccacccgggaccgcgcgtggtgagccctgtccaccggcccatcactctctcctccccccccccgcgcgcgctgtgggccgccttttgggccggccggcccattaagctcagccgagccgccccaaatctcttgggccgcaccctagccgcccgagaaaagtctatattccctccccctttttttttgcttttctttttcttttccaaaaaggatttaattaaatccttttcctttagaccaaaaatccaataatcttagaaatacaatatcttcccaaccgtaagtccgtttgactccgttcaactcccaaaattcctcaaatctcgagatctatttaatggcatgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatctaattatattgcttgaaaaatattatgcattgataggatcgcatttaatctgttgtcccgtctgcaaggcagattggcggacttacctaacttgttgcatttgatccttccattgttaattgctacaccatgtccccttgtaactacccagttgcacctcgatattcgtgcactctgtgcgagtatcgacggtcgccttcaaacttaaaatctgagtaacaacttgggtaaaacttgggttttacaaaagattggaaaacccgacacctgggtcggtgcttgcgaactaaatgaatttccaaaaccgcggaccggggaacgtaccgggtgtacggtttcccgctcttgcacttaaggaccgtttccttggaatttcatccgaacataagacaagtacgaccacatgggtagaatgggacacccctggctgagtaactagcttatcaggggagccttgatgccgagagacatgtggattcgccggggtggtgtcagggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaatagtcgtgcccacggtcatgggcggatgtgaggtgattcctagcgtagttttgtttgactactgcttgtgaaattgctgttgagaaaaggggttcgatgtttgaaaaatctgtagctgatgagatcagctaggcccgggtggccgtttgaaaagttgttggcccaggtggccgtttgaaaaagctgttggccgggtgccaaccttgtttcaattctaaagactgatacattgcacatactccgaccggacgagacgcactgtctcatccgtgtcgtttgagaagcactcacttagttgttttcagaaaatggttcaaataaaatcaattgctaaaacaacagccttcccttgaagcctgcaataaacaccttatttcccctggcttgctgagtactcccgtactcacccttgctctatataaataacccccccccagttgctgaagaagatgaagcggatccggctgatgaagagttcttccaagagcaacccggcttcgatgagttttagggtttcggcctagttcccaagtcgcgcctgtgatgattggtccaagtcctgacttccgctttccttttgtaatgcagttgtgagctcgggatctgtccgcagcccaacatgactgtacttctactctataataaagagacctctgttgttgtgatattctgtctccctgtgataccagcactgtttcctgggactggtatcgattaacaggttaatttggagcgtcacgggctagttccggtcggtactagtttggggcgtgacaatatgtttgggcaaaagtctgccgtaaagacttatggtatcttagagtttgttagagataatagtcgtgtccgttatggacgtatcttgtaattctcagatataagtagacccgagccctatgtaaaaaaaggactcatccaatacaatctcagcgcatcgccaccctttttattctatatgcttgatctatgtgttaaatctgccctttatgttaggatcttgtcgcatctagatatattagacttctgtttggtatattctacttgctttaacatcttaatatagagtggtatcggagtattagccgatgcatgctagatacatttgatcggctatgatataaatgtatctaatcccactattaatatatatttcgatctaaatgatttatactgtctcggcaaggcgaccgatctatcccaatcacttgatttaaatatatatcgatataaggattatatatcattaatatctacagccgatcgagtagatttagttatgatttgcttattgatatttgccgatcgatgtacgtatgacatcggcttgaaataaatgatatgtcatcggcacctagccgatcggctatcatttataggattaattgcggtttttttgttctatttcttattgattgcaggatcaaatcaactggcacgctcatacacctgaaggcgagttttggacctgcactggagttgagcagatctcccaggcctcgtgttttctatcaacagcggcggcggtccctggcgtagcgaattgatggcgctcgctggtctcaggcatgtggatcgatggtggcaacgtgtctcgggtagtttcatcttggcaacgacggcaacaaccgcaacttggcagcgatggcgatgactgtggtgagggtgccaaatcggcgacatagctgactattgcagaggggatttggggaatccgtggttgtgattgtggtcttggagaaattgcgtgaaaaggaaagtttgggaggttttattttcgaaaaatcatctccatagacggtcggcttaaccttgttgcttgcagaaatcggcttaatagccgcttacaaaaaaatgatttttttgggggttaaagccccgcctataaaaatcatcgatgttcacacgtttttgatcgcaaggtagggacgtatggcctcatgcaaacacgtgttttgcagtagtgtatattgggtactgatcgacaggtaggctccttgtcacgcgtactcattttgttctagccgtactcgtatatatgtggtccaatgacatctatttttggataatggaaattgtcgacgggggatacccgtagaccagatatagagggtattggggtccgttgatacgaggatctacgtagtacgacatcaagcaaacaaaagacaaggattatactggttcgggccccttggtaggtaatagccctaatccagttggtatgggattatatgatggaaaccacataatacaaagggaataacagaactcgatgataccgacgagaccgtagtcgagttagtccgactagatctcccggcgacttggctcctgtaggccccgactccgtaggttgtggtgggtatattggcggtgatattcgatattcgatgccttaggtcctgcccaaggggtcccttatataccgcgggtcagttaatctccaagtagaactcggagatatcggacccctcacgatatggtaaaaacccaacctcatccgagtaggactacttccattcgtagattatgtttctatcacgggatagatttccttaacgtatacgaaaactatccgtacacgcgcgggtataccgtatcggtacccatcgtatatccaaggatagagggtataccttacccgtaaccctgacagaaatattttacatttttgtttctaccataagacaaagacgatgtagaaagaaaagttaaaagacatttccattatccaagaaaaagatgacatttgtctttgtctgccataagatgctggtctgcccgaagtttatataaataaaaagacgatgcaaagaaagaaaaataaaatataaagtgataggataaattctcaactcccctattgactaactttaagccatgtagatttttcaaagccggccgttaagaaagaaagaa

SEQ ID NO: 55999 - DNA, 1598 bp, Oryza sativa
accgtatgattaatcgagtattaaatattacaaaattttgaaaaataaatttgtttgaacattttaacactatactatatcggtccacatttgacgagccgaaatgcttatcacaaatggccttacctttggcgagtccatataaaggtcgtaataggtgaggacatcagccgaggctcatcacaggtaggccatcacatgtgacggggcgtcatttgtgtccgacaaaaggtcgccctctaacgggcattgatccgttagagataagtgaagtcatcactaaccactcatctttgaccaagatcaaacacatcaaggatgaacgttgagcccgtcagaagttataaccagacctggcatagtgtaaaatatttctatacaaatttcttttacacgaaacatactatttagtaatttgagaaatatgctcacgggaaaatggtaactagctcactcaattaaacagctagaaagaacggggctctacgtcgggaaactattttgattctcgaggggatattccctcgttatttgcataccactcaaatggttacgaaaaaataagaaaatatattaacatatgatatatcactcccttccacgtcaatcaatgtatttttgctgtctactagccttctcactacgtaggaatagtagtactctcttctttacaaattgatcatcatatataaaactttatgtttatgcaccaagactaaagataatttaaatcacatcaattaagatatcatgcacacattctaccataatacatgtattgattaaaacaatatgccaatgcaccttagtatgcacacatgtattctctcatgctgtattaattgtattacgatgaaaactatgttcatatggttatatgatgattaatttgaaaaattttaaattctatcttacgatgattaattaaaaaaaggagggagtagtacagtatttgcagagaaaaacagatgtggcgatgagttggtgtcaggcagagacgtggtgacctgggttatcagagtcaacgctcaactgaacacgaggcagctgataccctctgaatctgatcgaacagagtttacatgcaacagcagctccctcccctgggacattgccattgccacaaaacagacacggtcttccaccgcccatctcttctggatctgcaccatgcatctgcgtacgttggtcgggagacgggagtaatctgatgtgatcgatggtgcattttattttatgactactagtacagtactactactacatgtgcatacagcacgtccagtcgagtcgagtcgagtcgaggatgccattgccaccaaggatgtgtttagttcacattaagagcaagtttaatactagtatatagccaactactagctccaattcatctatagttaacctaatagctcatttatataatagttacatactacactattaatacatggtcccacatgccatacacacgctgcgtcttggagtccgtgctacagctggctacaaatatgtaacccgctgcccttctctctcctcatttatctccttaaaatatgtttgcagctggcttttagcctgctattgtacctgctctaagg

SEQ ID NO: 56000 - DNA, 1419 bp, Oryza sativa
tttttacctccttcctaaacaccacctaaaattagaagtttggttgaaatcagaacgatgtgatggaaaagttggaaatttatgtgtgtagaaaagtttttaatgtgatggaaaagttataagtttgaaaaaaaagtttgcaactactgcgtaaacacggtgtgagttccgatgatcaacacgtagtaccgtgcagtgcctaggctaggtctggatggacctgactagcagctaagagcaaggataattaagagtgtaattaaggtgactgtaacatgtagagtataggagtactggagtatctcttaattgtttgtgttgaattaactatgttgctttctattcagttatttatttatgaagatattactcacgttatgaaaagaccattatatacgcagcgggttatttgtgccggtcgatatatacatgaacattaatttatgccgccaagactgtgcgtaggtcgggtgagagcctcagatcgagcgtgtgcctgctatgtatggcccgttgccaatctctacactcttgtttttgtccagctcactcgtgtagtactctagaaaagaaaataccacaagtcgcaaattaatgctactcgtatatccgacctgtcaaatgaggggaattcatgcatgattgtagccagcgtaattaaggagtgatctgcactgtttatcgcatgtgttgatgcatgatcaaactgacactcgagtaccaaggtccaatccatcaaccagtcaatcaacctaccctactcgtatgcagtcatctgcagagtagtactgtagcaggcgatttgaggctaacatcatcatagtgacacgatcacgctctgcagtacaatatcacaaccaccaattcaagtgcgagatagtaccctttgttgctagtctatcgcctcttcctaagggctgcaaacaacccaacccggaacctcgtctaaaatattggtgcaaatacacacatttccacagtgcaaatacactcttttatgtggcttaactggttgaatgtactgtaggagtaaactgagcccacagtggacatgacctcacgcgtggacacgggggagtgggacggaattcatttccccacctatcctcagcgagacatcacttctcctagccctcccctccgtcgctctcggcgacggacttctcgaggccgtgtaggcgcgcaccctcgccatggctgccttcctctcctcctcctcctcctcctcctccccctcctcctcgctacagtagtccacgaatgacgtggccacggccgtagcggagaagcgacccgtgtgggggggaggggagggagaggaggcaaggcggcagcaagcgacctgccatggatttctgttcttgattgttctttcaagatggatgttttttcgatctggaattactagcatgtctgatg

SEQ ID NO: 56001 - DNA, 8592 bp, Oryza sativa
  unsure (1)..(8592): unsure at all n locations
tgatgtcgtggggattatggagggcgatttggggcaggtcacggggcagtgaagaaatgctacccacagtgggcgtttctcggttttccccgtccgctcgcgcccttgccgccccgaagttttgcgccgctcagacaagggacgagaaacctagctgaggcacgggcgtttgctccacgtcgacccgaatccgagctggcgcaacaagatcacgcgctagctcggtgcactgtgaaaggcctaaggccgtgaactcatggatggctaggcaaaataggacaaaatggcatcatcaggcaaaaaaccgacctggaggtctaagggcccctttgaatcacatgattaaaaaaatataggaataggaaaaacgtaggattttaatatgagtgcaagtgtaaaacagaggattacaaaactcaggaaaaacacaggaatggctgtttgattggaccgcaggaaaaacgcaggaattaagggcccatttgatttggaggaaaaacataggaattttagaggatttcaatcctatagaaaaatttcctatgaagccctctgaaataaaggattgaatcctatctaatcctttgaaattcctatggaatggacaatcctatagagattttggaggaaatttagcaagagcttcaacctcttgctaacttttcttcgagtctatctttctcatccaattcctgtgtttttcctatggttcaatcaaacaatcattcctgtgtttttcctgcgttttgcaatcctccattttatacttacattcctatcaaaatcctacgtttttcatattcctacgttttctcaatcctgcgattcaaagggggcctaaaggagatatgaagggcccctttgaattggaggattatcatacgaattttggaggatttaatttcctaaggaatttttcctatgaaaccctttgattcataggaaagtataggaaattttccttatgattgtattcctgtagctcaatttcataggaaaataagcaagaggttcaacctcttagaaactatcttttgctttgtttgtttcctatggtgctatcaaagggaccctcttcatatttcctgtgtttttcattcctgtaggattaggaaaacataccaatttaattcctacatttttcctattcccgtgtttttcctatcctgtgtttcaaaggggcctgaagactcataggaaagtttccatgaggtagaacctcatgctagattttctctaaaacttgcatgtgtttaggcattccataggaatttcacaggattttataggattcattcatttgattcaaagagctatatagaaaatttttttatagaaatagaatcctctaaaattcctatgaatttcatttgaatcaaagtgggcctaaatcagaaaaacttgatcgtggaggtgaagggtgatgtacaagtgggaaagagacaaaagaggattgcatgttttaattgacgacagcgatgggatatgcacgcccccttaatttcgaaaactggatcattagcaattaagtactcctcctcattagagtagggtcgtctcatctggacgcatatgcaacgctgaagcttttgtcagaaagctgtgtactactagtagtagtgtatagtacggtactacagtggtggatccaaattgtatgaaatcccgaggcatgcagatgagacgtggattgatccttgctgtgctgtgctgtgttccctttcctttcctactagccgcgcgtagcaatgcaggatgcagtagctgcacaatgcaggagtactacgctggggcttctgtgcagtgcagtggtactgcatcttcacgtttgattcggctgcttgcgttgggctcggcactactagagctatatttccttcgtcacattttaaacgtagagataagttttcgtgtttaaatttaattatttgttttatttaaaataaaaaaacatattttgtaaaaaataaaaaaaccataagtcgcacatatattattatttatttttattacctaataacaataaaatactactccctccgtattttaatgtatgacgccgttgattttttaactaacgtttgaccattcgtcttaatcaaattttttatgcaaatataaaaatatttatgtcatacttaaagaatatttgatgatagatcaagtcacaataaaataaatgataattacataattttttttgaataagatgaaaggtcaaacgtttatcaaaaagttaacggcatcatacattaaaatacggatagagtaattataaaaaacttgaaaataaagcgaacgatcaaatctggcgacggaaactcatggctacactgagtacctagcaatttttagcatagtgctactcccttgtctcatattataaaagattttggatggacaccttatctcaatcaatcacaccaatttttatttaatttattcacctattttcttttttctcaaacaaaaaagtattttttttcaattactttcatctacttttttaactacctgtgctcattaaaaaatgattatgctttaggatggaagagctaagattttagcgatcaaatgctacccatcgttggtaggagtaccatatgagaaaaacttagaggttttttgactggccccacaaggtggtggtgggttcaaagcctgcggcagatgcagcaaaatccccccttccgtttcccgttccaggcgatcgagtcgagctgccgaggcgcgccaagagggagggagagatagagagattaaaaaagaaaaaaaaaagagccggtggggccgggccgacagagctggacaaatgcagacggaatgggggaaggccggggcccactaggttttgccatgtcccaggaatcagtgggcccgttggtctgacgccgacgttaagttcgtccacacacccatcgaacccgaacaaaagcagttcatctcaaacttgaaactgaaagcagcaagcaagcaagaattcgttcgtgtgtgcgcatgcagatgcaggcacctccgcatcatgatgcattcatgtaacgctttctttctccaccccacacggccacgtcgctctctcctcgatctctataactcttttctatatctgcacctgcgcgtgtgccaatggaccgatatcaacttttccgttccattgccgtcgtagcagtattatattttgccttttgcaattgtgtgcaggtaggtaggcgtgattagcttcttttcttttgtttgtttggcacacattaaagctaaagaaaaccaagcttaaaagcgatcgactttgtttcttcttcacaagagaagagaatggattatgtgtgcctgctactgctctgcactgcatgccttgttgcttgtgacattttcggttaattttcgatcagcgccaattcaaaggcagagcgcgtagtagtgacatccgctcattccaaagtcagatttactgcgttccaaaaaagaaaaaaaaagggtcagatttactgagcttttgctttggagagaaggaaagcctcgagtttgttcatgttgtgccttgacaggattgcagttaatctgagaatccgtcggtcgtcttccttcctccgagtccgacgacgagagaagaagcaaattcgaggagagagcggagggaggctgtcctcctctttatttattgaaggaaagaggcagcagaagcactccctgcacgaccccactccctctccactccaccacctcctcctcctccactccccacctcgccgccgcaagcgcccggccgccaccaccaccgccgccgccctcttcgtctctctatcttcaatcttcgcctaccttgtctcctccattcttcaaccttggcttccttccatttcggcgccactattctttctttttcttttcttttcctttcttttctgagtcgctgtgttggaagccagccttggaggcattcatgagcgcccgacgaccagctccatgatgaccggaggccgccgatggaatggcagatcccgtcgatatcgacaaggtactctccctctccctctccctccctccctgcacccgccgctgcctccatctcttcgcgccttttaccacctttctttctcccccatcttataccttgcgtgctgctaaatgccggcaactatcattgattgctgcaaccaaagctctagcctttccttcgctccgacaatctctgtcgttgtagccttcttgctggtgttgttgtagattcaccgcggattattgaggaacacgcacttttgacttttaattcaatgccaacaatcacaacgtgggttgcatgaatgtagccaatgctgcccctgctctctcaaatgttggcctgcctatttgcatttggagatccttccagggttatgcttactgcaatgcccaattttgggaggggaaaaaaatctgttcttttatttttttaaaaaaaaacataaatggaaggggaaattgggaacgaacaaaagaaaggtttgtcaagttccactccacatacttcgaaattttcgatgtgcaattgcaaaccgccgattgagctgtgctgaattcaattattagtcggatggaggattgttactttcactggagaatgctgtggcttatcgagtttgaggcttttttttttgtttaccgaaagagtttcaggccttgttccccctgctcgaattatcttgtgctatgcacagatatagaaaggaggagaagctggtgcattagattagtttctatatatcaagttgaattgatgcttatcgtttctagttgccattcctttcttttttatgggatcctattcttatggggtctctgatgttttgattttactcttattactccttttttttaaaaaaaaaatcgttactctctctggataatgaaaacgacagaatccctgccttcttgctaaaaagaatcatgaagttgaatttcagggtcttgtttacctacttggttcagtgcttaagataaataatgtgtgccatttgtgtgagagacatacaactagtgatgaactcagttttgtcttcttctttttttttgttaggagttagcactatctcacaaatctcatcatttaaagcatcactatctgggcaggttgtgtgattgtgtcctagaaatcttgacgatcaggaaaaagattttgagtaatcttgattatatgtatatgactgcgatgtctgctttccttcagatagatcctactcttgttttggaatctggataactgggttcttggagctaaccaaaatatcaaaatcaaaattttaacaatgtcaaaatgcaatggagaaaacaaagggacaggcagacacttccattagttacttttgttttgagggaatagacaagaagacacttggaattttcccattagcattgatgctatcgaagttttaattgtcaattacatttccaagaaaatgttctaaactctagtgatctgttattgaagttttttgctaatgttttaccaatgttctgcaccagttactctgcttcataattctgttcgtcctaatgcatctggcaggcacttattgctttaaagaaaggcacccaactgcttaaatatggtcgcaaggggaagccaaaatttactcccttcagactatcaaatgtaagtttactgtcttgtgcaaccttttttgataaaggtgatctcaaagtacggttttgaattccacagttccagcctgaaatgtggatgggatttctttttttttaaaaaaaatatctaggtccatattatgttgtttatggtgctacttacccaagagtacaaccattggagcagaaaccacttaaattattgacagctagaaaatttatgacatattaatatgaaactgagagcaatgcaacttccatttgtagttattatatgtacttacgcaactttctttttcatgctccacaggatgaatcaacactaatttgggtctcaaataacaaagagaaaagtttgaagctatcatctgtgtctagagttctctcgggacaaagaacagtaaggacttactttttaactatatggcaatttgtttcatgcatttgatcttcaacctgtttcttttcagttggtttttcaacgttttctgctccctgagaaggaccatttatccttctcactcatatataatgatggcaagcggtctcttgatctggtattacaacaaggatcaattgaactttatttcttctctttcatttctgaatgaatttcatctaatgagccctaatcttgtttcaaagatctgcaaggataaagttgaggcagaagtatggtttgcaggccttaatgtattgatatctcctggacagcatggatcccaacaccaacacattgatggaatacgcaacggtgccctgtcttttgaggtaaactctcttcaacacagaccactttgtgaatatatcattgtttgagtcatgatttcacatcatcattacagcttttttttttaagaaaaaagaaaaatctttgggcagaacgctatcagtatttctagcaacctcagttcaaagtttctgtctgtacactgtgttcaactcttgggtcattatccaccacctatgctctagtagctagtacaagttattgttgttgacgaaattcccacatgcattgctagtagtaatacgcattatccatcatgttctgagaactagcctagcatctaggaacatctcatagaagcagaaccacagttttgattattctatccaattgagcttcttgtttgattaccaactttttgtttggtgcacttttggcctaagctatagggttacatgcatatttatattattgttttacctagttcattcaacatgttcttttactttatcttgttcattcaacatattttttatacatcatattatcttgtactgctgcttgtatgttaaataaccaataatgcattcctgtggtttattaactgtcaagaacatgctccatatctattttcaaccgaatgatctttcaattgttaatcccatgtaaaatagatgaacctcacagttacatcatggcatgctatgcttctgatttgttttttgtttaaattgcttacagtgtggcagagatagtagcctaagcagtagctctgcttatacaacggattcctttgagaataagttgagctcagcgaattctgccaaggatcgttcttcaggagaatttacatattcagaaaggacagatgtgtcagatatgcaagtgaaaggtgcttcttcagacattcgaatcagtgtttccagtgctctcagcacatccagccatggttctggagatgattctgaatcttttggagatgtttatgtatggggggaagtcatgtgtgacactacttgtaggcaaggatctgacagtaatgcttactctgctactgcagctactgatattcttgtaccgaagcccttagagtcaaatgtaatgcttgatgtcagttatgtggcttgtggtgtgaagcacgcggcactggttactcgacaggcagaggtatttacatggggagaagaatgcagtggccgtcttggtcatggggccggcacaagcatttttcaaccacgtcttgttgagtcattgtctatctgcaatgtcgaaacaattgcctgtggtgaattccatacttgtgctatcactgcaactggtgacctttacacctggggagatggtacccacaacgctggactccttggtcatggaagtaacgtgagccactggattccaaaaagagtttcaggtcctttggagggccttcaggtgtcagctgtttcttgtggcacatggcatactgctttgataaccagttctggaaaattgtacacgtttggtgatggcacatttggagtcttaggtcatggaaatagagaaactatttcatacccgaaagaagtggagtcattgaagggtttgaggacaatttctgtttcatgtggggtgtggcatactgctgctgttgttgaggttatcatggcacagtcaaatacttcatctggaaagctatttacatggggtgatggagataaatatcgccttgggcatggtgacaggtcttcaaaactgaaaccaacctgtgtgccttcattaatagattacaatttccataaggctgtgtgtggtcatactctaacaattggattgactacttcaggccatatatttactgctgggagctctgtgtatggacagcttggcaatcccaataatgatggaaggtatccacgcctagttgaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56002 - DNA, 901 bp, Oryza sativa
cacgtggcgccaaacccacagggggtcggggacgccccagccctcggggccgaaacaggagcggccccgacccctcggggagacagagggaggggcggccacatcaccctcgggcccgaccccccgagggggtcaggccacgtgggtgaccgcggctgccccaaaacctctagtcaagatacccccggtcccatgtcaccgacacgaacggtcaaacatgtttaaaaaagtcaacggcgtcaaacatttagggaatgagtaagtatattatattgttacaataagtaattttgtgatattttagttattcatttgtgatagttgtacatggtgttttttcttcagcaatatctcgtgatgttgcagtttatatacctgcttgttttcttttatttttgaaaaagctttgataatttcatcccactacatattagagaatgttccatgtttagtcaactgttatattttgaccagcatatggatttttacgctcggatcagacatccgacgtctactcttgtcataatatatactccctcgttttaatgtaggacgtcgttgactttttaattaacgtttgaccactcgtcttatttaaaatttttatacaaatataaaaatacttatgtcatgcttaaagaacatttgatgataaatcaaatcaaaataaaataaattataattatataatttttttgaataagacgaaaggttaaacgtttgtcaaaaagtcaacgacgtcatacattaaaatacggaggaagtacttaatttctaaacattcggagcgtaacgaatataaacacagaaagtccccgtaaggtagcgagataataaaatacacaatgatcttttcataatactactaactcaaaaaaaaaaagatgcaatgtaatggagt

SEQ ID NO: 56003 - DNA, 799 bp, Oryza sativa
ttcctccttgtggctcataagcaccatcaccttgaactgcatgtaccccctgagagccgtcaccctgattctcttgagccgagccatctaaaactcttttttcttctccttccttagagatactggtctccggctcatcgggaatcacctttaccttgtacttttgaacaaatgttccattgcgagtctgtgtgaatgacctgaagaactgttctcgtgcttgttgcatcattgcttcgaaatccttcttctggtcaggtgtgagcttttccggatcaacagccacaatattcccttcattgactttgttaaatcctaacctttggattgtctctttaacagtacccggactagccgaggatggcgacggtggtagcttctcggtcatgaggaagattgatttctgacttctaatttgtcccactgggcgtgccaaaagcgtgttgacagaaaacacgagacctgggagatctgcttaactccagtgcaggtccaaaactcgccttcgggtgtatgagcgtgccagttgatttgatcctgcaatcaacaagaaatagaacaaagaaaccgcaattaatcctataaatgatagccgatcggctaggtgccgatgacatatcatttatttcaagccgatgtcatgcgtacatcgatcgacaaatatcaataagcaaatcagaactaaatctactcgatcggctatagatattaatgatatataatccttatatcgatatatacttaaatcaagtgattgggatggatcggtcgccttgccgagacagtataaatcacttaa

SEQ ID NO: 56004 - DNA, 823 bp, Oryza sativa
taaaatgattgcttgatgacatataatgaaagttttattgtgtttttttttaccctgcaaaactataaattttggatttattactaaattcttttgtgaaaattctggctagacctccgcgacactccgtctccgacgcgagggaggctacgtggagcttgggaagccggaggggctacgacagcgaactctggcgtgaggtggtggatctagtgctgcaccgaccagatccggtgcccccacggctagatccggcgtcgagtagctgatggcgggaggtgacatccgacgcggggaactacactaggaggccagcgcgggtggcatcggcggcagtaggagaccgacggctgcaagggatggcatcattggcagcgggaggacgacgtcaacaaacggtaacaggaggctaagagcaagtttaatagtagagctcactagttactattagtcaatgttaaagctaacatgtatagcaggttggctataaggctatctttattttcttcatcctctctctttctctcaccatgaatttaatacatatttcttagagtttgtgtgcagttagctcttgcatgagagccaacactccacacttttatttatctctctcttccacataagcatatagcttgtttatagcccactattatccttgctctaacattggcaagctgatgcgggcggtagcgggggcggcagcaaaagcgagggaggatggctcgtcggttgcaacggacgggcgacaacgggtgacagcagacaacacgcgtgaagtgggaggtccatgctacaggacgacacattttctgtttcttat

SEQ ID NO: 56005 - DNA, 1876 bp, Oryza sativa
gtgtactacacacagataaatatgtgtgttgatgtaagtgtgatgatcgaaaatgtgtgtgatgcagatcagggtgttggatgagacgatcaggaggcttgagcagctgttcaggttcacccaagcaaacaacccgggccctgctgtgctgctgaggatcattgggaggatcaaccgtgcaaacgccaggagatcaacgctcttcgcccagctccacacctacattcgccgccgccgccgtcgccaccaccagcaacaggcgcctccgtcgccacctgccggcggcaacatcgccagcaacggcaacggcgccgccatcaacaacggtaacagcaacaacgctgctgctggggctcctcctgccgatgcatgagctagcattgaccctagcttgatgccgtgatgctgatggacgcatgtagctggagatgatgagtgttgctgtcgtttctttgctgatcgatgttttctagctattgaagttgttactagaagtcatcaatttatttctaccggtttaatcagttttctaataattaagctagcagttgggaatgtgcaatggatttttctaaaagataaattgaatatgtagctggagagatcgaataatttttgtaactcgccttgcctctggaattgatcaatcgggtgatttctgttataaaagatacagcagaacgacgactaactttctcgatcgtttcagttattgatcacctaaaacacgctagatgacgacataagaacacacgacattaatttgttaatgaggttcagctgaagcttacatccccagggctttgattatggatatttttctccaaccaatatagctactagccgctacgagtccatgaccacgccgccatcatctccctgcgtgtctacgctacattgtaatcgctatggttatattgtggtgcccccctaagacatggttacatggctacatggctctatatatgaaattggttctaaaacatactccatccgtcccaaaatatatatagcaacttttgtttggatgtgatgtatcctagtactatgaatctcgacatgagacatgtctagattcgtagtactaggatacgtcccatccaaccaaaacttactatattttgggacggagggagtagataaggtcataacagttgttcaatataatgagggaaatatcttctctagatatgtaaactgagttcatcttagttttgtccttcttgtttatgttattatgtactcctacgactacagcatcgtaatgtaccacgatttgatgagtaatactccaatattcaatagttgcctaccatagttcgcgtaataagaaaaggaatactgataaaatcaacataacagagtacgttagactaaagaaagttttgcatcgggctgacaaattccaacctagatggtgtacacatgcaaagcacaccctctcaacctttatacaaccactaacctgtgtgcaaacataagagtgatatataatcaagattgcaccgtgaaccatttcccgcgcaattggatgaagtccttataaaataataaaaaaaggttatgattctagtatgacgactatataattaaatgaaccgatatatttcccgcgcaattacgtgaataaccataataacgaaccctaccaattatagctgacaacgtgtgagtaaacctattacgtagtttcgtgtaaaataaactccacttttattaagttagagtagtaattaatgcacaatatttccatttgtctgtattgctggtgtccattccccattatttttcttgtgccatatgcgtatgcaaggtgcggcctcttcagtggccacgtcagccatatctcacgtcatgctaataaagaaggtgcggg

SEQ ID NO: 56006 - DNA, 6248 bp, Oryza sativa
gcatgcatgcatgattgcccacagcaaaaaagcttggttttgttttgccattaatcgctgttcccaaggctatatacatggcttgatcattagtaacagctgtatgttcaagctgtgttaattatatatggcatcgatttggcgatatatatatatatatagagagagagagagagcgcgcgcgcgcgaagcaaacattataattaaccagagatcgattggtagcttcaaaaacttaaggaagaaaaacttaggagtaatttgcatggattattattattattattattattatatatatgtatggagctgagtacaaggcttaatggttttacttttgctacgtaaagtcgtcgatcgactattagttagcctcgataggcagccggagcagctagacaagcaatctcttgtaagcagaggagatcgaggaggagaggaaagatcgaacacgaagaacgcgtgcatgtgcgctcgtatatatcatgcgctcatggcgccaaaacatcatcgtcgtccacatgcatatgcagttttagtttagtttaattaatgcagtaagttttaaaaaaaaatgaacttagtagtagagcagagagcttaattaactagctagtgatcgatcgatcatatgccgctggccttgaagagcctcatgaggccgaaggtgatgcccatggcggcccacccaccgagcaccaccctcgcgctcgaccgcgccaccgccgcccgccccagcaccgcgcccacgcacccgaacgccgccagcgccacgctcgccaccgccaccaccaccgcgatccgcagcctgtagttgacgatgaacccggccgccagcagcggcaccacggcgcccaccgagaacgccatggccgacgccgccgccgcctgcgcggggctcggcagggccttctcctcctccccgccgcgcttgccatcgcgctccagctgcgccagctccacatcgcgctgcgagcacacggacacgaactccccgatggccatgctgcaggcgcccgccaggaggcccgcgaagccggagatgaccatggcgcgcgcctccgccttcacggcgcccacccccagcatcagcgacgccgtcgacaccagcccgtcgttcgcgcccagcaccgccgcccgcagccagttggcgcgcgccgccaggtccagctcgtcgcccaccgccgccgggttctcggcgtcaacctgcagcttgttgctgcttgatctctcgttgttcatcatggccgccatggctgattggctggcctgttagcttaattaattagctgagatcgatcgagtggatggatgggcagtgtggcgagcacgcttcttggcgtgttttatagtggttttcaggaggttttggtgtggctattgcgtgtcgccaactaattttaaagctactacactagctgcagtgcagtgcatcgttatatatgcatgatcgatccatctctttttagctatctacctctctagaccaacacccttcacttttgctcccctgtattgctcctcgacatgatgccaccttccacgaacatttaaagtcacctattcttcaatatcggtgcttgccgattgtgtatgtgcaaattacatttatatctaatattaataattattcattgacttaactgacaattacttaataggctatatatattaccaatatataaccagctgatgtgtttgatttgtcgccaaaataaaccttaccatattttggtattatttctcaatatgtgagttgagtatagatttaggattttatgaagttgtatgtatatacattgtatgaattttgataggagataatactttttagcaaacgagtggacatccctttgagaaatcaaaagaactagcacggtagcccgcgcagattgcgcggctagcatcattatattttctctcatatatttagcatatatattttctcattattttattaaaatatattacaatgacaacataattttaaattttgcaataacttttaatttcaaatttcagttacttctaaattgtattcctatattgtctttaaactcttcttcccatgtttttcttaatttcgaattttatttatttataaaatgcatttttatatggactctaaacactacttttcattttattatgtttattccgaattttagttagttttaaatacctatatagactctagactctacttctaatattccttattttttaattccgaatttctatttttttcttaattatatttctatatggcctctatactctacttctaatattcctttttttaattccgaatttctattatttcctaatttcctaattgtatttctatatggactctatactctacttctaatattcattatttttaattccgaatttcagttatttcataattgtatttctatatggactctagtctcctcttctaatattccttgtttttaattccgaatttcagttattttctaattgtatttttatatggactctagtctcctcttctaatatttcttattttttaattctgaatttcaattatttctaaattgtatttctatatggactctagtctcctcttctaatattccttattttttaaatttagaattttagctatttctaaattgtatttctatatggattctgccttttctttttctccgattaatgtgagaatttccaggtcatgagagcgaacgtggaggctcctttttctattcctttaataatataataaatttcccatgcatttatatcttcaaactgtactgttcagtgaaatttgtcataccagtcgattgcactgatcgattccctgttctgacttctgaacaccatggagtgcaagccatatagtaagtgcctagcacgtactagatgatgcttaatttcagcttcaaggtaactgtgcaagatcccttgaagacaaaagaggcctctcgtaccttaacttactacatttggtggactactctaagcagaagatcgactcgtttgccattaattgtacctgaatgaaatgattacattagtttcactgtgcaacatatgcgctctctttagcatatactcctcctatatgcatttcaaagtaaaggagcatatgccatgcattgaagatcatgcatgttgctagctcaatttactactggtagatgaagtactatacttagaatcagagaaaagcccaccttaaattaacactaccttaacgttgtaagcaattacatatatatcgaagttatataaatattctttgtctatatgagtttttcaattttaagacatctttttttatttcacgccactacaccagggctttaaattcctaaagacggtacggtatactgaaaacaattgtagctagctagctcatacagtcaaagtgtgcgggattcggttaagttgacaggggaatgttctccttgtcggatgaaacctcattatttccttaattgtcacttcatatttacggccagtgcttgggagtggaattgcactttttttaacatgagaatccaagaaggaacaaattaaagaaagaaaagacaccggtctgtattaattctagaacggcttcgatcgagcccaatggacgaatctgcttgctctcatcttgcttccctcacagaagagaagaaaaaaactatacatatttatattagtcaaaatgtatgtagtagtacaaaaattaatgtcaaggtgtgcaatgcaaatcagttaaattaatcaaattgcaggcatccctctcgtggagactgttgtctttttttatccgagcaaaaaataaaggaaaaaagctttgagcggacattagacatgaacttttggagggaaagatgacaagtggtgaacggaaacacaactttgcaaatggaaaaaaagatgaagaagaaaaggcagctcgatggactccctgccatgggcaaagatcaacgacagaagaagaagagaagacaagagttttcaaagaaaacgaagaggacgatgacaaagtgcagcagagcaggtcaagatgttaggtacgctactcgatggcactcatccatcatccatgtatgttggagattatggagaaataaaaacaatctagtggagagatttgttgtattgattattcgtgaaaaatcgggcgagatctagtgagtgctgaatcggcagccactggaccataggtcgatcagagaaatggtacgtagctgctgcaagcaacggctcgcccaaacagccgaccggaagaacggcgtgtggaaagagctagcaatcagagtaaattaagaatgatgatgatcgagctagccgccatcacgcgccatggatcatcaattggtaatcaagtgatcagattgattaggggttaagagttcagacagacacaatagaggattaataataggcaagcacatatagatatgtagatatagtgcgggataagcatggcgtccacacgaaaggcaccactctaatccctctttcggttttatcaatcttatcccgaattctggctggctgctgctgcctgcccatatctttgtgttctgctccatctctgctttaccatctcattctccactctatgttgttgtatcatgccactggtctctctctctcgctttctctgatccctgcttgctttttcattgtagactgactaatgccattttcctgccttgatcgatcatataatggagcattttagctgattgaggatggcccttggggtcgcccaagcgagcatgcatgcactgcacgagcacaaatgcagtttgtttgttcagattaattaaaaaaacaacaacaagggctgcctcttgcaacgcatgatcgattgatcgttgaaaagaaacatgaaaagattgagatttttgccggccagaaacaaaacatcgctgtgctcaccgcacctggacgggatccggatctgactgcagttctcatcaacggatgcaaatcggacgatccagactgtgatcacactgttcatcatcgtactatagcaaaaacatcgtagcaagggatactattcatgctgttactgtaacagtaaatctaaaccatcgatcataaaaataaatggctgagattacgtacagttctcagaatactgtcacaacacttcttttagggaatcatttggcgtgctttattaatatacaaacattgttacaacattcactagaacgtttagaacgttaacaagaaaatatgggcctcatcaaaccaattacaagaattcctaaacttaaaaaagtaagatttgctagaacatgtgccacacaattggcttccctattacaatgctcaacagagattttaacaaaatcatatatcaaaatctggcattcatagaaaattgccgtagccgttgttaccaaaaagcacccatcttacatcgtctctaccacctgtaaacaacctgatcgggtaataatgcagtcacaacacttatctgaatccaactcgacggttgtaacttgtaaagccgccggtttagactactataaaggagatggagggtagtgggttgtacataaatgggcttggcctcttttccaattgtagtggcatacggcccacttcccttttaagccctcccccaaacacccgacactgtactggcctgcatacgggcattacgggcacggacggacaggtggaccccacctgccattggcttcacaagtctactccccacggtgggaagggaggcagcaagggatcgcgacgccgcagccgcaacggctttcccgtcagactcacgtcttccaccagcgcctcccttacacgcttcactgacagtgggtccagtcttccttgggacccacatgcatagggggccaccgcgcgagtaggtgaacccaccgtatagtactagtattataatccgctctacagcctggctgaaatgacggaaatgcccccgggctgctcctctgtgttgtgtagttgcgcaccgctatctcggctcggctggctccagttccccaccaaactctctctcgccatggccgcatccgactccgactccgacgccgacgccgccgccgccgccgccgcctcgctgctgccggcgcccatccacctcctgccgccggacgcgctccacaacgtgctcctccgcctccccctccgcgacgccgtcgtctgccgcccggtatcgcgcctcttccacgaaaccctctcccacaacttcctcgccctcctcccctccctccgcctcctcctcctcc

SEQ ID NO: 56007 - DNA, 8133 bp, Oryza sativa
gcccccgtcgagcgctccgcgtggggcgatgtcttcgagatcctcaagcgcccgcgcctcctcgctggtgccggcggccgccgtgtcctgatgatcggcggcctcaggtcctcgttcgccatagacgcgccatgctccacggtgctcatcctacgcctagatctggccaccatggagtgggacgaagctggccgcatgcctcccaatatgtaccgttgcttcaccggcctctgtgaggctgctgcacagggtaatgccatgcctactgctgttgctggtggcaacaacaaggtcaaggtgtttggcggtgatggcaaggtgtggtttgctggaaagcgggtgcgagggaagctggcaatgtgggaggaggatgagctaggcaacagcggtggcaagtgggactgggttgatggtgttcctgggtacagtgatggcgtataccgtggctttgtgttcgatggtgggttcactgctatgccctgaagtctatggagaacacataccagtccggtgcgtgactaaatgcgctcaggttaagattttaattgattcgggacatctatccattgcatgcagggggaattgacatgtcaaagaattttatttgcattgtacttggttcgtagcatcatgagatactttcaattgctgtacttgttaaaagtgaaatgttttaaatatcttttcagggtttgttgcttcagacaataaaattcaggttacttttattttgttttgatgatttcgtaggggggaatatgtgtatggtgatcactctgcttgttacatgaacaaggtgatcacatcgttataataactttgctgatcttgactcgcgacactacttacatattagttctcagtagtcagtacataattagttttcctactggccgcatgaagtggggaatcactatatataaagttaatgaattcaggtgtgccctagttctttctactcagtactttaatgttatcagcagtcatagcaagggcaggcaagtatacaatttttcctctgtgtgtgtgtgtgttctgtacttactattgatcttttgaatttatagtttcctagggcttggttggtactctagttatttgtcttctgaaatgaacatgaaaacaagtttgttaggtcttaagcttcatttgttctgaccttagatgtgctattgggatgccttatatgaaatatcatccagcagagtcagggatgctaaaaataggtcctaacacaagcatatatatatatatatatatatatatatatatatcttcattcagcatgtttcacatacagaatagcttttaggtattccaataccataaacgtgtctatgttcttagttaattcagcaataacattatatgttttatgctgtgttatggttcttaattccttatggattcaaatatctcaacacactcttttgctgaattcctctgtgcttgtacattgttcaggtggtgatcttagctaataaaaattatagaaaagcttttgacaggttttgttatgtaacaaggcatgtccatataattgataacttgcgtgctctcttgttgacagggtgtgttcgctagcccaggatcccaaccggaacagtgatcgtggaaaacggggcggttcattagggcgtgattaattaagtatttcattagggcgtgattaattaagtattagctatttttaaaaaaaaatggattaatttgatttttttaaacaacttttgtatagaaactttttgcaaaaaatacactgtttagtagtttgaaaagcgtgcacgcggaaaacgagggagaggggttgggaaccctgggcaaagaacacagccatagtgacgtgcaagcacctcaacttttttttcctcgaaaatgagcatctcatctttgaattcagaaagtcaggagtctacacaaaagagcatgcattcctcttctgctctgtgcttgcaggttcaggtggtgaacattatagaaaaggttttgtcaggttttgtttcgtaacaaggcatgttcatataattgataacttgcatgctcttattgacataatgacatgcaagcatctcatatttgaattcagaaagtcaggagtctacacaaaagtcaaagctagggtacagctgcactaattatgaactgtatgaagtggtacttttagaaatatagtgtagtaaggaagcccatttgccaaagattgaaacagttcatggtcatgcaaccttgggttataacaaactaatttagtccctagttgcaatgtgatgaggtgctttactaaacttaatttggtgaacacattatttagttcttatttttgctttgattaaagacacaaggagtataatatgctttgcttatcttcgttttggaccgtgcttattggtgactactacaacattaagttctaacattggttccagaataagtattatctttgttcatgaatgctttcagcttttacaattgtttgcttaggtggaggaaggttttaagtgatatgatcttttgtgttgacgattcatctgcctgtctcaaacattatgggcattggtctggggtcagggataaatggcatatgaataaggagtttgttgcttgccttaggtaaagataatatatgcatttttcaaactagaatttggtatttgttaagttatagataaagttgtagctacagtataatgctagagtaattaggctcccatcattttccctacagcttataagccactgtcaatttgaattttaaaacttaattttgaagttcattttaaggtttatttttcagcactggcttttagaaaactaaggacacataaaagttttggccacaaattataagcagtacggcttataattagcattaggccaatctaggtgtcatgcacctgctcgtcctatacaaagttgtgctttgcatgtagttcttgaagcaatgaataatcaatctgctataccttcattccttatttttcattcttgctgaagcttcttacttatgccattttctaacgaatctactgctatttctccaatgcctaaccaagttgctgtgccatgctataagcctttcactgaatatgaaattttacaagatgtatttggatatgatccctgaaaatttggcagatctatgggcatgtcacatcttcctgaatatcatcagatattcagattctactaaaccacagtttggtgttaatgatattgagctaaatacatcttgtaaaatttggtggttttgtgcgagtctatgttataacttcttcactgtttctgttttattgttcttaaatggttactttctggtatctactgagctggtgagtgatctgaaataagaaagttatgagagttctgattttgtgagccttttcaattttcatgcatcttttccctgtttcaaaatgttctctaagatctgaaagctataaattggtatgtctggttttctctgtacatgaacatgctccctagtattatttacctgtgttcttgatgttcgctagtctggggaagccatgctagtttgctcgagacgaatggacacttttattatgtttggcagcagtttagcagaatgccttaggtgaactaacagtctaacaccctgttgaattttttaagcaattacataaactggaatctgcgtactgttgggactgatagatctctatcttgtccatttaagctatttcataggtcttctggttacatcaaattgggaattttcatttctggtatacaacctcatgtgtagcaactcttgcttacttgttcatctagaaagtgtccacatgagcagtagcacggtggcattattattgttgcgaacctgttgctgttgtattgaaatgctttgccagtcgtcatctaccaatattgtattgtacggtatgtgccaaaatcaacaccgaactacgtaagtgctatttcaaggttagtataaaaaaattggaacgtgcatacaaatgtaagcaaactactattcaaagccatggaagcgttgttatcacgacgatcaaccgattgaatatttctgatgtgccatgccgattcattgttgttctcgtgaaggaaggttaacggaagcaatagtactttaaattttgaaaaactgtcttcacatcacatcttttgttacactgtaaaagttttatcgttagtgtggtttatgatgtcacaagttagtggtcggctgataattggcaaggctgtgctaatcatccggtgatctgataatgaacacgctctggtggctttagtgcttgtgatatgcgtccatcattatttatttcataagagcatgcaaggacccactctgattaagtggtaagccctgtagttggcatgaaaaaatgctgctaatattgatgtatgcacaatatagtaaggtgggatgactcggcagtgtgatcttttgggtcagcagctgctgtccgatttgtccacttgatcccgtgctattcttacctaatcctggattggattggcacaagctgctgctgctgcatttgatgttctactgaatttgtttgttttcccatcaacttactcgctgctgctagttgctgctggattgttttgagcagagcggcttcaccttcacatcgctatcgcagccggccacagcttcttcacactactggttacttactgcgcgataatacggaatttactccagcttttgtcactaccgcgtgacataattactttggaagtgacagtaatatcctttaatttgcacttgcagcataagcgtactttgtaggtggcgacaacaaagcgtgggctttaattgtgccgatgtcatgatccatttcaggtcaggttaccccagcttttgtcaatactttgccaaataacaggaagtctggaacttgattattccaacttgatgcgtttttgttccggtgcttacagcacaaatgcgcataatatggtgggtcgactttcttcctttctacgtttaaaaactgttatggttggacgcagaagctagctgaaagcaatttctggcagctacaacaacaaaatcttgcaacaactagttgtgcttggtctaactaatacgtagttcacacagtggtactacttgctatcccttgaaatttagaacaataaaagctcatgtcatagctaactgttaaatagaagctgtttctgatacaaccacatatattactatggtaatacaacttatattacagtatgcgccatataggggcttctttgaaacaaaggatatttggagattttgaatccggtggaaatagtccctatgcatatctttggaacaaatgagtggtcatctcaaaaccatataaattcttatgaattgcctcaattcattagaattttggagggtttctagcataaattccaacctcatgggaatcttcctatgtcttcctctctcaaaattctcgtgctttttccctaggaaactccaaacaactttattagatcaattcttgtattgtttgaaatcctaaggatttaacaagccttgacaattcaatccaacacttctttttttcttttcatgttttttttaatcctgagttccaaaggagagttcctttgaaacaagagaaatgtgtatttgtatttccttttgttttttagaatctagctcaatccctaagatgatccttcaaaatgctctcccgtttgaaagaaggcataagtgtttactaccttgtacggtaccctttgtatgatcgttgtatgcatggaaggagtatttgtaggttggcactaatccatcaagttaagccaagcgtgcagcctgacgtacgctacaattatggtatgtagaaacaactgcgttgtactactattttctgattgatacgacgaaactgctttcttagaatctggagtccggttattagaatattggatctttctttcttcttttttttttctttttttgagaacagaatattgcttaattagattcttgactagcatacatacgcttggaaacaaaggtttggcctttgctgtttgctgccgtacattgcaaacgctatagctatgtattccctactggagtagttaattgcttcctccattctcatttgtttgacgccaacgttaaattaaaaataaacaaagggagtacttagtaattgacagtgattactgctctagcagttgagtactgccgctgcttctgacctgaagatttgatttggcccttgctgctcttaatcaatgaaaatatcgtaatatcatcgaggttgattattcttctgagtttatgtttctttcaccggaagtttttttaattgcaacttgatgcgttttgctcgagtagtgccccagcacagtggtgacattgacaatgtgtttatcacttgaaaaacagttataattaactccgtgtcattgccaactttaaaacacaagttacgtcgaagaggaacgtgttggacacgtcgggacaagttggagcaagtacgatctctttctctgttgatgcaaactagtaaattgtttatcaattgcttagttagtgaattaagcatgcaaggcacatcgttgaaattagaagctaactggatgcggtcaagcgtggtatcttggatccagttgctagaatcttatgtatgtgagtaatgaagtactaataacttaacattgatttgctatcaggttagcataatctagcagtgaattttggccgttgctattatataaaacgaaggtttgacattgatattgatgttataacaagtagtagtacactgtatttaacaattggagtaggctagcagacacatgatttctccgcttgtaaatacgtgagttttgtgctctgtttggcatgatcctaaatctgagatcacattgataaaatttgaagaatcattttatcatcacttaagacagaatgtaaataaatcattataatttaatttacaaactttaaatttgtcgtggattaaggatatggagttttgccaaaacaaccataaatcaatggagtaagatttgtaggagtattttgtttgcaaattaatattaaaaaaaataaaagtaaatttcagcaaactataacaatagctgatgattttatcataaaactgtaaccgtaatagcttgatttctctaggcttatttgctaggcacgcactcaaaaatacaaaattatgtcaggccacatgttagacacacaccgttatggtttactctgaataaagctgtagcaaagtgatagttttatcaaatggaatttactcgaaaattaatcagtgcaagtttaggggaactactactaccggaggtcactgcccggtgggccatgcaaagagagaaggagatggaaagcacggcgggcccaccgtacagcgagccgtactctgattccaccctttccagcgtccgtttgtccaatctccggtacttgcggaaaggactggtggtccccacccaaactctaactctccggcgtgcgcccctcccgccgccgtccgattgctccacgatgaatccagaccgtccatctcgccccccggaatcggataaggacaccccctccgccgccacgcgtcgcgtccctactggatgcagtaagaagctatatctcctgtggcgcgacggcgcagaagatcctcctcctcctcctcctgcttccattccatttttttccataattccattccaccaaagccaaaaattcataataaaaagaaaggaaaaaaaagagaaaaggaaaatctccctcctcctcctcctgcgactgcgagagagcgagacgctgctcagttcgtcgtctcgcttcgcctcgccggcgtttggattggaatctccgctccggcgaggaatttcaccctacaaatattagcccaccgcccggccggccggcgcgcgccatcctctagaagattctcgcgccaaaaagatcccctcggattcctcaccacctcttggattggatacctcagctcaggctgcttctactaccgcatctctctcgccgcctcctcctgagacgtagtggacgacgtcgctatggggggactcgcgtaggcggcacctcgccgccgcgggggagatggaggacgacatcgaggagggcgtggccgagagctcgggaccctctccccgtgccgccgc

SEQ ID NO: 56008 - DNA, 5383 bp, Oryza sativa
ggcggcggtagcgtgcacgggtcccctgacattaggaacgtcatctacgagcgcctggtggcgattcgcaacgaggaggccatctccaacccttcctccttccgcgttgagctcgaccgccacttccttcgcttgcccgaaaggtagtacacatacgatgcttctcgcctgtctctcagttgttttgcttttctcgcctttcaaagtgcaatcttcttgcctgtgcagctatttgatcgatctggatgtcagcaaggcagagcaagtgctgctgcaccggaggattctcgccgactgcgccgaccctgaaaagcgcccaatcttccatgcccgctacataggggtagactctggatcaactccaactgaaaacggtaatggtgggggctttctccctatcaatttgaggtataggtcaccaactttccaatgcttttatatatatatatatatatatatatatatatatatatacatacatacatactttactagttgaggacacagttgatttcagtggagtgtatgtacctttcttttcgtgttcggaatggtatctctttgtccaaacaaaaatgcttcttcttctgtaaatatcaagccaacttatcagtatatctttcgtgttaacatcgattgtgcctgtgaatattggacagagatgatgaattcacagaatccgagccatatgaaaggatgatggaagacctgagtctagagagaggaaaaggtgtggatgacttcgaagccagttctgcaaggtatttttgttactaagctgttgtgctgtgcgaatgacatatctataccataataacaatcaattaatccggaacgtcagtttcaggtttcaaccatctggttcgatctaaaaactgcaagaatgcgaaatttccatttcatttgtataaacatagattatgtttccagaagggtgctaacttgactgaaaggttgttctgtccataaaacaacactgtgttcctctttggtacaaagcttccgtcatgatacttaagagcaacctttatagttggtgttactgctccccgcaaaaaaaaatagttggtgttactgcagttatatgcaatcaggctagttgctctaatcagccttgtttgaattgttgagttttgtggatatgagcctttgctctctacatcggtgcacaacagttctcatataattctttgaaatgattagtaacgtcttctttgcctattctttttatatggacttctttctgatatccagactagtttagcactcatgtattatatgctttcttttcgtgaaccattctcttaatttgcctgagcaatcatctttaatcattttttacatgatttgtccataaccattctcttaattttgcagaagggactcgaaattcgtccgtgttcatgaaattattttttcttccatagacaagccaaagctcctcagtaaggcaaggccatgtactttgtgatttctatttagagacctccatacgaataccacaccttcttgtgtcaccgcttgaactgtgagatattgttttacagctatccgcgatactgtctgatattgggttgaacatccgtgaagctcatgtgttctcaacatcagatggcttttgtctcgatgtgtttgttgttgatggctgggatacagaggtaaacttagagcatcgtcatggttatagcttatttttttcacacaattacagaactctacaaattatgtttcgaacttttaatcatgactacttatggtgggaaaccataaaattagataatcagattgttaagtacactatgcttcaaggtgttccacaaattaaaacattgcctaacactatgtgcaggaaacggatggtttgcttcagaagcttatagaggcagaggcaagcagccatgtatggttcttcctatttctccatttaatcaacacgattgcttgaaatttaaaggtgtcttgctggttaggaagtcaacatgcttgcaagttacctcctttttgcattaaatgcagtcctgtaaatactctcaagtcagcattacaagacttgaagaaatgaatatgccatccctatccttttcctttacagaattgaacttcttgtatgtagggctcattgtctaatccgacaaatttgtcacaatcagagaaagttctagagctgcaggaaaagataggagattctgaattcgacaggagtttgctgcaaattggggagaaaattgcatccggatcttctggggatctgtaagaaacatgcaactcttattacttaggaataatgaatattaggaaagaacggaggtagttatttagaacaacaggtacaactcaactgctagtgtggattgcatgacctttcttacatctgtttacaagcaaatggtttcacaagggggcactatcaacaaatagtcacaaagctagttgtgttctgggtttctgatttcaacttgtggagacatattgctgtgtgcattattctatattttttaatgtttctagcaagatcagcagttcattaaccaagtggtcttgtttgtatcctcggctgcagatatcgaggaacttatctcggtgtggatgttgcagtaaaatttcttagatctgaacatgttaacgattcttcgaaagtggagttcttgcaagaaataatgattttaaagtaagctttcttttgaaatcactttgatgcatagacttgactttgaatcatttaaaattccagataattctaatacagtgaagtcatgtccaggagtgttgatcatgaaaatgttgtccaattttatggagcttgcacaaagcatcgaaagtatctcattgtaacaggtgacacaaatattgctgataatcttgcctgctgatttttttcgtaggaatcaaaatccttgtttctcaagattcagatagcagtgcttgggcatatttacaatctgagtagcgttggtggctaaaagattgagctcatgtctgggtataaccaatgtgcttggtttttcatctccagtttccttggcatctaatgtaaataactgttgattgaacatttttagttttgcattttggtgagcgtcattaggtggaattgttaaaaacaaaaaatctcgaaagacgggggataactcctgtcttttatccattttggtagggacttcaagagcagctaagtctataggagggatactgtaaccattacatttgcttgttgcgtccatgcataaagaattctacaccatgatggaaaatagtgcaagatatgtctggtcagaagaatattgctactctattcctatcaacaggtctctacccacccttcaattagcctgtgaattactactttctaattcatgcatgtgaaataagtcttcgttcctaatgagcacacaaattttcattttctaaattaccagccaaatttctgtattgtttacacatcacatgagtatttttttctattattgtattgcaaggcgatgagttctgggcccctagctgcaaagttcatatcagactcatcctgtatagcacctataaataaggagatgctatccatggatttataagatacatgtatcatccacacgttttaacttgacattagtttattgagattactcccattgcataattgattagcagtaaggtattggttgtccaatcttgctgttaattaaatatttagatgttttgaagagctttattaggagggtgttaattcattttactgcaagtgaacttgtgttcagaatcccaactaaactcttttctagtcacttaaaaaaagatatttgtgcatcttctttactgaatcatcgtattcacatgggagtttggttcaaatatttcgtacagtctagtctttatttattcagaagatgacaagaattatactttttttagataatggacaagaattgcatggatagtaaataaataattacttatgtacaatactgttattctgttcccttgtcatgccataggatttcttacataatatcaagagccagcgatctagatgagttaagttagtagtagtatcattgtagccatgagatcatttatatatttatcttactgcttttttagggaaaaaaatgtttgtatgtgtcagttccgatttccaactttccaagggtgcactctgttttcttgcttcaatcccacaaacgagcataggccatggattgcttgtttgtatttttatgtattgagttttccgaattgatcaagtcagctcaatgtagagcatttatctatctagggtatctattatcgggcaatttcttttctgcgattatttcatgtcaactgatattttgctttgttatttgtgtgtctcatccagagtacatgcccggaggtaatttgtatgacttccttcataagcaaaacaatactttggagcttcctgttgttcttaggattgctattggtatctcaaaaggaatggattatttgcaccagaataatatcatccatagggacttgaagactgccaatttgctaattggctctggtcaagtatgcatattgtttcgaagttgcttatcaattgaaggatgtcgaagcactgattcaattcttaataggtcgtgaagatcgcagactttggtgtctctcggctccgatctcaagggggagaaatgactgctgaaactggcacgtatagatggatggcacctgaggtactatgttgatccttttgttccttatcctctggtgtcccttttttccctttattttcctttctgattactcgataagacttttgtactgcaacagaaagtcttttctgtttgctaatgataagttcagtttcacaagcccatttcaccaggcttaggcacatatacagatgcatgatgcactattttactgttttcacatgtatgcatacacagactacctgactatgctgtccttgcaagcatgttggcttacatattgatcacgcttgcatttacttactgcactgattttttggatcagtgtgcaaaagccatacttagaagagttatgcaaagctaagacaatatgcatgtgcaatgtacttattagaatcgcgtgtgttaccaggtaataaaccataagccttatgaccataaggcagatgtcttcagctttgctattgttctatgggagttggtcactacaaaggtaacctgtggctggcaaggcattgtgtgacgttttcatagttctcaatttttttaacagcagtgaactatggtcagatgtaataaccactaatacatgtgctatgtagataccatacgaaaatctgacacccttgcaagctgcactgggagtaaggcaggtatgtatttgatgccaataagctccaacataacacattggatgttaaaaaaagtaa

SEQ ID NO: 56009 - DNA, 1484 bp, Oryza sativa
ggatgaaaatcctcatgtgcggcccctttctcagagattactgtagaattggaagatatcttacggcatgtcctggtaaatttctgaactttgtacactttaggtttaatgaaacgacgatcggaaaaaaataatgaatttgaagtatctaggttcatgcttgagactgctgaaaagctgcatatctgttgtaggtttccaagacaggaagtcgacatcccaaagcaaagatacaaaagaaatcggcgcgatagagaatacatgggctccttgtgacctttgtgaaaacagcttagaggttttcttcaaaactaccaggctactgtttgttgctagcacggcagcatagaaatgattttgtatatatgtcggatgcttgcatgtataatatttttttactcacacctgattggtatgagttttctgttttgtcatataatatgtgtactaaatttagaagaacgctgaacaaggcggcagccactgggatattttaatacagctctagtttttgtgtttccagcctgtgcaattttggctcatgtacatccggcaataacttagttgagacttcagaacttcagatgaagaaccatatctcttttgctgaattccattttgatgcttgtctataggattggagccaaattgttggctatgcccaagcttaatttggtagcatcccaaacccttgtttatactctagttagatttggcacctaactggaagcaattcaaacatattaaaaactagttcctctgtttcataatataagtcattctagcatttttcacatttatattgttgttaatgaatctagatctagattcattaacaataatataaatgtgagaaatgctaaaatgacttacattgtgaaacggagggagtagtatgttttgacacgggtaaagaaagaaaatagcagtttgggctgggcctggcccagttagttgcttgggccaaaatctgatgagatcgaaaactgaggaggaaaaaaaatccaatccatccatttcctttccagtggtttcgcgatggcgagcacgccggagccggagacgacggtgggaggctacgagctgcgggagcggctgggcggccggccgccgtccacggtggtgtggcgcgccgtggagcggtcgagcggatcccccgtggtggtgaagcaggtgcggctgactggcctccccagcaccctccgcgacagcctcgactgcgaggtccgcttcctcgccgccgtcacccaccccaacatcatccgcctcctcgacctcatccaggtctccttttgtcttctccatcgtcttcttcttcttccttctctaccaatcctagtgaatttttctccttaattagacccagagcaacctgtaccttgtcctggagctgtgcgagggaggagacctggcggcctacatccagcgcaacgggagggtagaggagacgcgtcgccagcaatttcatgagacagatcggtaat

SEQ ID NO: 56010 - DNA, 1148 bp, Oryza sativa
atgtccaggtggctactagttctctcttcaaccttgtttatcttatctaaacttcaataagttctcatcacagatttgtctctgcagctgcttcaatgcataaaccgaaccgtgtctcttccattctcagaagtcgttatttccaagctacgtcctgattctattgatatatgcaccagacttctgtgtagcaatccaggtgcgcctttgatcttgttacaacctctcactgaaaatatggagagtgcgaagctaacaaatttccataattgcttccagtgaaaaggttgtccttccaagagttcttcagccacagcttcctcagaccatagacgccttactgaagagcctatgcaagcttagcaatatcatctgaagttcaggattagttgaattgtttgtttgttgtacttggacatatgcaggtacctctttgtgttcaaaaccttgttttcctgtagtcttctctgtagcctgtagactttttacacgaaaaatgtgaatataagttgggagttctgtacacagcaaccaaaatgcattttcatatccactgtttgtctgtgttgaaacccggtctcctatccaaacatttcaagacttcccccccaatccactgttctgttgccaaaaagacacgaatattagggaatgacctaatattaaataactataaggggtgaggcttcgaacccaaattgtctagctcaccaccttgtggagctagctggaagatccctcggcgtttctcactgttctgttgccttaaaggtattttccgcatttgcaatccatctccttgctagcagcaatgatcaggagcagtgccattcctggaccttcagattcgggcgccgtgttgatgtcgcgtagctgagagcgattgatctactggggttccttccgatggagcggcggaggatgatcgccgatctgctcagggcgagcgcgagaggctcgtccctccgcggcggcgtccagctccacgccgcgctgatgaagctcggcttcgggtcggacaccatgctcaacaacaacctgatcgacatgtacgccaagtgcgggaagcttcacatggccggcgaggtgttcgacggaatgcccgagaggacgtggtgtcctgacggcgctcatggtgggcttcctgc

SEQ ID NO: 56011 - DNA, 19064 bp, Oryza sativa
aagggaagaagctgtagaaggggccaaaaatgtatatttttttaaaaaaaagaacaatcctaggagcggagaggagcgcggcggtggaggtggaggcgaggcgcacgtgggacgtcacatgccgacgcgcgccggggccgggccgaggcaccgacggaaacgcaaaaccaaacgaggtcaaagtcgcaccactcgcaacgtcacgactcacgcgtccatccatcacgattcgcgaggagcagccggctgctgccgccagcagcgacggccgcgccgcgctgccggttttgcggtgcggtgcgcgcggatcgatgggccgaaacgctagccaggcaggccgcgcgctcggtgcggttgcggttgcggaggcgcaacgcgcccgcagattgatgggccgatggtcgcgctggattctccgggccggtaatcgctacaagtacatgcgggccggtgggcctatggtgttggcatgtccgagaattattattgcggatcgcgtagcagccaggggttggtcgtcccgttcccgtacgtacgtccgcctcaccacactggttccggttcgtgtctttgaccgatgaccgccgtcacgcgccgcgcggctggactgaatagtaggagtcgcctcgccgaccgggggtcatgtatgtatcagtatctttgccttttccctctcctaggggccaaattcaaccacttgtggtctctcttctcagaggcaggatgacccggccttggcctgacagaaaacaaataagggctcaaaagcaacagcacattaagcttagtataaagaaactagtactgttacgtatcctgtcttcaaatatgatggtatttcagggtgcccacgatataactggtgcaattaatttcaaccatgcgagagaggttaactatctccatcatgtctgggctcgccatggccgcaaatatggcacttttactttgcagtttccacgcacctgctgtaacttctctaactagctaggtcaaaaatcacgttgcttattgcccaagacaccatccctgataataacactcggggacaagaagatcttccattattctgggcgtgtttagttccaaagtttttttttcaaacttctaactttccatcacctcaaatcttttatacacacacaacttcagtcacattgtcttcaattttaactaaattttaaactttaggccaatctaaacacagcctctatcacatccggtggttaatttgatacagtttgattgaagcgccgtggcctcacggtaacgcgcgagaaccagcaagttaacaaccgatcgagacgcgtacgtgcacagccgggatactactattttgcgagcaagcgagcattcatgcatgtatggtactcaactcaaatagcaacgcccccgcaacagtacaaatcaacgccacgcacgtcgccatatcctaacagaagagaatcatagctgcagccgggggccagcacgaagatatatatccggtgcacacacgcacggttttttgcgatgcgatgtcgtcacctatcccatcaaaggggttcaattcaacaacctaccaaccaacctagagtggctacgaatcgagattgcatatgctgcatagagcgcgcgaaggaatgagaggctgcacgcaggtcgcaggtgcatctggtggaggggcagcctgcatatatgaccgggcgactagcgagccagattgcaggccgggccccggcaaatcacgaccgcacgggcgtcggctcgatcgtaatcgcggacatcgtcttacgcgcgcaagtggcgtgagttcagatgttcaattcaccgagtcatttggctgaataatatttactccagtctccaccagcagcttgaacgcacgcacgcacgcgtgaccgcctgagcgcggaagtgtcgacatgcacactatgtacacctcctactctctcggctacttgcgcgacagcgtccacggcccgccgctccgcaaacttggggcttatttggattgctacgatgccaatttttttttggtagtgtcacttgttaccaatataagccaacattcgaattctggttaagattgttctaaattaatgtgaaatctaatatgggcattactaataaatctatctattatattattaaaacagctttaaaaggaggctccacgttcactgtgggggctagaaattcccacattaatcagagaaaaagagaaaaatattagccattggattaaaatagatctagattaatggttgtgatttaatatgagtctacatattttatggaaacaaaagactcggaaacagcatcaataaaccaaaccggaaccaaccagactccagtctgatttttggaagcttggaagctcaggaaccaagccggaatataaaatccaaaattagcaaaagaaaaaaaaaagaagaagagttcaagtaggaatacaatttaaaattagctgaaattcagaattaaaaataaacactgttaagattaattaaaatttagaataaaaaataaaataatatccaaaattagaaaaaataaaagagagttcaagtaggaatataattttgaaacaactaaaattgaaaataaaaaataaaaatattaaaagaacacgatacgatattatttattttttaaaaaaaaataaattcttaaattagaaaaagaagaaaaataatatttcaattaggaatacaatttataaataactgaaaaatgtgataaaaataaagactatcgaaagaaaaaaccatctaaaacacatgacgagataatttaagtaacaagcctataaaagagtagagtggtggcggttgatacgacatataaaaactgttaataaacaccaaatagaacactaatgatgattaaaaggaagaacgacagcaggccagcaaacgagcaaggcgattgtcgggacttctagaaagcaaaaaagataaaccccattgataatcatattcgatttttaaatatcaatgccaataaaaaggagaagcagcgggcggggtgtataggagtatagttgcaaagccgctgacggttaacgggacttatagaaaataaaaaatggattccaacgatagttatgttcgacttttagaatcacaatgacaataaagagtaggcggcggatgagccgtagaggagaatagtggcatcgtttaacgagacttctagaaattataaaaaatgaaacccaacaacacagtaaactctaaaaactataaggttcaatttttaaaggttcggaacttccaaaaagtaaaaaaaaattataatcatgttcgattttaaaatatcaatgataataaagaagggaggcagcgggcaagccgtagagaaatacaaggcaaagccgctgacggtttggcgggacttctagaaagtaaaaatgaatccaaacggtaattatgttcgatttttaaaatctcaatgacaataaagagaagatacagtggacgggccatagaggagtataatagcaacgtttgacgaaacgtctagaaattataaaaatgaatccaacgtgacaataaactctaaaaagtacaagatccaaactttaaaggttccaaggagaatgaatagaaatagtgataaatcttgcaagcaaataaagaaggagatgacataggggtagcaactggtgtgacttttaaaaaactatataattagaaacacgtagatgataaggtttggtctttcaaacttggtctttcaaactcttaagacaataagatagctatttaataaaatttaagtaaaattatataaaaaatatatgattttgtttaggtgatagccgcgcaatcgctagttgatttcaatccaaaccaaacatagagagcgactcgcatcagccgctctatgatgcgtgtttccccggttcccgcctgtccaagcgcgccctcgcctcgcctcgcctcgcctcgatcgcacagtcgctcgctcgtacgcggcgccgcttgcttgcctggttggtctttccatttcgatcgaaacattggctggccggctgcccgggctcgacacgtcttatcaccgttacgtcccccgctactatacaactgcgcttaaatcacagccgctactaatcaattgtttcaatgatagttgtatttaaagaagtagtataagtactaactgagctgagttgatatggacgtcgagcttgttggcaccttacaatttggcaccttacaatttctgttaatttgtctccttatttatagtttataattattatagttctaacggacaagtgagagagagagagagagagagagagagagaggaatatcctcgatcgagtatattctagtagatctctctagtcatacacggtcacggtgtcgatagcttttgcttctagtattacgctctgggttaccgtcggtggaaacggacgcggattaatcaatcagtttgagcgtttccacacgcactttgagccacaaataaccggccgggtcgacgtttggctgaccaccggctgctgctgcatactgagcacgatcgactcgtcctgttttcttagctttatatccaaaagaaaaggaatttagaactgcatcagctgcgcgcactcgtgacgcttgcaatgcccagttggatgggcatataaaaatgctggcttttcccccttgaacaccgtgagagataacataaaccgcacaagacaagaatcccggacacgtaagaaaggaaacactccaacttaattattttccagccttttgcgttctcttcggtgccaaacagtagcaagtgattctctgcctcccagcgaggcctaaaaaaagacagtagtttcgttgaagaaacaacaaaaaagactcggcgcagtggtggacagggagaatatcatatcacagaaaaatgtttaatcaaaaggattttgtgtcgtattaggatcaaaatgtttaatctatgcgtccacgtgcaacagttgtggggtccagcaggaagacactcgtcgctacgacacgaaccctcgaaaaaaaaagaaataaagaaagaaaaaggcctcccatcgtcaacacgcacacacctggtgcaatgcaaggaggcaaagcaaaggccaaacatccaaatttgattttggttgtgagctgagctccagtaaacctcactatcagagcacagcaataatccgtggctgacgaagcagaggcccaaacgcgaagcagaggagggcctttcggttttccgcgcctatataaaccccacacggccaaacggtttgagaggcgccaaacacacgacacgttctccccacacacacaaaccaacgcgacgcacgagagatttgtacgtgaagcacctgcagcgggcgacccaatggagaccccgactctgaccacgctgctcaaggcggcggtggccacgttcccctcgcgccgcgccctcgccgtcccgggcaaggtcgacctgtcgcacgcggcgctcgacgcgctcgtcgacgccgcggccgcgcgcctcgccgccgatgcgggcgtgctccccggccacgtcgtcgcgctcgccttccccaacaccgtcgaggtaaagcaccagtcacagaagctgttgatatcacggtgacgatcatcgagctgctgatgctgatctggttcttgtgtgtttttgcagctggtgatcatgttcttggcggtgatccgagcgcgcgcggtggcggcgccgctgaacccggcgtacacgcaggaggagttcgagttctacctctccgactccggggcgcgtctcctcatcaccaaccccgagggcaacgtcgccgcgcaggcggccgcctccaagctgggcctcgcccacaccaccgccagcctcaaggacgccgccggccaagtccacctcgccggcttccccgcctccgccgccgccgcggccaaggacttcgccaacgacccgtccgacgtggcgctgttcctgcacacctccggcaccacgagccggcccaagggcgtgccgctcacgcagcgcaacctggcggcgtccgtccagaacatccgcgccgtgtaccgcctcaccgaggcggacgcgacggtgatcgtgctcccgctcttccacgtccacggcctcctctgcggcctcctcgcctccctggcgtccggcgcgtccgtgacgctcccggcggcggggcgcttctcggcgtccaccttctgggccgacatgcgcggcgccggcgcgacgtggtacacggcggtgccgacgatccaccagatcatcatcgaccggcacacctcgaagccggaggcggagtacccggcgctgcggttcatccgcagctgcagcgcgtcgctggcgccggcgatcatggagaagctggaggcggcgttcggggcgccggtggtggaggcgtacgcgatgacggaggcgtcgcacctgatgacgtcgaacccgctgccggaggacggggcgaggaaggccgggtcggtggggcgcgcggtgggtcaggagatggcgatcctggacgaggaagggcggcgggtggaggccgggaagagcggcgaggtgtgcgtgcgcggcgccaacgtgacgagcgggtacaaggggaacccggaggcgaacgaggcggcgttccggttcgggtggttccacaccggcgacatcggcgtcgtggacgaggaggggtacctgcggctggtggggcggatcaaggagctgatcaaccgcggcggcgagaagatatcgccgatcgaggtggactcggtgctgctcgggcacccggccatcgcgcaggccgtggcgttcggggtgcccgacgccaagtacggggaggagatcaactgcgcggtgatcccccgggagggcgtgtcgctcggggaagaggaggtgctggcctactgccggaggaacctggccgcgttcaaggtgcccaagaaggtgtacatcgccgacgagcttcccaagacggccaccggcaagatccagcgccgcatcgtcgcgcagcacttcgtcgtgccggtgctgcccaccaaggcgtaataaaagtctctacctcccgaccaacccatcgcatgccatcgtcctactgtatctatcaagttcgtgtcttgatttgattttttctggttacttcggctacaaccagtagcttcgtttagggttgggtttcccgtgctaacgagtagtaaaatttcggtttcccgtcctttcgtacgtgttgaattgttgttattacttctcaccggccaaactgattgtacgtgttggtcatattatcgtcgtcgtttttccacccgtgagcgcgtgcccacagcacagcacagtggtcgtccaacttttaccagtcgatcgagtcgagaggaaaagaaaagagaaaaagaaggcgcgggttcgtggcatattctagaacgcaggtggatactggatacataccaccggttgctgcgttcgtcagcagaggtcaggcacctctcgctcgctgatttggtggttcagttgttggggacaacgacgtgcatttccacgtcaatggaccttatcgcggagtcgtttctggttttttgcaacaaaaaatcgtcagggatgacgtgccgcggcgccgctgccactcgcccactgtgccggccagtggcgacggcgacgtttcctcaaagtcacaaactgatcgatcaatcgatcaacgatccaacgatcacccttgctttccggatttgagaaacgacggaggaaggtagggccccaccaacgtggtgtcccacagtagggaagtgacgtttggtgggtcagtgggtgccggcgcccacaaaacacccatctctcggcgtctccgcagcgcaatcgacaatcgagaactgatggaggagcgctcctacgtatccctgtagcgaatcccagccacagcccacgcaagcccacaaggccacagggaaggaggtggccgaaaatctcgatagagctcgacccgtgcagcctccaaaaccacgggaaaaatacgcgatcaaaaccacgagaaatccgcgatcgcccggcgctcggcgaagctggggtctcccttggcttcccctccacgacccctggaaccggacgcgtgcgcgtccctgcgccttgccccaacctgtgattcgcgtagttgcctggaattctcaatccatctctgtggatgttatcaggattgcagcatgccaagttggaggaaacgcagcacagaaacctgacataatattcggatagaaaaatgatgccgattccaacaatccaagacaattccaaactccgtgcagcacgcagcatacactacggagtaggagcctagaacgaaaactgtcggatgcgatatcatttgtacgtgtcagtcgagaaattccatatttaccaatttaatttttcgagtggtaatcgcaatacgatgataagagaactaggaaaacagtttcaatattcatacgcggtgatgatcagaaacgatcgaaaaccgtacagagccaattgggaatttccatgccggttttcatcctaataggttgcaccacaaacttacacatgtatgccagcagaggcgaacaaaggaatttcgttagaccggtgaggcattgaagaaacacctgctgtgcaataccggcaatcaactgtaaatcatacagcattatgagtcaaaaacagtcaatacagtatcacgaccaaactgaactagtgcctgcctgctcgtgcgtctcagctcctctatattccgagcatgcaatggccatgatcagataaatattagtgtgtgatgtgacggacgaatttacagcggtaagaatggtatgctacaacgccagggcgagctcagcccatgctagagaggattccttcaggatggcggctgccgacaagtcgatcccgttctccagaactcctgtgatgatctgcatcgatggtctcttggatggatcagggtcgatgcagcggctcactacgctgcagatcaccatgagatcctctgttctgacattggtcagctcaggatcgacaagcttaccgatctcctctgtctgctgcagatacttgatggcctgaacaatgtagagaatgcatattcagaataagcagtgcaaatgttcaatgcaactaatattccaaactgcatgctcctgtattttctgaactatatgttttgtttaagtcattttaagttcatggtggaactaggctctggtcctcttgagcagacttcagagtcaatttctaaaatatttacttctttgtcacaatgagatagagaaagagtagaatgcctcacccagtcaatcaaatagcctttgtccttgcaataaggaagccgtccactgatgatctccagcaaaatcactccaaaagcaaatgtattgccttggatgtctgcttgtttgtcctctgaagaatccaagtggccagggaaagaggatttgttattgatgcggccaggagccttctcatgtttttgtttggtgaacatcattttccagcactcaaaatcaaccagctgaaaacaaaaatggaaaacaattgtgtttgtttcaccaggttggagagtattgcactctaaggatagggatgaacagacaaggaaaggctatctctgaagaaccaaaaataacgtgcaccttacctttggagtaaaatcttcagtaacatatacagagttggaattcagctcagagatagcaaatggaggctgcaactcggtatgcaggtatcttagaccctgcgcgatgccaatggctattttcattcgtctgagccaagataactgagctccttctccatctgaaggaaccccataaaaatcaaataagcaaacctgctgcacataacacatgcaatatgcaataactaagcatcacataatcgtcagaaaataaagaggctggcttacagtgtaggtgctcaaacagggtcccgtttgatgcgtattcaaacactagcatcctggagaatgggtcactttctctgcaatagcccagaaattttgctatgttctcatgattcaaccttgccaggtcaataacctaaaatttacacccattaatattgtgggacaacatactgttctcacagcagaattttgctaagctttaccttgttttggtaaaatagttcatgttggctagtccaatgaccttcaaaggcacataatgatatgacagaaacctcaggtccatccttcatggttcctttgtacactactgtctcaggagatgaaccaataatgttgctaaaatcctcacaagctacttcaagctcttggcgacttaactttggcaggcttttcagcatatcagaatctggtgagagcattaagatattaacagcactattcaaatcatatcaattaattaaccgataacagcactaaccgatcagcactgttatctcatcactccaactttttgatctgttccacgaggatattcttatcgatggctttagcttgcaacttctggaagcagtaattgcaccagtgatcacaaatacaagcagaagaataccagttgaaatttctaaaatgagaagccatgttggttgtggtgatctttcatgtttatggtcagaggtgggatgcttgaatccctttacgccacctcgctggccagccggagaaccacctaagacaaaatgagtggattcagccaatatcagtacatggtgttatcgactagttacccaacaatactcaaatagtaaagaaatgcaatcaatttaattggtgtgcaaaatttcagtgtggtgttttgcgtcaggtccccacatcaggaattgcttaaagtttagcttaaattcaatattggcctctttgctttaagttttgtcactttttttttaaaaaaataaagacggaaaaatgaagcacatcaattgtcttatcatgttgaccatgcaaagatcaagtgggctatcttggccttctattgattgctaaataaagcagtgaaactgtaaaggtagagggctatactgaatgcagataaaaggggatacttctgcttatcatgacacggataaattttgcaagtgtaggcctgtaggatatcaatcacaacaccacttgcaggtacatcgtgaaattccaatagaaggatatcactttaatgcatgctgaagtaatcctgttaatgttttttttttggtgggtggggggaggggggcgtaatcctgttaatgctagaaggaaaaatacatacttatacaaatttggaaagcccgctgccggacagagtactcatcctgtaagcagttcccttggaaacttgacctgcagacaagccatgtaaatggatggaccttaaagcagtagcaaacacactgtatggtactaccttggaagatacttcaagcacggtgggatttttccaacaagaaagttgtatgagaaatctccaacatttaatcgaggagaagggcatagcccattgtgagccgtggatctggtggagtaaaataaaatcgattcagataattaacaaaaagataataaaacatggtcaaatataagttttttgcaggctcactgccagatgtcatcaagagagaatataataaagaagctgcatgcacaaagttactaaggctcccatcggatggcctaataagccaaagaaaaagccaaattttaaattttcaaacttaattttgagattgattttgagttattttcaacgtagttttttttttcagcattggcttttaagtcaccaagaacacacatataaaagttttacctacaaatttaattttattccgttttggcttattagggaaaaagccaaacgatggggccttaagtaaccaccacttgatacctagtcttatcctttttactgtcaccaaaatttactgccaaattaactagtatgtaagaacgaatgttttttaagagggacacacaaatacaatcgccatgatatcatagctgcggtgttcagttcatgaataaaatggtttgactatggcatggatatccagaaatatagacatagaatacaagagcacaggaacctgaagggaattaagtgacatttttatggtttaatatatatagaaaatgcatctacagtcttgatcatcaaataaaaatggagtaaggagaagtcaccaacccactattggccgtaggagaaaaaccagaaccattgcttccaggaattgatcctttcagtctatttctgtccaacctcagctgaacaagattctgtagcttgcccagctctgaaggtatattcccagtcaacccattggaatgaaagtttctacagcagatgaatgaaagcagccttagtttcaatagcaaagaagcaccagagacaggaaaaccctgaatatataagcaaatcaattggcatcttacattacgcttacgctgctcaatccagccagctcaggaggtataggaccagtaagcctattaacacccaaatccaagaccctaaggttcctcagtgaacctagctgtttcggaattgtcccaaaaagcatgttgcgatccaaatacctgcccaaaaaggagaccttcagaaaccttgaagctaattcatcataaccagttgaaaaaacaataaaacagaacatacagctcttgcaagaagctcagctgtccaagttcaggcgcgataaatcccttcagcgacgagtttgacagcttcctgcaaggtgcggaatcatcgagtcatgacacatgagaagaaattccatcccagaaggattttgactgatcacgcaagtacgggttttagttggcgtttcattgcaaacaaaatctactgactacatatctaaatggcacatcatactccattatttccagctgtttgcacatgcaatatgcgtctatgtcaaacatatacagcattgtacagctccaacgataagctagtggcagtgcttatagtatcaaacaagtcttcacctacaaaattgtagtacctgctaatgtaaacattaataaatcaccataacaaactcttttccctccccactttatgtacacagtaatgttgaacaggatttgatattaccggctagtaagtaccacagtagtaactagtaaagcagtaggtgaaacattagtgagatctagctgagtgcaggtgcaaggggggggggggggtttcttacagggagatcacggagccctgcggcgaggagcagatcaccccgtgccagtcgcaggcgttcccgtccgcatcgctccagtccgcgagcgccgaccgggggtcctcgatgattgcgcgcttgaacgcgatgagcgccgagactagcacaaggcgtagcaaagcgcgtgtgagcagaacgccacatttctcatggaggaacagaacgagagtgtacgagacacagcaaaaccgttggtcacagatcagaaatgcaccatagaaatggaggtggaattcgagttttaggcacgaaatttcgcggataaatctcgaaatttgcatcgcctccaccgagtaacaggtggaaatttcgaagaagatagatcagaaccaaaaatctgaacagccatttcaaactcggtaaaaaaatgtaaaaaaaaaacccgtaaaacgtctcccagaaatggaattcacaggcagtgcataattagaaaaaacaccacgaattcaaacaaaactccctaaaatccgaccaaaaaaaacaggaaagaaaaacaccaagtcagtggaagaacacacatacacggcgcaaccgcgcaagcgacaacactcaccgtcactgcccaacgcattcgccgagcactgcaacaccaccaccaccaccccgcactgcaacgcgaggaggagccggaggacggaggaagcaccgccccaacaatgcctcatctccgaacgccgccgcagctgcagcaccgcctccgaatcactcactcgagcactacactcccccctctctcagagatcgcacgtcctcgcgcgaattcacggcgccatggctaccgctccgattcctcgctgctgctccggcctcagcaccacatggagatggagatggaggtgggttggttgtttggggagtgtgagcagttgagtaaaagagagagccgagcactggaagaagaagaagaagatgcagagagagagagagagagagagagagagagggagacgagggcgtagagagagaaagaggaggaagcgaggagaatgttgggctaatttagtgcgagcaattaaaatggcaagggtggggggaggcggtggccgattagttatcacgcgcactattaatttgtcaattaagtaccactcaattaattaacaaattacccccaccacttactgagtattagcattagtgttagagattaagcatctcaaaagaaaatttaggggttagggagcatcttccttttattttaagactagccactggttatagaatgtcattagcagcatttttttgatctgctcttgtgctgtttgcagtgtctcttaactctctttgcctatatattttttaacttctttaggagaagcttattttggggttcttcagaaatgggtgtggtgtttctgaccgttcaacgctgtgtcctccctttgttttttcatgtggtccctccattttctctgcgttcttggattctctcttaattacagtgcggtgacttagcaagatataataaaaaaggtcatgttatttttacagcatatggtgtgataactaggctacaacagatttaatattgggtaacacaaaaacaataccgttagctgaaatactgttaagaacttaagatggtttatattgctagaatgctgctgctacatggtacatcttggacgtgtgtttaagtcatgctctttttagtttattcactaaattactaaacatagtatttactctacgctttgaaaattcattttcttaaaaaaacttagataacttattttaattttttttacaaaaaataatttatcgctataatagaacatataatccgctgtaataataccgagccttagattttttgtaaacagaggaaggataaggatgagacgtagctgctgcagtaatagcggtggagggagtgaagacagctcggcagtttcagtaattagtttgtcttgactcttgtcctcttgcacttggacttatatactccatgttcttcatgtctcttcttctaattcgaatgcatggtcgtgttgcagaaaagaaaaatctcagttcagaaattattggttgacaatggcatcgatcagccgctgaaagagaattggaaacaaattaagtaacagtggcttttttttttgtttggtagtcacctgcaaatttgggtccaggttgttgcctactatcacaccatggtcctgctgcttgcatggcagccatggttaatctcatgagacaccacaatttttggtaggatcgatcgaatccaattccaattctgcatatatggtttgcaaatcaagggacccactcttaacgttaatctcaacgtatcagaaatgggtgaaacgaaaggagccttacagctaataatgttcacgtgcaattcaagattcagacagcttccaaagaagagaaaagattcaggctgtgtttagatctaaaatttagatccaaacttcagttcttttccatcacatcaacctgtcatatacacacaacttttcagtcacatcatcttcaatttcaaccaaaatctaaactttgcgctgaactaaacacagcctcagtcacactcttgattataacatcgtagttcagacagttcagtttgttgtagcacactgcacacgcaaccctcttcagaggccataacgtagcaaagctgtaactgcagaaatgagatagtagtaagatgcactgaatattcagagtgagcatatcatattatcatatcatcctttctgccagccaagatcgtgtaaaaataggagctgagattgcaaatcctttttgccacttggtggcttgggagtccagcaacaggcaacagatcaaggagagaagaaaaacatcgcattcagcaaggccaagaagcgtacacgacatgcatggtacgaggagagcaaacagacacctcaattttatgaagatgtgtctacagacggggctgcatcgcatggcaatcgaacgtgacagcatgagagaaaggacactgtcaaaaccactatgtttaggcaggcagtgtatagtagtatagaatggcacaggaggtgaagggtaaagttttcattgaactcggtcaattacatccaaatgatacaattgttcttataacgcttccaggtctctgcatagtatgcacacagtcgattgtgtggaccagcaatggtgactgcaggcaatcaacttcttgcaccgaaagagagctagcagcgaaatgagaaaacggaggcattgattcaaggtcatcaactatagaacagttctttctttggtgcatttaaatatggagggacaagtagattataggagtattgttgcagcgtcaaggaagaaagacctgccccaattgttgctaggacctactactgtacttcaaaattcttctttctttctttctttttttctttcggtctgtatgattctctagtcaatttattatactgcattgtactaatatctcttgtgtctatttgggttggtatataattaagagttatgagaaactatgtacacgaaagaaatgtttccgtataaactgaaactgaggtcaccagagagcttgccacttggtacttggatattcagagatggcctcagatcacagtgaccaggactgcaggacatgccatcgtgtgtataaactaaactgtattggtattgagtaatttggaagcaagcagccttgatgtgatcaggccagacagcagcagcaaaaggcaaaacctcccagatggctgtctcctccctgacactagattactgtttctggggagcattacactttgttaaaaatatagtacttcgtttttcagattgatggtggccaatggttctttgcaatgtgtaagcagctcatgaattcaaacgtagcaatatcattgcagtgagcaccaagtgttcctcatcttccaaccagcttattgaaatccataattcaaggaagccaaaagtaggcctctccttctggcaaaggcaatggttgattagcaagatgaggagattagattttggatttgagctgtaaaatggcagtttttcttgcagttggaggggtccttgtctgtattgcttgatggttgaggaggccacaccaactaagatatcatgtttgtgtccacagctcttctgatggcgcaaggcacgcagtattaggccactcggcactcgaccaccaacccttcatctgattatatctcaaacaaaatagcccattaaatccaaaattgacaagaaaaaggaaggtgagaaattcagttttcagaaatatatcaagattggtgagaaattcactacaaaaggcccattaatccaaaagtaacaagaaagatagcaccaagagggtgagaaattcagtttttcagaagcaacaaaaggattgcagataaaacttgcaagttcggtcatcaccacttttccttcatgaacaagaggcgccatcaatatgtttttgcctacattaagagcacttacatgcaaatatgtttcttaatggttgctttcaataatttaaacatgcatgtgctcacttggggtccagggtctgtctggtctcttagccgtatctttcggtctctgatgctggattcttttaatttctgcatctgtctctgcctcccatccattcgtggagctaggcagaatccatgaaaaacttaggtcttttgcaacaaatcaatggtcccatgtcaacaaccatcgccagcctctcttctctgcagtcacctttgcctttgcatatcctggtgtgctggtggcagttaaaagaattcagaggctgagaccgatcgatgaaaatatgcatgatgctagcatttcttgtgtattgtaggtatgattagattgcactagaacatttgtttagagagcaagtgtgtacttagcattgatctaggaagcagatgcctcattgcttggttggcattgacgctatgcttttgtaaagcagtttgtagttaatgagaaaggaaagagtgagatgataaacaaaggagagaaggaaaggaaggtttggttctttgtcattgtcaatatgttagttaattacaaccatttcttcagacatagctccgggtttcaagagttttagtcagtcattaagtcatacctatattctacatgacaaaatgaaatttggtgattcataagcgaaaattcggaaacatgtttgcactccattcagcaaacgcctaaaggctaaagtcaatctatataacatatatacttgcaaaatttccaattgacacttgtcaagtagacgatccacttaaaagtttaattgggccggcacgagtaaggccacccttttcatttctctcacacctcagagaaaagcaagaactgaatatatgttagtttaacttatcctagtttcgactatacagaagatagtggtgtgaattgaagcttaagcaagtacattacttgaggagctcctaagcaagtgggtctttgaggaatccagcaacaacaaactcctctacaatctgtctcaccgcactataccactacacccacaatgccactgccattgccaaatactctctttacttacaagtgaaggttttcaacataacaaacaaacaaacaaaaaagaaatctcaagatcttcttcttctctttgtaacttgatcattagagcgagttctaggaaattcaggccagatgaactgatgaacttactggctgacaacgccattactagtagatgtttggactttgtacccagaagtaaaagaccttgctgctgtactgctctcacttgtgtcctggttttgttagctgttggtgcaggcttagatgagtgcaggacggtgaggactcactggactaaagacaaaagcgagagagggccattacccattgaatgctccttagatcatacactagcacagatgtaaagttgccaggccatatatgtatgtctacatctgcacattttccccaatcatttcggcattttgctctccatttcttcagtgcagaga

SEQ ID NO: 56012 - DNA, 6909 bp, Oryza sativa
cgtgatgatctttaccctaacacgcgttttcttctctctttttttttctctcctgtttaggttggtccaagcttcgcttttatgaaaagagatttgttcgttggatgctccagatcagagcagttcagctgcgctggtcagctcttaatatcccaggccactctgctctctgcactgcagcagctacgaattcaggccagtagatagtactccgtgcaactgcctgccgtgtactacgtgcaggcagctaatgcctgactgcttagcgactctaatcattggatccattcagaaaacacgcagaaaaaggagacggggagatcatccgttccaatcatgcgtgttggcctttgcgatggcagcgtcacgagattcacgacggcgagcgatgagtcgctgactccggcggcaacgacgatctggaaggtgattgggctagagtgggaaattatgtaggtttccgacgggaactgaactatatatctgacgaaattcatgtggaattctagtgttttaacataactacaaatgtgaaacatcatctgaataatggctagaaatgttttaaaaaaatgacatacagtaaaaggaaaggttgggccgttgataggcaaactgtaatttagtagtatcaacctaacatccattgataggcaaactgtaatttagtagtatcaacctaacatccagcatttcagattttcagtgggtctccgtaccaaaatgagaccttgtctaagtctaaatgagactttaatttacccccttacaaatttgagcaagacagcatgagttatccatatcttaacctaataacgccaaaagttttgtaggtttgttacagtgacagcttgtacagtagttcagagctgcatcggctgaagagcatacattttctgaacaaattcagagttaacacacctcaacactaaaactagcactgaaaacatcattctgggggaactcaaagagccatttgggggttaatctcaccgtgaaaccgtgaatgaatcgagggatgcaggcttagcactccaccggctaaaaaatggagccttcctgagaagctcaagtgtctgctggtattcatgagccatatcctgcaaagaacatcagccaccttccagtagtcagtcattgacttctcatattcatcagacactagaatcgtttgacaaaagggttagttcatcatacgctactaagctactgtattttccaatataagatgaaataccttgatttgacggtaggacatttcctcgcgatggaactttttgactaatggatgttcaatcaacacaaaggcttctagcaaccttctcctacagttaaaaaacagaatataaatataccataacagttttgcatcaggatgcttggaatgggaaaggatgcaccctcttacttgcagagcaatgactcagtggatggtgagcatgctgcctttgaagatgtaccctgttttctcccagttgttcctaagacaacttcatgaaaaccggatttgttccagcatatcgagtacctgtaaaatataaattgcaaagctaggtgctcttactaaaaacatgtacatactacatgaggtaaactaaaaaaaaagggtctaagtttataaagacaacaaaccatatactacccgcatgtcaaaggttgcaaatctccagaagtctgttgaaactcttttggagggataggtgcctcataaaatagtggctgtaggaaagaaaacggatccactgtcatgagaagttagcagatgatttgtatatcagtacacaacattgccactccgaccttgttcaatttaaaaggcaacagcagtttgctggatagagaggacagtcgagcatcgagaactttcttgatattattttcaacagaaaacccatcagaagcaccagtaggtgattgtccaatagtaatggtggacaggtacaagggctcaagaatgtgagacagtaatgcacctgtgaaagaacagaggtaaggggttatagagttgatccattgacccgtgaaacgggaatatcgtaactagaaaaataaagaagcaatataattgtggagaaatactagcatgtccactatatattacttcagcagatctgcagcatatattgccatgaacagcaaatgatgaatagcatgaaaatgctgccacataggatgcaatcaacaaacttataacattgaattgaaaatgatcgtggacaacaaaccttgaattccaacaacactccagcgagttattttgtcaaaacaactcattgataatgtagtgtcaccacgcccaggcttcctttgaacaaacccaacatctgtcacacaaggcagtctaccaattaaaatggacacagaaaaataacactaagacaatgaaatgaattagacttttaacatgcgggcaaagtaggcacatcttgaaaaaaacaattaaaccgagatgaaagatccatcagtttcccagactgtattatatacccatggagtctagatttagtgtaatccccattaaaactctccagttccaagtctagaaaattggtgtgcattggtcaccaacgccaacttgtttagcacctgggagctagttccactcccacactttcatgataccattttttccaacagaaaggaaaaacaacaagtactggaaaatcagccaaataagaaacttcgacatatctactgagttacagtacgatgtcacagctaaagacatgaatcaactgctactccagatacatgagtaggcgtctcattgaaaaacttaagtagaaattaaatgttaccaggacaaataaagcatttctaacaagccatcaactgattaatacaatttgtcaaacgtaaggctaatagtaaaagaaaattagcagctataaacatgaatttactgttctgctcaatgccaagaaagaggcataccatcgcatccattaacactatccagctgttccctgagcaactctgagggagatggtggaacaggcatgactccacctgcaaaattcaccaaaccaaggaatccattgaactctaaatgtgtagaactttgccatttcaattgatcaaacaatcggctaagcctaaaaaaaaatgcgaaccggcgaacagcaaaccgaatatacatggaatctgggtgatgtagagatgaaggtggtacccatccctcaacttccacttctcaccggaagcaaccaaccaatcggaagcgccgctccggccgatctcggtgtagatgaggcggaggagcgcgcggcgtgcgacgacctcggcatgcgcgtcgtggacgaggtctccgtggtggttgaggcgagcggcgccgagacacttggttccggtggccagcgagagaacagtgagattccgggggtcctgctgcggagtggagaggaggaaggcggcgaggacggtggactcccgcccctgcggcttgcccttctttgggagagagttgtagtgttggagaacagtcgaggaggtggattccgcccaggagacgtcgtcccatggcgacggcggcggcgccggcggcgaggaggcggcggaggaggggagcatcgaggacggggaaggcgtcaatgcattttacgctttgcagctgcagttacgtagccttacgcccattgtgcggtacaatgagatgaaggggaaaggaatatatcggcccactaaaattacgatcctaattcggcccaccaagatgttgttaagatttggtcgcgatccaaatttgccccatgaaaatttcgttaaaaaaagtcatcctcgaaagtcacaacaaaaacaaaggattcttacatatatattttccaatagaataaagactaatgatcaagcattgtctccactattaatagcgtaacagtaacaataatttcaatcaaaaatagcttgtttgtatcaacgactataccaatgttctattggtaaataatctaaaaaatatttgttcgaatactggtaaacgcgccacatagctagcctctagatctttgattagaaaataactcaccatccgaatgacatgtgcactaacacaaggaggctaggagaagctagcaagcaatgatgcaacacaaggatgcaagcaacaagggccaaaaatttgactgcacagtgcaagtgaaagcaacgtacacaatcctatgttcctaattaaacatctcgtactttgttaaatttcataatctctgcaaagtaccgatcactgtcaaaacggccggcctcctccatttgccggcctccgccggcgacgcacgctcctcgcaaagtcaaatgcatggccgcgtataaatatccattccatcgttaccgtctccggcagcggattgcaccattggttaaccagtaattaaggaggcgagatgaggcaggcgaggccctactcggcgatgttcgccggcggcgtgtcggcgcggactgggccgcacgcgctgccgctggctcgcatcaagaagatcatgaagcggtcggcgggggacagcagcgtcgtcgacggcggcggcggcggcggcggcggggcgaggatgatctccggggaggcgccggtggtgttctccaaggcgtgcgagctgttcatcgccgagctgacgcgccgcgcctgggccgccacgctcgagggcaagcgccggactgtgcacaaggaggacgtcgcgccgccgtgcagaacaccgatctcttcgacttcctcgtcgacgtcgtcacggcagacctcggcgacgatcatacggactataagtaaatcgatatgatttattacacatttacagtaagctagctatgtttgccgaatattgcaacacaaatctgtgtcaaagtccacttgtccatgggccatgtccaactgtgtcattttcaaacaccgacagccggtacatcgaccttgtccatggcccttgaaacaggaacaaatccatagaggtcgccgtccggaatcacacaaggtccttcgagcttcgacgatcaccgatgcattgcatcgaagacgtacgtagaagaagaacaacacaacgagtagggtatggaaccgtgcgggcagagcacgaagagtttgaatcgaacaagaagacgatggccataagctccgaggcccgacggcccggtccacggcacggttatttgaagcacaagcacagcacgattggtgtcggacccgtgccagcccgacccgacagttgggccgtgcctagggcgatgccttggcacggtgagccggtccgacacggcatggtcaaagaaaaatagtcgagggatctaaattagacttaattcattcatataagatatggcccaaagagaagagggataaaatagacttattctaaccatatgaaacacagcccaaagagatgagaacggaaaaatagacttattctatgaagaagcacgatgggctgttgtgcttttgggccgcgggccgagtcctattgtgccatgcctgaagggggacaaaatagacttattctaaccataaggcacaacccaaagagatgaggatggaaaaatagacttaatttataaagaagcacgatgggcggttgtgccttcgggccgcgggccgagtcctattatgccatgactgggccgtgggtgcagcccgtgggtaggcccaacctggcccggcgcgtaggttgagccgtgtcgacccgactaaccttggctcaggcccagttgtgcctgggccatgtcggactgggtggcccatctgggcatctatattgagggccatggtaacgagggcttgttcattttaatgccgattttagtaaattttggcattgctaaattttaatagtgtttggatgtatttagttcgatgcatctctaaaatttgatatcgtttttataagagaaaaaaattccagaattaccaaaattggtagaatgatattggtaagataatgcttagtttgttaccctattaaattttggctgagttgaaagtggtgatgaagtgaacaggttcgaggacaggttggaaaccgtctggccattagggcatgtacaacggtttttattagtggtctttctttattgctatgcaagtaaaatttgatgacatggaagaaagagaaatatggttgttatgcatgacaatggctcagagtcgactcttaacatttattagagtaatttttgttgcatggtggcgaaagaaaggaaagaagagtaagaaaaaatattttgatacattagtgattagagaccatattgtctccaactgttgtaggatgctagtctctagataatgtagagctcatacctgactctacctttgtacatagccttaatctcacccgtgagttccgcaaccttgccacgcgcacaagactcctacgaggagttcctccttatcacgtggttgtctctatgtatggtcatctgcaacgctgacaccatccacccatccctcagcgaaaaagagagagagagagagaagaggatagagaaagggacgatggcgcggactggaaaattctatgtatactcatagacaacaaaaacaaaaattaactcaaaattctatgtatactggagaaatataaaaaagacaattttctgcgtgtatataacttgggggtaattttgattcatatccctcaaccacagaccgggtatacgaaatctattaattgccaataccggttcattttgcaccccaagcagtttccaaagttgtcttaggttgcttagtggggtccatatgtcggtgacatgggaaagaaagaggaagggggggggggggggggcatgtaggacccagtggctgtttcgcgctgcagcccacgttcgaagagtgcctgatatgtgtaggtcgttgagtgtggagacaacgagcaggtcgtggaagtgatcaaggcgtacgtgtacgtgtgaggatggtgagcagaggcagca

SEQ ID NO: 56013 - DNA, 1450 bp, Oryza sativa
  unsure (1)..(1450): unsure at all n locations
tactcgctttctgaaacaaacaagagtgtaggtgtatcagttgtgtgccattctcgtctcttctccgcgacgcgttcgctttctctcccacccaaaacccccagagagggaagagaaacgcctccctcccctctcctcccccgacccaccctgcacctccttcctcgtcgacgccatggcagcaccggagtgaagcagccagccagccgcccggatttcaccatttggtcccgggtttcgcccggatctgggtctctcttcaaccgtcttctccaatctggcggtgctatagctcgccgcgcccggttggggacaaggcccagtaggcgctagccaaacagtgttgagcgcctcctcccctcctcgcgcctcggcgcacggccggcgagaaggttttgaggggcggcgagcttcttcaatctgcctccatctcggtttgaatcggtatgcatatactagcatctccctgtagactgtagtaatacgaaattgtactagtagtttatgtatgcgtcgccgtcggtttgatctccagaaccatcgctgtcagcgagtagcattagcacttactgcgagcttatggtccctggggatctagtattagtttgtggatttctccatttgatgttgacatgctacagtatctccttcgcccatcatactactagaagcgtttctttttgcgcttttgtcgaatggaaaagatttgtagtttttttatgtgtaaatcaagtttgatttttattttttgttcacctgcatctgttatgaaaaattgttgtttttcccttgttgatgctacagatgttctatgactgcatcatcaggttcataagtcctgcttctaatcaatggtgctaacagatgtttctgttttgtacagagtggtgtagcaaataacatcattttcggaggcaatggcggcatataagttgggtgtggaggttgcaagtgctcatgacctgatgcccaaggatgggcaaggttcagcaagtgcctgtgtcgagcttacgtttgatggccagcggttccgcacggctatcaaggacaaggatctgaacccagtgtggaatgagcgcttctacttcaacgtttcggatccgtctaatcttcctgagcttgcgcttgaagcgtacgtctacaacatcaacagatccattgatggttcaaggtccttccttggcaaggtcagaattgctggaacctcattcgtgccattccctgatgcggttgtcatgcattatccactggagaagcgtgggatgttctcacgtgtgaaaggggaactgggtctgaaagtatacattaccaatgacccatccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56014 - DNA, 1108 bp, Oryza sativa
acgcggcggtatttcccgcggcacgctgtccccgccgacctcacggcgctcctcgcacacgagctcacccgtggcatgcatgaacctcgccgttgaatgtagccccggcgcgcgtcgttcgccatgctcagcgtgtacgacgcgacgtacgccacgcgctcccttagcttccgcttcggcgcgcggcgcgcgcgctgccgctcctccgggcgtccctcgccgcagcgcgcgtgcccgaccgccacgcaccgtacgtggcaccctctccgtccccgacgtcttccgcgctagctcccgtgcagacgtgcagtggcagataaaaaaaaaacagagatgtctaaacaaactagataaaactacaatcctctctctcatccatctatagtaaaaaaaaatttagcaggggcttcatggactcttgtggtcttcacgctagtagtggagtcagggctcgacaccccaccgctccaatattggatatgcacttgctcctaggcacctcgagtagtgtcgtcgctgcaacctggggcgaggcactgccctcaagtagagatggcaacgggtgcatatccatcgggttcccctgccccatacccacacccacgatgtcaaaatattcccacttaaatacccacacccgtcgcgggtacaaaatcgtccccatacccacatccatacaggtaacgggtacccatacccatataattgatttgtagcatttatagttttgtattctaattagccatattagagttgtaaaccattaatattttccctagcaacaatgctattaatattagtgttcaaaggcgagtaaaaaaaattatacaaccacattacataatcaagaaatcaaataataatttcatataactagtctataacaatacttaagatgtgaaaggagttttatgctatgatttagtagtcgttgagacttatattgctaatagttttaggcttaatcaacgaatttttttacccatgggttggtgggtacgggtgggtaaagaacatacccatacccacgtactcaataggtaagagttttcgcccgttagtagacccatgggtataagagttaaaatacgattagcttctagtagaa

SEQ ID NO: 56015 - DNA, 2891 bp, Oryza sativa
tgttcagttgaagttaagttctgagaagaagaggagataaggagatggacggcccatattacacgataccggttcacaggagaagttaatgaagatccaagggatcacactgatcgaagtagtagctgtagctgtccgttgccgtactgtgctacgtcattttttgtgtgtgcttgtaatggcgtaagaatataagccgcttctgaatctgaaggatgtatcgaacaattcaaaccctaattttatctactcattcttgcggcgcacagttctttcctttcccttttatcttttccagatatgatcccaataggtagctacatggctaaatttctctgaatttctgttgaatcagggctcaaatcggccgggtcttgacaatctggtatcagagcaaggcgattcttggccagcttctggatctgggtggtgctaagccggtgagggttggagggacaagtaccctctgtaaaattccgcagccaggctaaggagctcaatccagaagcagagttgtgagaagagcaatgaaggttggggagggcttcggtttctctctgtaaaatcccccacttgttgctgctcaaagatggcgaggggaagaaatttggaacctgtgttggaggaggcggatccggcatgggctggagatgtaggggagttgaggcaagctgtggcagaactccaggagaagtttgaggaggagaacaaggcgatccatgagcagattcaaaatcaagctatgcaggctcaagttcatcgagatgagataatgcaatccatgaagatgattcaggagatgttgagttctacggccagttgctctcggaaggaagctaaggtgaagcagaggtggtaaagatgccgggggctactcagtcctcaacacaaaatcctcaaagaagtgaaggtatgatgatgtttccatccactccagggagggtggacttaaggggagtcacttgtcccatgactcaacccgatctatttactactgctcacactactagtattggtagccacataccccaagttcccacttttactgcccctgagatcaatacatcagtgttcttcccaactcataccactccacctcatactagttttggaactcagtactaccatccaaatgctcacatgatgaattatcacaattccccatactttttcccacagtatgctcctttccaaccaccttgggtctacacacaaccagggccttacacttaggtagataatccaccacatgggcaacatgataatgtgacacatgagcaacaaaggcacagaggtaggaatcaatatgcagaggaggtgaagaaaggacccaagaagtttaattttcctgagttcaatggggaacatcctgaagcttggattagaaaggcaaacaaatattttgcacttactaagacccctgaagaagagaaggtgctagtagctgaggtatacatcactagtaaggctgatcagtggagtgatagctatgacattcctactgaaaccctatcttggccagaattctgcactatagtttgtaagaggtttgctgctaagtctaaggtggagataattgacatcttcagaaacctaaagcaatatggatctgtggagtcctatttgacaagtttgaagagattgtgccattggtcaagagaaataattccagcttgaatgaggagtatttcctggattatttcatctctgggttaaaagatcatattaagaggccactcaaatccatgggaattcatttgttagtgcaagcttatgagcatgctaggaattatgacagtggaccttagttcagtaaaggcagcagtggactgcaaaaacctgagaagaagggtgaatgggttggaaataaaaagggaaaggatgataaaaatgagactggtggaaaaattaagtggaatggcaaatgctttagatgccaagaaccttgggttcctgggcatgggaaagtgtgtaaggccaacaagcaggtgtatctggtgactatggaggaggaagaaactgaaaatgaaggaggatatggtgaaattgttgacactgaagctaaattcgatacaccacctgacagcccaagaaacaaaatcaaaaaaggagaagaaaaggagtaagctatgcatcctatcggtgaaggagatatgggagccacaaccttgaccttaaaggtcagaattggcaaggtgacagccacagccttggtggatagtggcaacactactacattcattacaccatccttggtgagaagggctaatctggagatagaaaactatgaaccaattccagtgaaggtagctaatggggaaattttgtatacaagggcacattgtcctcaacatgcataccatatccaagaggaagaatttgcatctacattcagggtgttggaaatcagaggatatgacatcatctttggatgtgattggattcaccagttcagccctgtatctcttaatcttaaaactaaagagttgactatgagtaaggatggacacaccttggtgctctcagatgtgtcagttcctgtaaggaatttcttgattagcatgcacaagctggagaaatgggtagatcaaggaatggctggaacagtattgcacttaaaaccagttcaggaggatgaagggagaaaaggggaaactcctgaagaggttaatgaggtgcttaaggagtatggtgatgtatttaaggagccaaaacaattacctcctgctagggactgtgatcacacaataccattgatccctggagctaaaccagtgaatgtgagaccttaccgtctacctcatcatcaaaaaaatgcaatggaggaattcatgaagcagatgattactatcaatactatccaacccagtatgagtacttactcctcacca

SEQ ID NO: 56016 - DNA, 30872 bp, Oryza sativa
atgtggggcactttgaatttgtggtcatgccattcaggcttactaatgcaccagctatattccaggccctaatgaacaaaataatgtgaagtaccaggtaaaaaaaataatgttaagtagctcaaaagaataggaggctaaccctatgatgtagtattatatattcccatggaagtgaagttaaaacacgcctaacaaagatgtgtgttgattacttgattgcttccatgaaacacgacctagcataataaatttctaattgaggctggtaattcaacttaaacaaagttgcccttgacatagaaagatataaataaacatgcagtattccataccaagaaaaaaaattacaggaccattatcatataagctaaaatcattgaaaacatgatagacagtagcaacttgatcataggggaagcaaaagaaacaatggtgcgtgctgagtttgacgtcccagagctgttatatttaactagaatttcttctctcttttttaactcttctcgtgtttttgctaaagcttcttggagtggcatgttgtacatatggctgtggactgtaatgtcacaagttttcttattcggcaccaggtagaagaatccaccctttaaacgacgatccttgtaacggctgagcttctcgttaatgatatctatcaagtgattcatactgcgtctatgtttcttatagaccgtccatgtaagcatggctaatcccttaagcatattatggtaaaccaccgctattcttttttgcactaacaaggatacttcacggtctaatgacgtcgttttagccatagtataaccttcactgcaaatccaggtaccacgctcatctcggagacataaccgaaaattctttttcccaaccttgaaaccagtcttccttcgtcctttcctaaaagattaaaaaaaatctctaagaaaaggaaagagactctagttgcatccatcactccatttaaaaagacatttgcatcttcatatacaagaaaatgacaaccactccagatttaatttttcaaaactttaaccaccaaatagctctcaaaagattatgtttataaaagtaaaaattacatgggtataattttcgttacaagtacttttacaatacaacaatgtgctgtaagttatcgatatattctaataaaaaatagtaatccaaggtacatgtaactattttgtacatattatgcaatctcaattattttgtacatattatgcaacttaattttccgcagcaacgtagcggggtattcattttgtttgctttcaagtacatcaaaatttgttttgtggagtgacaattgcaatcatattctgcatatatagtaatctatccgttttatattataaggcggttgacttttttttccctaatcaaactttgttaagtttgaccaagtttataaaaaaacagtaacatctaaaatatcaaattagttccatttaatctaacattgaatatattttaacaatatgtttgttttgggttgaaaatactataatattttttctataatcttgatcaaacttagagatatttgactggttaaaaaaaatcaaatggcttatgatataaaacagaaggaatatttttcaagtccaaaagaaaaattctactatactattgttatttattattagtatctttcaaacctaaaaaaagtgtgcaacacgaggaactggccattacgtaccttgaacatatatatgccttgaattaatacacgttatatgatttgtgccggcccccatcggtgcacttattcaacgaacaagagaaacgacatatttgtaaaaaaaaattgtgaacaaaatttttatatacatgttcttagcgatctaaaattattaaaggataaaaaataaacttcgataaaaaaacctctaaatttaacttcaaatttaaagttgttaattcaatttttgactgataagtataagcgaaaagatgataccatacatgtttttttgaaaaaaaagatgagatgagcatataattatagtacatacatacctgaagctgcggcaggtacaatcattgtccattggctagcagagtcgcgggtgctgcaaaattgtcgtctctgttaatcgcgcggatgccaatgattttcatggatcaaccgagcacataagccacatatgttatatatacacgtagtattataccttgataacgtcgaagtgggtatggttggagtaggcagtgttgtatttggatacagtataggtgtatccgtgtatgtgtggaaaaaaaacgaaaaaaaaaacgaagtacttgagagcgtgccggtgaggcaatggactttgtatttatacctcagcgacacctttaccttcgagatggacccgatcggacggctacgatcagccgcaccccgcgtctcaccacccaaatacccaacacacaggctacgctataaacgcaggcaaaagcgaccgaaccaaaacccaaacgcgagccgagcctggtcgagacgcttctcaacgccacgcccctcacctaaccgggccgacgacccaagggcccaagcaccagccaccctctctctctctctctctctctctctctctctctcctctccgccgccgcaccccgccgcctccctcctccggcgaccgccgcgggcagagcgcgacaagagggagggaggagagctcgcccgaggtgggggcagggagcgcgaggagagggtgaggggaagatggtgagctcttcgtcgccggtggtgaacgtgtacccgctcgccaactacacgttcggcaccaaggagcccaagatggagaaggacacctccgtcgccgaccgcctcgcccgcatgaaggtcaagtaagtgtccccgcccccaaacccctccctgatctgacgctaggtttcttcttctccccggaaccctaaaccctagagctcagatcatgcccgcttttttccccccttcggtttgaacaggtccaaggtctgcttaaattagatagtactgaaacaggagtgtattaggcattttttttgtgaactatgcttgcttaagccgttacattttaactgggatttaagactaaacacttgtgttctgactgtttatgccaccctagtgttcagatggtcatcgtgggcacttattttgatccgtatgttgatatgggaaattgttttagttacatggcttataatggtgggtgattcgttgggtgttgacttgaattatagctaaaatgccacgaccatctatttatttgctcatgtatttttcctctcacgctgttgatctagctgccaagcactatgtcatgaatagttttacaagataatttacgtttgtcagaagaatacccggaatgtcaagccaaaatagtatgacactggaattttttttctgtttcttcagttgattgcgatgcattgttgtgttaattacatatatctactttgtttccgatgtaacttatgaacagctaggctccttcctcagtatattcctttctaagattatctgtccaataatgcaagttaattacaagttgcttctgtaatgacagctacatgaaagaaggaatgcggaccagtgttgaagcaatcctattggtgtgtttatactttcttcacattatttatgtacacaattttgtgtttgaaatatccaacagttgtcaaattttgtgtagttattactactagtccatataaactgcagtgtgtcaaacaaactgaaatctttgcttgcattgtcctaaataggtgcaagaacacaaccatccccacatactgctgttgcaaattggtaatacattttgcaagcttcctggtggacgtttgaagcctggagaaaatggtgtgttatgtatagctcttttttaaaccctgtcagtttcttcataaattgtaatataatgtatttagctgttggttctgctactggaatttgcagaaattgagggtctgaaaagaaagttatgcagtaagcttgcagtgaactcgccttcctttccacctaactggcaggtaatgagctcaagagaaatttagatgcaactcctttgaatttaagttatatctggtgacattttgcatgtgattcatagttaatccggtattaatgaaggttatccacatggcgtcctaaatttcatagctatttctgatttgtatcggttgccttaatattgatctagaagaaagagaaaactcaactgttgtttcggcaatcctttacctattgatttgcaatatctgtattatttgttactcatttcttatttcaggcacacatattagaatgttactgagtttatgtgtgtcatattgtggcataggtgattatgtgcacaaagttgtaatctgaagcttcaatggtcagctcattgtcttgtatacctcttagtcacagggctagttttctttatgtatgccctttgtttttatgtgccattcaagtacatgtgtaggttatggtatggtttgctggacctggaattttttggagaattgttgctgatgatttttcactagatataaaacgtgcagattcagaatgaacttttaacttattcatgcttgccactctttatagttatttccttatcgtgttttgtattcaatcatgttgataatggttttattgaatgcctttaaagatggatcttgtgtagtttaaattatatccaatctgataaaggtgtaaacattgtttccaggttggagagtgtgttgctgtatggtggaggccaaactttgagactgtgatgtatccttactgccctccacatataaccaagcccaaggtacattcttgcttcaaaaggctttttttcttagggcctgtttggcagggctccaactcctaaaataactccaggagtggagctgtggagtggcccgaacctagctccacccatctagtatattttttcagattactccagcccgctccactccctttttaggtggagctgaaaccgtttggttgggccccagctccatgagaggtggagctggagcgctgccaatcaggcccttataacttagtgaaatcagaaaatctaaatgtgcattgtggtgaacaggagtgcaagaagcttttcattgttcacctatctgaaagagagtattttgctgttccgaggaacctgaagctgcttgctgttccactgtttgaactctatgacaacgttcaggtaatctaactcatcctatagtacaattagaattcttgaagtttgagaatatttttcccatctgtgaggcgttatgaactatgtaccagtggttatagtttctttctgtttcattaggaagcatttccatattatcaatttgattttgcttcattctttcttttttctatttccacttaaaatcatacttacacagaagggaaggatccctatattaagttggtttctaaaagaaaggatccatctcttgtatttagattacttccctgatcttcgtcttgtttggtgtcattgacagggccttagttgtcacataatcacttatctttaacgaggcaacatgattaggacatcttacaaacagaatttccaagtttgataaaaatagattggtgttacacaaaatctaggttcaatcataatgtgccacattagcttttgtaagaacaattttgtatgtatagcctttcctttgtaggccatcacttctgcacagagtttgcttattcttctgatgcagttttttttgtgtcttatgttgtgcttattcttcaattactttgctactgttgctgaaatttctttgtgtggatgcagcgatatgggccagtcatttccaccattccgcagcagctgtctaggttccagttcaacatggttagctcgtgaaggtgatgagagatggagattagtgtgcactaggctctatttgatgggatcttcaacgggctgaactacctaatcgacttggcatgactaatttgttctatcacagagaatttccatgaattagcttgggaaaaatattctggatccatcgttggactgttagctggacatgcatttcgactgtattttgttggattgttttgtatcacatcgcaaagctggtgcctggtgtatttttagatgatcttttgttggctctgcacgctaattgttggtgtacatggctctgtatgcttactgccttgatgttgtatgctgtagctgtaactcttcaggctgcctagcttttttttctagccaggaactccccctcttaactgtaaaaatgctttggatttaagacaacatagagaggattaagctttttacagtgttccatcacatgcaaattatcgtgcgtctgtatgtggcatgcttgtcagttgtcactaaaaactttgcggctgaatgcaaatgcttcacctagcagcatcactaaacgcggactaatagcgctactattgtgtagttcatcttgcggaaacaacacagtacgtggtgctcataataggcggcaattcaggggtttccaatcttggggtaacaacaacacattgcgtagtgctaataataagcggcaattttgggttgaaagatcgactcggtattcttaaaaaaaaagagaggaagcagaactaagtcaagatgatatgggtcgccccttctttttgcgccaaagagtctcagtgagatggagcattgtgtagtgctcataaaaagcggcaattttgggttgaaagataagagtctcagcaagatggtggatttcgtgaaattcgatcactctttgaacaaaatccgatacaagccaagtggttcggacttagcttcggtacaattccgaaatttggatgacgaaattcgaacaaattttgttgcgatcaaagccaagtggtttggtagagctccgaaatttggatgacgaaatttgaataaacttcctttttgaatcggaaaactcgaacaatcttgtgaacagtgggccagtggctcaccgcccacttcaccggtttccggcgtccggcgcggcgcctgcagaagagcccctcgaaaacccctaccccccatagctgcccacgtccccccgtttcccgcgcccacctccaccgccatcgccatgggcaagccgaagcagcaagtgctctcccgcttcttctcccccaagccgggggcctccgcccccgccaccgcggacgatccgccgcctccgcctagacctcccgccgagccgcccgtcgccgccgtcgtctccttctcgcccgccaagcgcgcgcgcgccctctccgtctcccccaaaccaccgccaaaagggccaagccctcccctcccccttccgactacgttcgccgcaggctgctcgaaccgccccggccgcccccgcccgccgctttgaaccctagcggcaaaggctacaccccgctggagcagcaggtggtcgacctcaaggcgcgccaccccgacgtcctcctcatggtcgaggtcggttaccgcttccgcttcttcggcgaggacgccgccgtcgccgcctccgtgctcggcatcatcgcccaccccgaccacagcttcctcaccgccagcatccctaccttccgcttgggcttccacgtccgccgcctcgtcgccgcggggcacaaggttggcgtcgtccgccagaccgagacggcggcgatcaaggcggcgcacggcgggggcgcggccggcacgcccttcgcgcgcgggctctcggcggtgtacacgcgcgccactatcgaggccgcggccggggagctggagggcggcggcgcgcccgacgaggggagcaggtacctcgtgtgcgtggtggacaaggaggtggacgccatggggacggaggggttcgaggtgaagatcggggtggtggccatcgaggtttcgaccggtgaggttgtgcacggcgagttcatggacggagtctcgaggaatggccttgaggccgtgctgcttggcttggcgcccgttgaggtcatcctcgggactccaatatcctctgccacggaaaaggtatacctgtgcggtttgtgatgtgcgaattgtaggctacctgatttgttataatctgcaagtaattccaggttgtaacttacctggtctgttttctcagctattgtagttgttctaaatggaaacttatttaggattgttggtggaaagactcacagtcatctgggtagtttggcagcaatagttcggcattttaaaatttctcagcaaaaaaagaatgattgcttgttgactctgccaaattaagttctagcaaattattcctatagtgaactttggaagggttatttgccttacagtttaatgagttccccccagaattgtttaaagttcttacaatctgtgtgaaagttccttcctgttttgatgtgcttgagacccctctgtttgatttgttctgttctacatgttgtccagctgatggtggcatatgccgggcctacctctaatgtccgggttgagcgcacctcgcgtctttgttttagtgagggtggtgctttagctgaactgctctctttgtttgagaagtctggggttgatgctccaactgttgagaatggcagacatttgatggagatgaacgaggagaacaataatcctcgtgggattgaggtaccgttaagttcttctgaactcactgtcatcgcaccttatgattgggtctccatatgtagtttagtaagttccaatttctttttttctttttggttcaagcagggtatcatggctatgccagaactagttatccatgcactggccttgagtgttcgctatctcaagggttttggtatggacaggataatctgctttggttcttcatttcagccatttacagctaacactgaaatgtctctgtcagcaaatactcttcaacaacttgaggtagacttttatacaacaccgccaaagtaaattttttgtttgcatatatatgaccttctgtttatttactctgcactgtctgtaagtctcatcttgaatcctaactatatggaagaaagtgcatcctatcattaaataatatatatatatatatattatttaatatgagacttacagttggcttttcttagaaacacatggatcacgtcaactttttgtttttatgacctatgttcttaatacacttttccactccattcttccatatatgaaagtaacacctggagtgctttcaggtattgaagaaccactcagatggttcattggatggatcattgttccaaactatgaacaacacatgtacagcttttggatccagattgtttagacactgggtaagactctgtaacctggtcatggaatgaatattaatccatgatgcatcatatcactatgaaaagtgataactagacagctattgtttatcttgactattgtcttaaaggtctttggttgtgacatttcttgcagctgactcaccctttatgtgatagaaatcaaatatgtactcgtcatgacgcggtctctgagatctctgaatcaattggatcacaacaatattcaactaacaatctccaggatgaagtggacatgtcttgctcatcttctgtgagaagtgatctgagcaccattctttcatccgttttgagaatgctggcaggaactcttgatatacaaagaggaataacaaggattttccactgcaaagccacagcgaaagaggtcaaatatttattattccttttcggttctagacttctagttaatttgataatgacacctaattatgctagtttatttcattaaactgacattatacagcatgaatatcctgcttagactaatcccttttttttattatactctctgttcagactgtacatttttattatttactgtccaaatattcccatgatttcaattcaatattcatgtaatcagggtacttcaaatgatactcccttcgggctgataatacttgtcgttttagacaaggatgaggtcaaattttagaatctttgattatgaatcatttttaaaatatttgtctttcaaatatggtgactacatgtatagattagtcttaaaaagtactttaataaaatcatatatttgttaacatttttatacatattataatggaaaataatggtcaaagttgttttttggagaccgtgcccttgtccaaaagaccaaaacaacaagtattatcaacccggagggagtaaatgttatgctgctgaaaaattatggcttggttcttatgccaatagttgactggtgcattctgttcttgacgcctgattgcctatagttttgtattgtagtttgttggggtcgtccaagctatcctgacggctggaaagcaactgcagaagcttgttcttgaggatacagacaccatgtcttctcagcatagaactgtgcactctcctttgttgagaaggctaataaatacggcttcatcatgtactgtcctggctaatgctgcgacacttgtgtcttgtcttaacaaagatgctgctgatcaaggagatatgctaaacttattcattgcatctgttgatcagttcccagaggtataaccttctcttttagggcttgtttggttaatccccatgagggagggaattggaggggattaattccacaccccttcaattcccttgtgggagggattaactgaacaaagccttaatggaatgatcttgttattccctagtttttatgatgcatcgtcttcatatttgaaaaaaaaattataggttgcagagggtcatgcaactgttgaaatggccaagcagaaattggagctgttaattactgagtatcgaaagcagcttggtgtgcgcaacttggagtttaaaacagtagctgggacaactcatttgattgaagttaagtcgcttaattgaattcagttaacttctaactattgttaattgcagttccaagtagcaaatgatgtccatgagaaaagtagcacagagcaaaatattttacagttttgttatacgattaatattaccatcatcatgtcatatcttgtgcctgcagctaccggtggatagaaaggtaccttcaagttggatgaaagtaaacagcaccaagaaaacaattagataccacactccggaagtctcgaaaaacttggagaatttattgctggctaaggaaaagctagcagttatctgcaggacaacatggaataacttcctcatggatttcggcagatactatgcgcagtttcaagcaactgttaaatctcttgccactctggactgcttatactcgcttgccactctcgcaaaacaaaatgtaatagactgttcttaacccttttgtgctcatctttttacattcactttgttccaacagtacattgctaaacaaccaatattccatctgccagaaatatgtacgaccaaattttgttcgtgagaatgaagcaagtcagattcacataaaagatggccgccatccggttagttttggatcacttcccactccattcctaatatgaatgcaacttcagtttttaacaggcaaatcacaaacagtatcattgcattccttttattagttgtaatacagtactgcctcacaagttttgcatccctaagaaaacaaatagaagaacctgaaaatttgagatactcatactgcagttgaggggattagttctattggtcaattttaattactccttccttttggctgtacatctaccgtgctttgggcattttggtcttttcaaatatttaggtacctaggttttgtaagggaagtcgtgtgtacagatttgtcacgaaaagtactttcgtaatatttcaatttgatcgggtttttggccactggtggtcaaagttgtttttccaaggccataccattgttcaacacgttattatatctggcctgagtagagtagttgcatgaaattgcatgcatgtttcaactttaagagctataaagaatagtgtcatgataactgcatgctttcttgaaagcttagattttacctacaattatttcaggtggtcaatatgaaaataatattctactgtgccacggacactatttccaatactactggcagatcacacacggtcatgcatacttcatgtgaagcatttagtttatgttgacaatgtttgtatttctatgctgttggtttttaggttctggagtccctacttggagtcaattttgttccaaatgataccgagcttcatgcaaatagtgagtactgccagattgttacaggaccaaacatgggaggaaagagttgctatattcgtcaagttgctctaattacattgatggcccaggtataaatattgtctcacacttgtagttcactcatgttaacatgttctggatgtataacatagttactgcaaacttagttgttgggcttaggacctgaggaagtaagggtttactttgttgttatcttaccctgactctgagattatcctaacacttggtacactgatttccttaggttggttccttcgtaccagcttcatcagcaacattgcatgctgttgatggaatttatactcgaatgggcgcgtccgatagtattcagcatggaacaagtaccttttatgaggagttgagtgaagcttccaacatattgcataactgctcatctcggtcactagttatcatcgatgagcttggtcgtggtacaagcacacatgatggtgttgctatagcttatgctacattacactatcttctgaaagagaagaaatgcatggtaatttttgtcactcattatccaaagattcttaatattctgagagaatttgaaggttctgtcggtgcataccatgtctcatatctagcaacacggaaactgttggaagtagctgatagacagatggtgattaacaacacagagacaaaggatcttggtgaaatcactttcttatataaacttgttgctggagcttcagacagaagcttcggtcttaatgttgcgctgcttgcacaggttagttttaagttgtcatgtctttttgtttctatatttctagtttggtccaaatttgattagttattaagacatgtgcttaataccatgacttgcaagtgaccacctttcttcccttgtactctagactgattgtagaataacgacatacattcttcagtttgcttgttgctgtctatatagggaataggttctagttttgggttcattgttttagtacaggaaataagtcctctgttttcttcaatgacgatgcatgttgtggttaatttttgaagtacccttcctcctttgcaagctgagttacagtttgaagtgaaacagtgcttatgatctccttgtttttgttacttgtttgctgatatgtgttcctatttgcagcttccatctagctgtattgagcgcgcttcagtcatggcagccaaacttcaacaggagttaagtgagcgtgagaaaaataagttttgtaggctaatggacgttccacgggaaagctctccgaaagagctttgtgcacagccttatcaagggctggctgaagcatgccacaggatactatttaacgttacatctgctcaaagtaatgacgagttaacggatacactatcttctttaagggaagccagggaaattgccttgaaggcaataaaaggctggtgatcatgttcttcgaagcagtggatacttcaccactggtttccttttgtttttttgaagggatcaggtattgatgctgttccattctgttcaggtattgcttcgttctagctactagtttctaatgtagtgccttgactgatctttgcatgaaggtggcatcttctgataatctactaaaaatttatcgaagatgattttgggactaatgttatttatcgaagacgattttgggactaatgttagccattgtgctaatggcagcagtgtagactgtaaaatatagtggatctggaaggtggaggaccttgaagttaaagccaactctatggaagagcaagtaacttattgtaaatctgtagttacagcatcagttgatgtatccagacttgtccaaaccatattaaagctttgcctccattttgaagtgtagatgcagaaatgagatgcatctcttatatcctattcctcagtgaaatatccctgtgtttctaatttgtgtctatttgtgataatcctggaacttcaaaatgctgtcctccgtcttgatattttcgatttgaatttggactgatctatcttttttttaaaaaaaagttacactaatctatctactggagtacttcagcaacattttctaaaaggaaagaaaggaggatgctgaacgcagcacagcaacattttctaaaaggaaagaaaggaggatgctgaacgcagcacatcctgaaggcgtacttaagaaaggccagcccagcccagcaggggcgccggcccattcatccacttgggggcgtaccatcggtccatcgcacgtgagaggagaggaatatcccgtaaaatccgaagagaaggaatcctcctactacacaaatttcatatttttttagattttctttgtttgagaaagtttcaggtggcagagtcacgaatgcatcatcgctctcctgccctgcctcgtctcctccgctcagctcagctccggtccaaaccaaaacacacacacaacataagaggcggcggccctaacaaatcccaagagacttccactgcacaaccaacctagagcagctttgagacttgagagtgagagctcgcgagtcgcgcacagactcaaacagaggcagagagagatgggaagggaatgaggcggcggctcctctccccttctccggtgacgtgacgacgcccctctcctcctcctccgctgccgcatccgagttcataaaccttcgtcccttccgccccgccatccgtcttcccggaatcccggtatgtaagccccgcccccgcttcatcagttcggtcggattggatgaacgcccattttttgtggggacgttcagcgtgatgtatcaacgattcaatcgaacagccattggttttttttctcccgtgtttctaatctaatgccgcttactttttttagccaaacattttgttggattcctccggggttctgatttgggtttctgttgatattgtgttcgtacagggggcgcgtggggatggatttgtctaggtttactgccccgcggccgggcttgcagatcggcgccgccgggaatggcttccgggcatgctccctgcggcgtctcaggtatcgtgtctgcggcgggaaccccatgggcgcctccgccctcggaggctgcggttcccgtagcctcttctacttggctccaaaccatgggagccctcttgccctccggaccagagggagggcgctgaggtgccagggaaatgactcactggcctatgttgatggccctttggaaggtaccaatggctcagtagtcgataataccgaggacgaagcaaacagctctgggttggatgaggagaagggtgatgatgatgcagaaaatctcagggacttgcttcagaaggcgaggaaagagctggaggtggccaggttgaacagcaccatgttcgaggagaaggcgcagcggatatccgagtcggccatcgcactgaaggatagggcagataaagctcagagcgacgtctcttctgccgtgacgaccatacaggagatcatcagcaaggaggctgatgccaaggaggctgtccggacagctacaatggcgctctccatggctgaggcccgcttgcagttggcgtcagaagctctggatgccaaaaggggatcagtcgggccgatggaagttagcattgatgatgtggaggaggaggcccttgcgtccgcgcaagaggagattaaggagtgccaagaaagtctgtcaaaatgtgaggaggagctgagacgtatccaagagaagaaaatggagttgcagaaggaggttgatagattgacggagcttgctgagagggctcttttggatgcttcaaaagctgaggaggatgttgcaaatataatggttttggctgaacaggcagtagctcttgagatggaagctgcacagcgagcaaatgatgcggaactagcattgcagaaagcggagaaggccatctcctcggttgatgccgtcgtagagttaccagcacctgctgaggagcaagtaagtgatgaagaagacaatgtttctgaagtgtatgattacagcagtgatgctatagatgatattcctgaaagagacgaggtgtcaaatgttgagcgcctaactgttggggacttagctgtagaaggcattgagcaacttgaatcatcccgtgaaatgtctgatgacgaaagcactgacaagttgcttgttgagcctcagaaagaagccgaacctgatatagataagtcaaagcaagggaaaaaacaggaaatagaacgaaaggagtctcagccatcgaatgctcctaaagcatcactgaagagatcatctcggttcttccccgcatctttcttctcctccaaagcggatggagaatttacacctacatctgttttcaaggggttgatgaaatcgactagaaagcatgcgccaaagcttgttgttgggatagtgcttcttggagcagggtgagttgcatagtgaataatatcttttctctttggtttctgtttgctagaaagtaagaaaattctgatttcccatatgtttgtatatttatgctggatactgttatagtttgtcatattttctatctgtataatcaaataactgaaagtacttgttcttacaacagttgaagtgatttcattaatgttgataagccaattctttatgaaacggtgtttctattctctgtctacagagcattcttcttaaatcgggctgagaagagtagtcaattatttcagcagcaagaaataaccacaagtattgaggaagttacctccactgcaaagcccatagttcgtgagatgcgaaagatcccacaacgagtaaaaaagcttattgagctcttacctcatcaagaggtatgttccctttcaactgaacctgtacattggcgaatttatttcccttttttgtgagtacattctcttgctgctcacacaagttagacaagaaatttggcttgtgtctaactcccttctgctctttgttaccctaggtaaatgaggaagaagcttcactcttcgacatattatatttgcttctggctagtgttgtgtttgtaccattatttcagaaaatacctggaggtgatacatttatttctgacatctatatgtgcatagcatggtatcatggcaatcaaactttccttatccatctgccttttttttacaaatcatatcaaacaaattcgtctctgttctactctagttttagtttcaagtttcaaccgaacactacaaagtacaaacattcactttgattttctaatttgaaatatctgaacgtttgttcactgtccgatatttctttttctaatatgcaccttgatatcataggtagtcctgttcttggatatctggctgctggtgtcctaatcggtccctatgggctttccatcatccgtcatgtccatggaacaaaagcaattgctgaatttggagttgttttcttgttgttcaacattggccttgaggtagaaactgagtttcttttagattctttccttaatcctcatgcaggatatatcagcttaccattttttacctgcagctttctgtggaaaggctaagctcaatgaagaagtatgtctttgggttaggctctgctcaggttatactcatgctatgcaaccagtaaagcaatagttccatgtggatactccctaacaaattggagcaattgacaggtgctggctactacagcagctgttggtatgatagctcaccgttttgcagtgctaccgggaccagcagcaattgttattgggagtgggttggctctgtcctcaacagctgttgttttgcaggtacttataactggcatttatcttgtgtcatagattctgacattttgatatttctcatagtcaccgtgatcatatcacaattggaataaattgatcacctggaaaccttttttttctctgcttcaaactttgataccagagtattgtggaaacttcctttctacatatatatttgtggtcttcatttttttagttacactgggtgttgagcacttatggtttgcttctctaggtactacaagaacgtggggagagcacatcacgacatggacgtgctacattttctgtgttattattccaggtatgaccaccatgatcatgaatattggtgattatgttccaagtttctcttcctccctttttttttcttctgatgcacttccttatgttttatcttgagttcttgatgacaccccaccctgtggttgcatttatttgaatgtcctttactgttccttgccatgcatgtatgcaagcatggacttagacatacactcatctgcaagcacatgcttatgcttagggtttattgtttcctcttcccatatctattgccatttacaggaaaaaaaatgcattgacctgactagtgttaatgtaatctaagtctttcttctgatagatatttgttgtgacatactgttgtatgcaggatttggctgtggtggtcctgttgatattaatacctcttatatcacctaattcttcaaaaggaggggtaaccttttttgatgccatgttctttttccctgtctgagttaggacatttttgcttgttggtgcaaaatgatcaacgtgtttactacaaatgattcttcgtgcatgaacaatcaagtactctacatcactcttgtaacagtcagtataatcatgacatgaactgatgagataatctagatgttttatcctatagcatgatcaattgaccaattaaaattgttaaatttcttgattggtgataaattttatgaatcactttaaaagccatgttccattgcattgccctttgtaggctatttaagccagatgatctatttattgttctaagtgctcattctatatttctgatgacataggttaaattgacagaaatataacataagtaactgttgtgtaagatcagctagtgttatatatgtttattgaaatgtatgcttgacacttggacacagccaaagacattaatttagcaagagttttaattgcaatatgaccatggttgcttctcgcagagtctttccataaccatgtggtgtcgcaatgttctctttttatctttttctttctgtttaaactttcttacacaatttctgcttcttataggttggtttccaagcaatagcagaagctatgggaatggctgctgtaaaagcaatagctgctataacagccataatcgctggaggtcgtctggtgagtcggctgttgtttcatttagttggcattcttatccgttgatgatttttgcattgactctaagtttgactgccagctaaacacgcacacctacatgcatgcatgtgtgccactgcacatttatagcccttgttgcctgtgtgctcattctgctctctagaatttgattataactgttcgatttgtaagttatcctttttatgttgaacagttgcttcgtccaatttacaagcaaattgctgaaaataggaacgctgagatattttcagcaaatactctccttgttatttttggaacaagtcttctcacagctcgggtatgtatatttttcttattatatcccagccttgcatagttgcattccttgaatctactttgcatgttgttttactctctcatttcaggctggattgtcgatggcactgggagcatttttggctggtctattgctagcagaaacagaattctccttacaggttgagtcggatattgctccttaccgtggtcttctgttaggtcttttctttatgacggtaaggactctgaatataatcatcattttttttgtctatgtcaatgagctgataggagtttgcttcaatgtttatatggataatataacaatgtacatatcgaatgcaacattacagacatcgaattatgttgatattatcttgctagttcattagttatgatgccaccgacatatgcaatgaataactttacacgcttgttcactatccaactgtttgacttcacatatttgtcaagttgttatgttttatttatttaaatttttaatggtcatgtattgtgtagaacagtattaatggttccagtgtcatatcacttatgtttctgtctttgattcttattttagatttttttttaggtccaacatcgtggtttctattatttactctggaatgacgataaatcgctaattcttcctgtaagctactatcttatttgaagcccttgcttaatgcttgcactgcatttgccctttccaggttggaatgtctattgaccccaagttgcttctgtcaaacttcccagcaatctctgtgatattaggtcttttgattattggaaagacaatgttggttacatttattggtagagtatttggaatttccaccatagctgctgttcgggttggtctgttgcttgcacctggtggggagtttgcttttgttgccttcggagaagctgtcaatcaggtttggccctggttctttctgtttttttgtattgttttaggtgataagatgtatatgtcacacacatctgagttaagacaaactcatggacaatatttttgcagggtcttctatctcctcaattatcgtcattattatttctagtggttggcatttcaatggctcttacaccatggttagctgctggtggccagtttttggcatcaaaatttgagcagcatgatgtgagaagtttattacctgtggaaagtgaggtatcttcttttcactctcatagaccaacccatgttttaccttctgtttcgatgacctttttttttttgctgcaatagaggacatttgcaaaaacttagtatttttcccagtttagtttgtaatgaactgtcaagttcacagattttaacaagaatgcataattccatgctatgttcaattcagctagtataatacaaattttgtccatgtagacggatgacttgcaagaccatattataatattgggatttgggcgtgttgggcaggtttgtaatcctcataagattttatctatctatctatctactttgctcgataaatttctactaatacgcctttcatatatttttagataatcgcacaactcctgtcagaaagattaattccatttgttgcacttgatgttcgaaagtatggtactgcatcttgcaataaccttgttaaaggcagctacaagataatattgaagcatatctcagcattactattggctattatatgtataataatcctcgttctcaagcatgcatataagctgctatgtgttcaaacactttgttatgatttatgtctggctggtgatgcctacttgtggttagtggcatgcttgttagacagtgaacatgtagctggagataaattctagtagatccacaaaatattagaaaattcagttaagtgcatggaaactaaggaagtggtggcaaaacctgcaggaaacagatgttacactttccatttatcgttggttagttacattttggtagattgataaggctggtagcttccctctgaaacaaaagtgatgtcgtgtgtgatgctattgccgtaacatttggttgtcatctccatctgtcttgggctgccaagcctgccacatgtacttgttcaattagtcaatacctctggttaaacctattatcttcaactatttaattcttgggcacctttttcactcagtgatcgggtggcagttggacgcgcgcttgacctaccagtatatttcggggatgcaggaagtagagaggtagaacaagttcaactaaaaattctaccatacaacttgtcaaaaggtgctgatctcaatcgatttttgccaggtactgcacaaagttggggctgagagggcctgcgcagctgctattactttagatacccctggtgcaaattatagagctgtctgggctttgagcaaatattttccaaatgtgaagacattcgtccgagcgcatgatgtggatcatggtgttaacttggagaaagctggtgcaacagcggtaagtatgtgtaacaaagttgtgtgcaatgatttcagcagtgtctaggagtctaggtgatgacatactcctggtgcaacttgaatggacattactccatgtggttcagtgcaagtttttttttacacattttattttattggaaggaacttttaaaatccagtaacctgcctattaacatttgcggcaagtagtttttcacaaatatatgaattgaaatgtttattaaaaccttaaaccttgtggcagttagttttggaacctggtagtacacacccttagttgtacagtcatttgcatagaccattagaaaaaaaatcttttggtcactaatgaattaaatgttgaacatggaagggttttaggtgctcatttgccactcatgggattacccaagtatctgtcggtgcaattgtaatatttggtgtcatcatttggtaccgatggttcttctatacttgtgggctagccatttcgatatgatatataacctgccattgtgctgcactgctgcataagggcccattctttgtcttatgcatatccttttgttatatactgtattctatcaccgatttaataatactatctcctaatggaactacatctacttttaaggttgtccctgagaccttggaaccaagtctccagttggctgctgctgttcttgcacaggtaagcaatgctgttacagtattatactgttatgctctttcatcaagtgtggaatttaatgcacaaacatcaatttttcctattactgtatttcaggcaaaactcccaatgtcagagattgcagcaactgtcaatgagttcaggaaccgtcatctgtcagagctcacagaggtttgtgactgcattgcaacttagtgatcttagtcataaactcataatgatttcaataaaatccatagagctgtaaaattttcctatgtttattgaagaccttaatgaagtcctacgttggtctattggtggatgattttttattcaggttcaaatgctaactgctaagttcttttttctgacagttatgtgctacaagtggaagttctctgggctacggatactcgagagtcatgtccatttccaaatcaaagaccgtcacctctgatgatgagagtgaaactgttgatggagcattggcgatttgagctgatgcgttagtcacctcccttagactgtacagtagataatctgtcatcaaagataatttgcgtatagaaaagtagtagcaaaataattcacgcaatgacgattcccatttttgaaaacttagcattacccctttttttaatgtatggtaggacataggatattacttatcttctaccatcagttcatttatttgtagcccttttactccgttagcaagtaatttcttgatggagaactaggacgatgcttgcaccttacatggagaacactgagaatttcacaagtggcctccaaatggcgcatgatggataagtcgtagtcgtctcttatgaggaatccatacaaccaagattttgggttcagaactaaatattatgattttgttagtactcagagctgatgttggaaacaagtggtgtcgggtttcttttgatattgcattatatttttaacagagcttgtttattattgttcttgtatagtatcttttgttagagctgcaaataacaaattaaatatcaaactagtaaacatttgcttaattaaaaacgagtaatgctatacgtacttaaaaatatttacgaaactcttattaacaaagatcttaaccgtcggatttaagtgggtatttgtgaaaaagcaaaattcgataacaatgtttgtcacgtcagtttttgtacgtgtacccttctccattaaaaaatgcagcagtaatgcgaactgcacatctataaagcgtcttccatctctgatgggcccagttttggaagtactcctgcagtcaaaaaaaaaaaaatccatttctaccatcccgtagaattagtggagagtgagaatgactaaagtaactttaattattaaaaaaataataagagtattgaatggataaaatttttcgtttcacgtgttaatggtaggtaaaatgatagaagttaatttttcgtgtgataaaattcaaactttgagtattttttggaccgagggaatcttacgtggccgcaggcgtatactttcaaaaaagaattaaaaaaaagtgaccgcaaagtacgctatcataagacggcgcgtccggtcaggtgccgctccatgcggcatccgtctcttacgtggcgtgtgccaagcggttctctctggcagtatggcacgcggtccccccctgccccaccttgttgcgtccgccctctcacgcaaacacacacaccaacgcagaacacacagaagaactccaaaaaaaaaacagtcagagagagagagagggagagagaggcagaaaccatatcgtttctctgaacaaatcactactactacctcaaatagaaaaaagacgaagtgaaaaaaaaagaaaaaaaacacgcatgaaacgtagaacaatcagcacgagcacgccgaggaagtagtagacatgcaaactttgcaactcctcgatcggaaaagtacttcagtttctagtaccattcgcaggtctcatcacacaaaacaccatcactagctacttaacagataactgaatccatctaggactatagtacctatcaaacgacgacgaatctgtcatgagacgataccaaaaaaaaagataggatatcatctcggtaaacacacatacggagtatgcccttcacgatatgatctgccgcgaccgcgagcacgaacatcctgctgctactcctacggcgccgcgcccgcgtcgtccgcggccgcccccgccgccggcgccgcgccctcgtcgtccgcggccgcccccgcgtcgtccgctggtgccgccgccaccacctcgtccgctgcagccacctcatcttcagcgaactcctcaaggtcgtcgtacttgttgaggcggactagttggtccttgcgcagcggcttcttcaccgggacggccaccttgctaccgtccggctgcacctccagacgaagctgttacggcatcaatacagagcactacccataactctagtatcattgggcctagaagatccaaacgagaagtccacaccaacccaaagtatatgagctgtgattggtctaatagttgaggaagtctataaatactagaagaatcttctagaggcgggtgtggtaattgaatctaacttctatctgaagaaaccattcctcctcctaactctgtttccttcttcctctgctctgaaatgctatgttctgttctgttcttcctcctcatccccaatttcatctgtgattcgatctagggttcgtaacatcttggtatcagagcccgatcctggagcggccaacattcaagacgcgtttgcaaggtcaagtggacgccatggagaagcagcacgaaggcttcgggaagatgctgtccagtattcaagaggcgatcggcgccttgtcggtgaagcaaggcgaggtgcaggagacgatgaacaaaatggagaaatccatttcaagttggcgacccctcaagttgatgctgcggtgcagagcttgcaggcgtgacatggagttgctgagaaatcaagtcggtgcggtggagcgacatcaagcggaagctgacaaatcgtcgaacacctcgcaggcgttggaggagcgggaggaaattgctcgtcgcacatctctgctgccgacgccgccaaccacgtctctgccagtatcgcaggcgttggaggagcgggaggaaattgctcgtcacgcacctctgttgccgacgccgccaaccgcgtctatgccagcctcgactggcgaaattggtctggatggccaccgcatttcaactcagttccgggggagggcaccgggggtagtcactactctcgtcccacctccgggcaagggtacgcactctctaccgtttcctcctcgtgttcattcaaatttttcggagtttgttggtcgcgaggagagtgggggatcagaggggcgtgggtacaatcacagattgccgaaattggattttccccaatttgatgacagtgatcctcagaattggcgtttaagatgtgaacattattttggggtttatggcactcatccagatttgtgggttagagtagctaccatttatttcattggtcgagctgcatcttggttacgttcttcgcgagctcatttgctttgtgggagttggggagttttttgtgatacggtggataggaagtttgataggaatagacaccttcagcttgttcgtcagattgatcagctcaagcagtcagggtcggtgaatgagtactatgagcgttttgatgatttgtggagtcagttgttggtttatgatccaaccttgagcactgtgagttgtgtccatagattcacggagggattacgcagtgatattaaaaatgcagtgttaatgcattttccccaagatttggagactgctttggctcttgctatcttacaggaggaattgggagaggctggtggatctttggtgtccaaggatgggaagaaattgggtgatcacgctgctcgaattaaaggcgcttaccctttacctttaccaccacccaaatttgtgcatgctggcaagggagatgataaaagagcagctgaagttcctaaagtggccagttcttctgacaaattggttgctctcaaggcctatcgacgagctcaaggtctttgttatgtttgtgctgaaaagtggtctcctactcacaagtgttcaggaccagtacagttacatgctgttcaagaacttttcagtgttttggcagctgatgtttctgatggtgaacaggatgctgattctacctctagtctgatggctatttctttacaggccattcaaggcacggtttctgcacatactttgcgattacaagggtccattcaaggctttgatgtgttaattttggtggattcaggcagctcttgcagttttcttagttcagtggttttacctcatctcactggtgtgaaatctttacttactccaattcaagtaaaggtagccaatggtactgttctttattgtacctctgagttgccggctgcaaaatgggaggttcaagggcatcagttctctactaatttcaaactgcttcctttggacaattatgatatgatcttgggtatggactggctagagaaatatagtccaatggatatcaattggcaggccaaaacaattcagttttgtcttcatgataagtcagtggaacttaaaggagtggtacctgaattggataaatgtgatgtggtgtcaattgaccagttacagttgttgcacaattaagcagttgtggagtcattggttaagttcatgaccagtgacggttatagtttttctcaaaatgttgcaagttcaattcagtccattttggatgaatttgctgacatttttactgaaccagaagggttgccagcttgtcgatcttatgatcacactatccctttgattgctggagcacaactagtcaacattcgcccatatcgttatacacctgatcagaagaatgaaattgaaaaacaagttcaggaaatgttgaaaaaaggtatcattcgtcctagttccagtcctttttcttctcctgtgttgttggtcaagaaaaaagatggcacatggcgtttttgtgtggattaccgacatctcaatgccataaccatcaagaataaataccctttacctgttattgatgaattattggacgaattggcgggtgcttgttggttttctaagttagatttgcgctcgggatatcatcaaatccgcatggctcctcaggatgaacataagactgcatttaagacccacaatggccatttcgagttcagagttcttccttttggtcttaccagtgctccagccacttttcagggtgttatgaattctgttttggcagctcaattgcgtcagtctgtcttggtctttgttgatgatatcttagtttacagtcgttctttggaagagcataagaatcatctgagacaagtattaagcactttgacacatcaccaattgaaggttaaactctcaaaatgttcttttgctcaacaaagcttggcttatttgggtcacatcattagtgctcagggggtagctactgatgaggagaaaattattgctgtcaaggattggcccactcctctttctgtcaaagacttgcgtagttttttgggattaactggttactatcgcaagtttgtcagaaattatggtgttatttgtaaaccattaaccaatttgctacgaaaaggggtactgtttcaatggacttctgtcactcaggaggcttttgtagctctcaagactgctttgattgaagctccagtattggctttacctaattttcagcaaccctttgttgttgaaacggatgcatcggacaaagggattggagctgttcttatgcaaaatagtcatcccattgcctttctcagtaaagcacttggacctcgcactcaaggtttgtctacctatgaaaaggagagtcttgcaatcatgttagcaattgaccattggcgttcttatttgcaacatgacgagtttgtgattagaacggatcatcgcagtctgtcttttctaataaatcagagattgtcgaccccttggcaacaaaaagctttgactaaacttttaggtctgaggtataaaatctgttataagaagggattggagaatggggctgctgatgcattatctcgccgacaatctgatggtttggaggaattgtctgccatttctatatgtttgccggactggctacaggagctaattgctggttatcagtctgactcggaggctcagaaattacttcaagctttatctgtgtcaggtgcaggtccatctaactttgaagtgctgaatggcattttgtattttaaacatagaatctggattggtcataacaaacttttgcaacaaaagattttggccaatttacatactgcagcagtggggggtcattcaggaattttggttacttatcaaagagttaagcagttgttctcttggccaggcctgcgcaaagatgttcaggagtttgtccaacattgtgatatttttcaaagagctaaatctggacatgttaaatacccagggttattgcagccattggaggtaccttctcaatcatggcaagtaattactatggattttatcgaaggtttacccagatcggcttcatttgactgtatactggttattgtggataaattctctaagtttgctcatttttttacccctgaaacacccctttactgcctttggagtggctcagcttttcatggaacatattcatagtatacatggtttacctcaagctattgtatctgaccgtgatcgagtgttcactagttctctttggaaggaattgtttcgccgagctggtactcaactccgaatgagttcttcgtatcacccacaatcggatggacaaacagagcgtgtgaatcaatgtgtggaaatgtttttgcgctgctttgttcattcttgtccttctcggtggaagcattggctggcattggctcaatattggtacaatacgtcatttcattcagccttgggtatgactccttttgaagtattatttgggcacaaacctcgttactttggattatccacttcatctgttgatgctcctggagatcttgcaagttggttaagtgagcgaaatgacatgaatactttgattcatcatcatttgttgcgagctcagcaacggatgaagagccaagctgattcgaagcgatctgagcgttgttttgcggttggtgattgggtgttcatgaaattacaaccatatattcaacaatcagttatgactcgatctaacaggaagttatccttcaaatattatggtccatttcaagtcttacaacgaattggattggtggcttacagattacagttgcctgctcacagcttaatacaccctgtcgtccatgtgtctcagctcaagaaggctctcgcaccatctgaagcagttcagccttctttgcctgtgttgaatcctgatgctggtcatttagcgattccaatcaaaattctggatcatcgttcgattcgtcgaggttccaagatgatcaagcaagttctaattcgttggtccggtgtgtcttcttctgctgacacctgggagagtttagatgaaatgcaagctaagtttccagctgcaccagcctggggacaggctgaaactcaaggagggaggaatgttacggcatcaatacagagcactacccataactctagtatcattgggcctagaagatccaaacgagaagtccacaccaacccaaagtatatgggctgtgattggtctaatagttgaggaagtctataaatactagaaggatcttctagaggcgggtgtggtaattgaatctaacttctatctgaagaaatcattcctcctcctaactttgtttccttcttcctctgctctgaaatgctctgttctgttctgttcttcctcctcatccccaatttcatctgtgattcgatctagggttcgtaacagaagcttgcggggagtcgggacagcgttgaaggtagagcggaggagagcggcctgcggcccgcgtgggaagcggcacggcggacggtgatcagccttggcgagaggaggagggggacgtgggcttcgattggaggagcaggtggtggtatctcgctagcattggccgaatggaatggacatggacacgcctgctctctttttaaaggcggacatcctatact

SEQ ID NO: 56017 - DNA, 4691 bp, Oryza sativa
atatatatacacacacatcaggtgtggctcgtgtgccaccagattcaatttgattgagaacttgagatccgcgcggttaacaaagacaacaactagcttacacacttgtgagcgatggacaagaatctcacctgccgcgggcgcttcaggtatgtaaactcatccgatatttcatgcaaagaacataggtcatgtaaataatattttctccatctcaaaatataaaggattttaggtagaatacatgaatctggacataggatatgtcacatccatccaaaatctcttatattttaggacagagagaatactatgtattaaagataattttagtgatccttttgctataataatgccatctaattagtaggttatgtgaataatactctctgtgctgaaatttaacaatttttagctctctatttgaacaaaactaaaatatattataatttgaaacggatgtggtactactgtgtataaaaagatactgtactatgataagttgcatgaaaatctaacactagtatgaggcttcgtagtttgcgcatgcaagtcgcggagggaagtcacgcgcaggttaattgacacgagtcagactccctgttgtggtgcagcataacggtgtttcttttccagaagtcaaaccagctagtttttcgatttaatttccattagcactgctttctgaactgcaaaataattccaatatatttttttagaaaatcatataatttacttttgaaaattataatagctaatattcccttcgtcctaaagtatagcaagttttgcccaaatttatagctaaaacttgctaaaccttaggacggaggttgtaattaattatcactaataggttttttttcgtttcgtgtacggctgaaaattaaatctcatcctagctgcccatacgaatgcatgcatcggccctatgcatacccacgttgacgaaagcttttaaaaacttcatttgaaagtttgaaatttttagttaaaagttcaaatttttggtaaagttttcaaaaaaaaatcatttttttccaaatttgagttggatgtttcgaaaattgaattgcaagttctaaaacttaagttgaaaggatcaattttgttggtagaaagtttactttgaatttttctaattcgaaataaaaacttttagttgaaaagtctttattgaaagttttattcaaattttgagagagcttagaaataactacaaaactatatagaattcaaaagctattcaaactttcaaaatagaaattttaaataatttcccatctattctagccacttaatattcgtcccataaggcccaaaacgcggcagtagccatgtctcgcgtgcaaaaaacacgttgagagaatcctgttcgacatttttgttgcgagtcgcgacgcgcgcgcgcaaattagttcttctgaacaaaatgcatgttgaaaagcatatccaacatttttttgtctcaaaaaacacggtatgattagatttgtcttttttgatattccctccttctctaaatgtttgacgccattgacttttttaaacatgtttgaccgttcatcttatttaaaaacttttatgaaatatgtaaaattatatgtatatataaaagtatatttaacaatgaatcaaatgataggaaaataatcaataattacttaaattttttgaataagacgaacggtcaaatatatttaaaaaagtcaactgcgtcaaacatttagggattgagggagtatatgatatgctttaagtttataataaatgaaaccacatcctctctattttcttatttcctctctcaattttcttgttttttttttcagacaagggaagactggttttaagattaagaaaaagaagtttaggctatgtgttcgcgatgagcatggcacctgggtctgcagtgaacatgacaccatggctaaaacaacgtcactggggcgcgaagtatcgctgcaactggaaaaaatgatactgggggattactcctcaaaacttaagatgttaggtatgcttaagtggacaacttttaaagaccagcgatgcggtataaatcacttgataaaaaatattaaaaataaactcaaacggtacaagtatcgtcgattggaacgaggaatcttctacttgacaccatctgctacagtgaacagccatttataccacatgccactcaaagaagcattggtgagaacaaaactagatttacgaaggcgaaaggaagtattagatagatacaatagctcggagggatcaaaattccgtagtggtgcaatggtttcacctatgaccaagttgtcgatatgcatcctgtcttcggtgattttagcttatatgatagtattcttttaaagttaattgatgtactgtagagtgtttgtaacttgtttatatcattgtgaaggcaagttctttcttctatttaagttgaattgcagcctataaatcgaacacctaatctcccctatttatggatttgtcacgttgggcatgtttttatctcacacttagcatagaatgtgtgcctggggtgtttcagacgaaacatcagtagcccccatcctggcaaatcacactaaaatagcatttcatcggtaaaaaaaaaagtattaggaacgacagaaattttgggttaggccaaaaacaatatcttcggtacaagaccagactacatgcaccaccaacatgctcttttcacaagaggtactgcagtggcacacgccattaaaacaacagcacatcattggtcagattgtgcgtcaaagttgacacgagtagcaaaatggtttatcgtattgggtgcagcttttgaagatctaagcattgcaacctgcaaaatagatcaaaatatgctatatcaaatgattggcccaaaactccagacagtttagtaaactcaacttttcacatagaatgggaagcccctaatactaccttaggactgttcatattgcttccgagataaccaacaccaaatgaaggggaggaataggcagcaacaagttcagcggctcccaatgcagatacctcccctctctgcagaatgttatattgttaaatcaaagattatccatgcaaaacccaaggagacgtatcagcaaagtaccacctttagaacatcagcctgaattagcaacaacccagcgcctgtatcatgagacatctcgctgctgctttgaaccgcttggcgcagaactttggtacaagcagaagcagggccagattgtatcctgagaaaatacaaattgagttccaaccaaaagagaatatgatgttgaatgtaacgaaattatggtaatagattatgtagaaaggttaggagtccataagcatggactgccctagatcatgttatggccaacaggaatgacagaactggctagatcaagacatcaagtgacggcaaacaacagtgctcaaactgtagattaagatagcaaagctgaagccagtgtaaatatgatgcaagcagtcctacatgtttgcaaattcattgaggctgaatgacatggtgagaattgtatagtgcagaactgtatatcaataagagcaaatttgtagagatgagcatacaatgatgatgagatacaacattcacgtgcagcaaatcctctaatcaagtgttcaccggctccagttgcacaacacccaactataaacggtgtgccaaagggccctttggatgaggcccagcacccagacccatacatagcagccaaaccaacccgtccatctacctgcaagaaaccaatgcttattgaaggcctggggaatctctatgcaaaggcatcatacaagaaatataaataaaagagtcctcctcaaacaaatttaagtatcatacaatgaaaaaaatgaccactggacctttagtgcaatgccaccactggatgctcctgatgctatatttccataagcatcaacccaaacagcaccaacagtatccatcacgcagtcttgatcatcctccatgattgatcgtgtgatcatcttcatcttctttacaccagtaatatcctcagcttcagctcctaaaatgaaatggcaacatgtgatgtggactggccaagtacgttattacatatactgatgcacacagaaagcacaagcaaataatgagcagtaccacaagcctgggacctagtgctgcatatttgagtgttgaattatatatatttgaaaggaatctcgtacagacattagcatctagatgaccgtttatggaggccaaaaatcatgcagatgaacacaagagaatgccggcatacagaagaacacgcaatagcatatgtagcatagacaactattggaagaccttgtgaaaaggagtggtgtgcatttgcatgaatttaacacatatacgagaataaattaaactgcaattaagttttagaagatacttcaaccaaagaagcgttgtggatatgataaataaccacttaatcaatatagaagtgattagagatactaacacacagatgaaataagagcaacagtaagggagaaaaaagacctggtgcttccaactgtactgaactagattctgaaccagaaccagtgctatgattaactgattccttggcacttgcaagcaatgatctgtattttccccactgtgcttttgcactctcagtcaccaaccactatttgagaatataccaagaacggatttcaaaacaagt

SEQ ID NO: 56018 - DNA, 11379 bp, Oryza sativa
aaagcaatttggatgggattctttacacctgatctacaagaaataagacgtgtggtaacacaaatagtaacttttacacaggaggattgatttatcgcaaattactacaagtaccttgcacagctccaacagctccaaaggtagtagtagaaccatccatgatacttgcatcgcattccacatgaccactctcagtcaaatttgaaccgcgtccagcatttgtgatgggatcatcctaatcagccatagatgagaatggataaactaagacaacttttgcttggaacaaacaccattagccctttatctacatacaagtacactgtatcaccctcgattcgcttatatctaggaggtctgcaaaccctgcttatatgatctatagaaccactcttcctttttccccccttttgacatatcaaaatgtggccatatatcatacaccatcctatttgtcacccattgtaaaatttgaactaaactgcatagtacgtgtagacattgtaacaatacgtagaaagagatgatccaaacctccaatacttgaatggcagctgcaaccgcatcaaggcttgtgccatttccctgcaaaagtattaagagatttaggaattcaccactgcaaagctacatggacgccgctcgagcattacattttcacactacttcaatcaataccccatctagaacataaatccgctcgccagtcaaaatccattgctcagatggaacacttggtggggatcgcgcgtcaatccgagctccatgccatacaaaaccaaccaagcacgagagcaggaggagaaggaggcgagtggggggtaagtaggggatagggtaaagtacaaaacctcgcggagcactgcggcggcggcgaggcaagcgcgcttcatggctcggcggtacgccttctcgttcgccggcgcgtggaagccggcgccgacgtgcacggccacgaagaacctacggttgggggggctctggttcccttctccttctcctcctcctcctccgccgccgcctacccccacaaactcgctctcgtctcccccgccgccgccgccatcgccgccggccatgttcgtttcgagctcgtcgcgattaggacgagaaagttttggaattatgcgtttgagcccctgaagagttggggtttttcccaaaaaggcccaaaatgggaggtatttttgcagttggacccttgtagaaagatatattagtaaataggttgcgaatccttttcactagcgtggatcttcgtgtatcccgtttgtgcagacaagatgctttcctttttggtgtatttggacccctttttttcttcacggatgattttaattttatctgcacactccagtgaacagcacagtaaggctgctactctatactgcaaatgtgacgtgtgactgatttgatatggattggatatttgggttgtgttaataatcatataggagtagcaatttctatctaaaattttcatacatgaattgtctagtaagtatatttgaaacacaggattaaaaaaacatggatttttatagaaatgcaagtgtaaaactaaatattataaaatacagaatatccatttgaatatatcaaaagaaaaacacatgaataagatgagatcgatggactcaaaacgaaaatttctactctcccaatacctagtatgagataacggttatctatgagatatggaaagttgcattaagaccagctaatagggctaaatcattgaaataaggaagtgtaaatcgtttcatactttctcgctaaggcgtgccgcccgaaatttcagcccccatctccacacgcgtttacctatcgatgatagaaaggcaaagtttgcagccggcacgctaaacaattttagcatgaacacggcaacacgtacgacctgtttatatatgactaaaactttttaaaattttttagtccctatcatatcagatgtttgataccaattataaatattaaacgtagactattaataagacccattatataaccctgaactaattcgcaagacgaatctattgagcctaattaatccatgattagcctatatgatactaaagtaaacatgcgctagttatggattaattaggcttaaaaaatttgtcacgtgaattagctctcatttatatgtaattagttttataagtagtctatgtttaatactttaaattcatccgatatgacaggtactgaatccaaacatcatctaaatagtaccagtggagtacgtagtagtagctttactagagggtatagctttactatagggtaaaaatgaaagaaaaaaagtttttcttttgacatgaaaaaagaaaagttttcatgagaacccaatgagagaaatgaatacagtctatacgtgtactccctccgttccataatatagcaaccggtatcctataatatagcaatttaaaaccagataaaatattttatagtacaacgaatctgaataaaagaatattcaaattcgttgtactataaaatgttgggtgcagatcccctggagttggcttccaacttcaaccggtgaatttggaccaatctgaccccttactttgtttatatgggttagatgtagccatgtcacctctttctaattacacatttacaacagaaataatcctatctaaatttatttttttgtgttgtccgtccattcagatcaatagtctcggaagagcattatacatcatggagtaaaaaataattatctttaaacttttttaactgagttgttaagaaattaacggtattgagacctgtatcgaactcattcattctaataatcgacagaacaagaagcttctatcggtgcaatgtttttgttttgtttgttcttatctaattgttgtcagaaagtttaaaggtaacatgttctctactgtactagataatatttttttatagactctacattgtagtatttcttttgaaagaaaatgggctagtagtaaccagggaaaaagggattggatttaatctaatccatcaaattaaagggatggcttagattaagtaaatccactgtgtggatttggaggcaactccaggggatccacaccctaaaatgttctatctaattttagattgctattatattattttagacatgtagattgtaggagtagactatatacagggccttcacttcagcctttcacgtccctgtgtaacgacaaatcttcttttttttttctcttccctgctcgcagactgcacagggcctgcacgcaattactgttcctttttcccttctttttccatgcgaaagaaaatgaatccatttcctcatgctgctgctgctctcgatccatcctcagttctcaacgcacaatacaaacacacacacacagagggagagggagacgcagggtcaccacctaatcaccaccaccacctccaccacctcctctcttctcgggattgttactgctccactcactgcttggcccttctctcaccttcttccaacttccccctctccttctactcccctccaggatcgaaccccgcgcgctgcaacaagcctggcattttggtatgtatttcttttttcttttaatttttgtgtactagttcatccgcttggaacatggtacatggttcttggccttctgggttcatcttcttgctgggaagcaatcggtttgattgttaaccccccgcgatcttcagccagcgtgcgtgcttcttttgtttgtgctgtgcgattgtgccgtggggtttggttatagtttgattctttgctcttttttttctttttctttttttagggttttgtgtttgatgcaaggattcagttagcgcacacctgttctcttcgaaagctttatttagtgatgtttgcgttggtgtaaagcatggagagttcttgcgaattaatgggttgtgatggaaatgctaaaaaaatgtaaagatcattaattattggcgttacagaaaccacaaatttgttgcagggggctaactagagatgtggagtgttaaaaatgtcatggtatcaccgtgctgcgggttttgtgaaattgtttccttgtttttttccttttggtaatattttggaggaagatcgtgtgaaatcactagtattaattgttttgtgaggaaggttatgtaaaattgtggtgcctcttgaatcttgatgccataaccagcgtatgacttataagttaaataaagcttccattatctaaaaaaagatgacttataagttataacatgtcgggatttttgactatttcatcttaagaacaaattaaaagcaagacaagtactaacaagtttacatgggtgcaaagattaataggcaagggcgccaagctgtgaggaactagatagatttcacagctccccgttgggaggcacactgcttgcttattatagctgctgcatgtgtactgtttgtgttactgcgcacatatttccttgagaagctttctttactactgtttgtgttggtataaagcatggtgagttcttgagaatagaaggtctgtgatggaatgataatatgcagagatcatggattattgacggcaaagaaaccacaaatttgctacaatggggcagctagagatgtgtaacgcgatgtttgattatttgcactttgtcatctcaccggggtgtcactgtgctgcagatcgtatgaaattattatatttttaggaaggtgtgtgtatgtttgcttgttttgcacggataaatgtgtgaaatatggtgtcatgatggcatcaccaatgtgtgccctataacatgttggcattgatgttaaaagcaacatagaactacaagagaagtaacaagttgtgcagtgcaaatttacatgagtttgaactatatataaacagatttcacagctctctgttgggaggcacattgcttacttcttataagagcaggatcaataataccgcccgttgctggctataaaattcgccatgtcatttagtaggctatatagtatatagatgtagcttgcgttttcttccttgggcaggccaaaagctgcatgcacaaactgattgctgtccaatcaccatttatcctgaacagctagtacccaatcactatgcgtaagcaagggtatggccaattgcagtaaattcacctagtcttggaggctgcgtgcagccggcgctaatatagtcgcccgcttaagttctctgtccttgattccctccgccaactcagcttttttgccatgatggatatattatagcctgcttaattctcctattgtacttgctctaagcttctgcatgtgtactgttactcaaacacttgttaatcctcctttttttttgcatgtgtactgttactcaaacacttgttaatcctcttttttttttcagaacctcttctttgtgaaccagttgcaggcacaattacgaggtggaaaagtgactttggctgctcagcaggagggtttcagtgacaagatgaattctggtgctgaatatgaagatggcagtgaggaagaagaaccatatgaacgtgtgttttatgatgatgaagacgatggcaatgatgattcaatatgtggggatccctgtgatgattcagtaccaaaagaggaggtgcacaggtaaagtggcaaagacacatttcatgtggagcatttcatcaatctggtgcttaattctcgcagtacttgcaggaagcttatgcatgaagcagagccatatgatgatttggtggctggtgaggaggaatctgttgagaactctgctctgcaagctttcaagaaggaacgaaatgagcaagagctcaagcaggcccagaaaatgggttacagcattaagcaaaaggagataccagtggacatggaaatgggaatgaaaccgttcaaaaaacggcttgtcaagtttgctgatgatgtatcatgttacacatacagtaccgagagttttgctgctgcaaagttggagaaaaggaaagctcagtttgatgaccaggacaagcacctccataagaaacaggaacacactccaccttcgtttcctcaggatggtggcaagctgaaagaagtggacaacactaatctgtatgtgggcaacctacctgcttctgtaggttctcacaagctcatcgagctatttctacctttcggtcaaattgtcagatcaagagttgtggatgattgtttcactggtttgagccagggatatggctttgtgaagtattctgatcctcgctgtgcttctgaagctattaagcgcatgaatgggcgcttggttgaaggaagagctctagaggtcagagtagctggttttccatcatcagaggataatagccagcagccttcaaaggaaactgacatggctaaattgtatgtgtgcaacctttccttgtccatgaacacagacaggctgattcatctttttctgccttttggggaagtaactaatgcaaaggtggccaaagatcacacaacaggcttaagtaaaggatatggctttgtgcagtactctagtcctcaccatgcagctgaggctgtcatccatttgaatggacgtcttgtcgatggaagaaagatagaggttcgagtatctggcataccttcaacactgccaaattcagctgttgaatcacccagcaccaccagaaattcagctgttgaatcacccagcaccaccagaaccgtcaaggaaattgacatgtctaatctgtatgtctgtaacatgccatcgtcaattgacaccaagaagttggttgagcttttccttccatttggtaagatcacccatgcaagagtggtggcagatcctgacaccttttcagccaaaggatatggtttcatcaagtttactgattctgaatctgctaccaagctattgcagcaatgaatggagcattggttggaggagaaatgataattgtcagagttgcaggcctttccccatcagcatccatctcagctgtacagaccactcaagacatcaacaagtctagactatacatcactaatcttccacggtcgatgactgccgataagatggttaatcttttcgcgccctttggtcagatcactaaagtcctgatgaatctggagtatagtctagtgtggtatgcagatgcaccctcagctaccaaagctgtccaacacatggatggatacatggttgaaggaaagaggttagtggtcaagagatcagagttatgtacaaccacgcttcacaagcaggtggcaagccaatcaaggaaatcgacatggccaatctctatgttggcagggttccatcaagtttaactgaagatcaattcatcgatctcttccgcccatttggacgagttgttcaagctagaatgtttcgatttcagaggtatggcatggttaggtttgataatccttcatgtgctgctgcagcaattgatcatttggatggctaccagattggtggaagcatactggctgtgagagtcgcggggcttccagcagaatccaatgcagccaagggtgctctgacatcacagatgtcttctaatgagcagggacaaatcgacatgactaacctttatgtgagccatctcccgagctatgttaacaacgaaagacttatcgacctcttcctaccatgtggccaaatcactcaagcaaaagtagttgttgagagatacactggtgtgagcaaaggatttggatttgtcaagtttgctgatgcttactctgctgctgtggctctcactcacatgaatggttaccctctggatgggcatgtgttggaggttaggatagctggtgttcatccagatgctatgagcagttacatggcgcatttctactcccacttcacaatgcatgatcccgcaaaggcggctgtcggaatacctacgtcctattggccgcactattacgatgaatccgcatacaatacaacagctgagaacctgggccaagtcaccactacatctgcaaccgatgcttctgctgctcaaacatctcagaaggaaaggttgcctggatctaaatcagtcgatttggttgctgagaaagattgctcttctgcgtcgaacaaagttgccaattgttctgagtcacagccaacagcttgggctggtccacctggctttgagcctcatgccatctccaagaaatgtactgctgggtccaatgcttctcaagcttgttcaaaggatcattttgcacagtcaggaggtggccacaaaaggcgttcaatcgtctagcaccattcacttcaggccacttgtggcttgatctaacttgatggaagaatctacctaagtttcccatcacttaagaattattagtcgtcaacgttttcttttgtagggagatttctctttaattgactggttttcccatttggagaaaagaccatgtcctaactttattgggtcagtacagtacttcttagaggtcaggttatctgagctagatggtagatgaaaacaatgtcagtgcaatgtaatggtaaaaacctctatgtggaaccattgcatgtttgtttatgaatcatgatgccaactgatgaccactctgatgagtgagagatgcttggttggagcttcatgctatctgaacttgttaaggtaagttgctgtccccttccatgtttgtctggttgacggtgtagtacttctggaatgttaactgctttattcagttcagtatttggttcagtttgatcatgaggtgaatatgcgcgtgtcgacgtcccaggattcgacttaccgccggttatcgcggttaatgggcttaccgcggggtacggtaatataaataccgcgataaccttcttaaattcaaataaatttaaaaaataatttaaatttttgataaattttgcacggtttcgtacggtttatcacggttaccgcgcggtaaccgtgcttaccgccggggcgcggtaacccagccccggcggtttgggaaacccaggtcgacgatcgttgagtttttctgtcttgcttgcttcttgtgtatacagctttatactactgtataactacgtcttcagttcagtttcacttactggttctactggttctgtttcactttcttgtcccacaacgttgttgttccagctgtacgcaaagtacagctaaattgcaataataagtagacgttgtgtgtggaaagtaaaacttttatagaggttcaatggcgttcactgtgctgcatgaagatttggtgaaaaaaaaaaaactggaaatcactggcagttcaaccagctaactcacagttacacttcatgtggaatcacaaattaacaggtccaagccaagccgaaaatcgtttatactacagttgattcacaaaggccacacattcacgccttgctcgcagatatgaataatggatttagcagaaaataactaacagtgacaaccaaacgtccgcgtatatttatccttttacacctctgaattttaaaaccagccagacggggtaaacaatgccagctctcatttatttgaaccaaagtgtacacatataatctgaaacttgtgaatacggagaagtacattctgtaagaagcagcacttgtatggtataaaaaaaagggaaatacaggaaatgtgaggaatgctatgtaaaataaataaaatgcacggtaatcaggtcacttcgacatgaagagagatctgcactgctctgctgtatcatcaggactggtaactgcaaatataaatgatgaaatcagcttggtgatggcatcaatcatgtattagctcagaaaagatttaaagcaagtttaacctcggcaaacaagactcagccacatatgagaagcttgcaagagtattcctatttagtaagaggatacagctcaaccataatggaacttgtgaagtatttccagaagaaaatgttattgctttgtttattcaagacttgacccaagtgtttgtggttgtttcaaactgaattttattcatgaacattaacctgaattggtcaattctaatgatggaaactgccagcaagtatactgctactgaacattcatttgcatgatctgtgcagtattgcttgattggaatagcctgtctggttgggtcaatacccaagtttcacagtctgatctacgactgtgtgctgatggttatagaatgtctcacagtaacattataaaatttttgtgtccaataaacctaatcctatcttatacacaagttttaagttataacaagaagttcaagtccaacgcatatacagtaatgtcatgagaataatagcttttatgaaacaaacagcacacctgtatgtccaattgtccggtcagactcaaatatctcataatcattgcctccctattgaatgaaaaaaaagtcaggcgaagaactaaatagtggaaatgttatatagttgaatatgatagacagataacaacaagaatatactgtagtgaacataaaaggggcaaagcatatataaggtgttattctagcattgtatggataaaatacttaaccacacataaagtaggaagcacttttttgctaaaaagagtacatatcaccttgtaggttttgtccccaaagaaatggatttcttgaaattcctcaagatatctcaagcagtaagttttgtcccagccttgtgggaacacctgttaaagtgatacagcagtaaatatcatgaaaccaataatttctggcacatttgtatgaggatagaaggcttacatcaaaactaatctgccctccaatagaaaatgtcaagttcaagtgggcgaacttttcacgaagcactgagaccattttaggccgaatgttatgtacctatagtaaataagtcagttaagtttcatggtgcctgaatgataacaaattattgctctttgtaaagaattgtttgtaccttatcatacttttcaaactcatcacgttcttcttgactacaatttctccctatgggcgacacattcagcattccacttcggaactctatgaatgtacccctgatgaaacagttatttggtccataaggagctgttgcccaatgggaattagtagataggtttgttcactgaccttttgattgggatgtccaagtcagcaatgtaatgaagcgtgaagttaataaattcctgcaaagaacatgtatcatcgattgcatggccttaaaatttatgtgtgaacaagcaacactataactaaaaaaggctcacctttagctgatcatctccaagaaacgatttcaaactctgcagagcacaaaacattatgttccataatgttccataatatagaaaggcgtcgttctaagaccagtagcagccaatgactttttttttttggggggggggggggggcgggtatggcaacactatgtcatttaaaaattggccaaatgaaaagaaaaacctctaccattattcccaggcccca

SEQ ID NO: 56019 - DNA, 13743 bp, Oryza sativa
cactatataatgcatatatttgcctaaggacttacttgagttccaatgagttggccgttcttgtgcgcgaccaggccattttcagagaagcagtaatcgtaatcagtagtaactgcggtgcaaggatgaatgcagctactcagagaggtctcatagagcataagcaatgtgttcttggattagagaacacacatcaactaaatccgcaagctagagagtacaggttcaaaacctgatttgccgagttgttcggaaatcttcaccagatcagatcccccaaccacgcccacagtgacatgctgctcccaatacatacataaccaaaacatgacatgaatcccatatggtccatggaaaccaggaggaagagaagtgaagaggagaagcgcagagacgccattctcacctcgcgcagctgcttcatgaactggagcatctccggcgtcaccacctatacccccaaaaaaaaaagaagagaagaacaagattcattcaacaacgacgatgcagctgcagcgaggaaactatcgctcgggaagagatgagatgagatgacggaagcggatccggagaatggggaaaccttgcggggcgcggtgagggtgccgtcgacgtcgaagagcgcgaggacaccggcattcttcctcgccgccatcgccaccactccgctcctcctcctcctcctcctgctgctacagcgaacgggcgcggtatagcagcagcaacagagcccggatgatgcgtgcggcgacgggaaaggcagcttgggtcgtttcgccggtgcggatctagacgcgctccctcgcttcgcctcgcttcccgcggcggcggcaacggcgaggcgggggaatttataggcggcgcgggcgcgaggtgtgcgtcgggatctgcgcgaggaggcgaagcggaggaggaggagaagacgaagaaagtcaagccgtctcgtggagtgggagagtgaggaggacgaggtgggggtgagcgccacgtcacgtgaccaatcgcgcctatggattggggtgaggtgaggccattcacattgcaagcaccgacggtagtgtcttaccccagacatttagctcaaagacaccctttcccacggtacaaggatcttattttgcgtgactagttggatttgggcactgtacaaggaaaccggcccacaacgctcgtgacttggtggatggcagcgaaggggaccgaaggaaatcaatttccccacctaccctcggacaacgacccgtcttctcttctcgctttcacctcctccatcgtcttctccgctctacttcctcccacgccaccgctcctcctcctcctcgtctcgtcccgccccgcccctactcctccgctcctgcatggccgctgcccctccttccgccctccccaccgccaccgcggcccctccttccgcaccccctcttcactggccccgcacgggagcgtggtggacgggctcggtgcggcagtgttggctgcggagctcggcgacgacctggccaaggcggcggatctggcggacgcggcgttcttcggcgcaaggccctgtagcgacgaggaggaggtggtgggggcgtagatccggcggtgagacgccgccgccatggtggatgtcgccgcgcacctcgactcctccgcctcctctagcgctgccatggggacgctgccgctccaggcctccctccttctccccgagctccccctggcggcgagatgactccgatgcggcggtcggcgtcggatttggcggacacggcggatttgttttttcatcatgtggtgtacatacgtctcgatttgttttgttgaatccgtcttatttgagttattctcttccaatcccgaaaattttcgtgcctaacttggtgtctggaggaagagtggctgtggcgggagcgctagtgttgtggcgggaggaggaacttcgctgcggcgggagtggattttgggaggacgattctgggatttcacggtgctagggcacgcgtgtgcgaggcgatgctgcccacagtgcgcatgcccggggatttcggcgtcgcgcgctccctcgcttggaccaggttccgcgcggctctgcttgggggcgaggagctcagctagggcgcgcatccatctgccacgcacacgaaaagcctagctggcatggtgtagcactgatccagctaggagcactgtgagaggcctgagtacgttttttattgtgggccgtggcctgctcggcccatctcgctacggtgggccgttttgtttgtctgggttgcctttgttaacacttgggatgggatagtcaatttgatgtcattttcgttttctaccgtaccaagttttggagaatgtcttctgcataactgtatgtgttgcgctgctcactgacatgtgggtctcacgtgctagaggatctctattgcattttttaatattgtcaaattttgataaggtagtaatctaaagttctaaacacatcccaaatactccacaatgggcctgttcactttgatgcaaaaaaaaaaccttaccaaattttggcaacttactaaattttttgcaggatttcttatatagttaccaaaatttagcagcaaactaaatgtagccacttttttttgcaaccttaccaaattttggtaaggttgaaaatggcatcaaagtgaacaggccccgtatgtccatgtcttgccatgccaaaattcggtgattttttacaaacttctccacataacactacacaagaatatttggcatggtagcaaagcaaacaacacccacacttctaccctaccaaattttggtattatcaaactttgctaaattttggtgttcccaaaatttggtaaggttaattttatatcagcgaaaatatgcgtcggtgtcgcgttcgcaaagtagatttgccctcgtcatgaaagaaagtgcatgattcgataaaaatattctggatttcacaccatcacatctttgtagtaaaaaatatacaaaatttaggcagagcaagtcaatggtctgggatatacatataaatggatgtttcagttcttaggacatcatagcacggagtattgttgacaagcacattaattcttgagacaagatctcctctcgttgatgctcattagtagcaggcaatcagttccagctgctgtaaccctccccctcgttctcgtggttgtgatgatggcgagtttcctgaagaaattcgagtgtccagcacattagcatcacacactccaaccagatgttcagacacaatggcaacaacaccatcgatgttgcaagagacagaggtaagtgtttttaccgctgctggagtgaaggtgagagcaaccttgatctctccacagtacttctcctccttgacgacacggtggacggctggaggaaggctgccttccaggaacacaggctccagaggaatgctgaaattttgcacaggtgagcaagaaccatacatgcatagactgacaaatatcactctgaagagatgttcagagaaaggtgttcttctgaactttcttcagaagctcatgttgtctcatggaagaagggattctactctcaagatggataaacatgtttgagttcagaagctgcatttcagctgtgcactgctaaaatggaagaatgcagagtgtcacccataatttagatgcttactttgcttcaccgacgaaatcgtcagctgagaaggcatcactgtccatgatcttgacattgagctgtggaacatcgtcggagacggtgaagacgaaggtctcgttccattcaggctcgcttcctgctcctgaatcgtttgaaagcaaagattgaggttcatcagattaggatcgtattcccgcccatttaggtataggtacagtacaaatcagttgatgctccatagcaacagcactgaaccttgttcctaatgcaatggaattagtatgtgctaacagttaacgaataccttttgcaacgctgcttttctgctcctgagtgcggcaggtgaggatcacgtaggggtccatgtcgtctgatttggcaaaaatacacacaaattggcatcaaatgaagagcgtaaaaaacagtgattctcagataaagtttgagaagattgtgattgagtatgtctagcccctacgtacacatgctttctcactctaacgctatgatgtttttaactttttactcgagtaggagtgtaggacaggacagcacaagcaaaactccacgatatactggcgtgcttttatccatccttcgtcgttttcgcatgcagatacatatttttttttaggtttgctttagagtaatgaagtgaaataaaacaattgttaggcattaacaacaggacatcaagcactataagtcaccgttgacccatgatctagctagaacaacatgctgataattgcttaaccaaccgcgaaatgcccctcctcgatcactctgtctagtatcctcactggtaatgaatcatgatatctattgatgccttgttcatgcatctaatctgtcaggttcacaatcctaaagaaacgattaagcagtcaaccagcaaagaagagaagaaatggcgtaatcaaaaacaaaagctttgcaaacacagcaagaagaggtagaaggatgtgtgtttactcaagaagtcagtgtcctcgaggcccttggcgcagacgaggaggacctccagcttcccgtgcaccatctctcctcttctcttcgatcgatctctcgctagtcgctagtcttcttgccgttgatctcttcttcttcttgatgatgatgttgcacaggcactttcccctttgctagtatggccagtaatcttcaccaactcatatagcaagtcgttgaaggtgccagccaaggtggccaagtagccagcatggcccactctgacagtctgtgtcttactaataaccattaattattgaggagaattaaaaaaaaagaagaattaagtacgggtcaatgacctcctcctagcatttatcttgcagaaagagacgagccgagcagcctcctctggcctaggttgagctggaaccggcacatgaactcatgagacgagaacatgccggggagactggcttgatgcaatgcatattttcacctaattgtataaaaaaaaagggatagacgtgggtgatttacatcatctcacgtctctactgctgtgggagggacagggaacggatccggtaatccgttaataggcgcgttggtttacaacataagatttgattagtggtgacttgaaaaaggaaaaaaaaatgtttgtgggagtatttggctgagggattcacgcgtgcttgcatttgaagttttgaacgatgcagcatgtagatcaatacggttcagccatcccagcccaaacaagattaggcctcactcttgggccacaatcatgcttccaatggccagcttactggcaaatgtaaggaggaggccaaaacttgggtctggcgtgagaagtctccatgattggttaatttttagttagcccgggatacatgtacatctttttttttcttttgtttacttcttttatgttcaatgaaattgacggctcgccgattcattaaaaaaatcatgatgcatatgaatattaaaaggactccttttcatcttattattagtcctaatcaaaagagtagaatgcacgttgataaaatgtaatctccctttacaccaggtttatactacatctaggctcccatctgatggcctaaacagccaaagaaaaagctaaaatttgaatttttaaatttaaatttgagattgattttgagatattttcaacgtagtttcttttacagcattggctttaagtcaccaagaacacatatataaaacgtttacctataaatttatttttattccctaataaaccgttttggtttataagaaaaaagccaaacgatgggggagtaactttttgaaaaagcaccaaaatgggaataccagcgtatcttctactactactacgtatctgctgcattccacggcaccacaaaaaccaacggatgcaccaacccgacgcccccgcggtcactgactggtggggccagaccaccaactaaactctctctccctttcctctcgagcccccgattcgcccgcaaggtcgccgtctccatctcgtctccctcgccgccgcctcgccgtggctgcccctccatccgtacgccggttgaatcgtcggctggctgcttcgatctggttccggttcctgattgcttgctccaccgattgaccgatcgcgttttgagggttgggggtttgctttttttggattccgcttgcgcggttgcaggtggtgcgtcgatctgcgtccatatggcggcgacagctgcggcgctcgcggtgacggacgagctggcgttgccgctccgcgcggtgggggatctggcggccgccgcgggggtctcgcgggaggaggtggtggtcatcacgcagtgcgcctcgcttggtgagcttctcctcgtctcgtttgggttgtttgaatacttttcgcctgaaatttgtttgaatactgaatccatctactcggattaggactttgcgtgcttagaatcaatctggaattgtgcctaggctgtgttaccagcgtttgtccttttgctgattttggttttgatttgttccaaccctacaaatcacactagttcaatcgattcatggtagctccttgaaagacctgtttgggattggagctcatttctgacgacgcccccttattatacttcatatgctaattctatgtagattcatttcaccacatgtaggaccaaatagggaacacctgtgagacagcgctattggttgacgaaggaaaaatttttttccatatgctcgcattaatcacgaggggaaaatattggagaacatctccctatatgtctgcattgattatctaaattcatctagtggtaatatgcaatatgcaattctcaccaatgactactaaattccaaaatttggaccctacaaccgacacactgttttgctctgctatatgttcagtttcgatttctgttatgctttagtataccttatccttgtagtatacattttggtttgtcataagctcgttttgaacattccatgttggcatggttcaggtgggaagttaccttttgatgatgcatcagttggttctgttcttgctgtcattaagaaagtggaaaacttgggcgatctgttcataactgaaataagcagggttcttaaagctggaggcatggtgcttatacagagttccccctctgatcaggatgtatgtactgttttgccaatatactttattttgtaatgcttaatttgcactccctgatcttctgatcttctcttcatcagcccaataactctattcagcgcaagctactgttaggaggatttgttgacgtgcaagcttctgctgcaagttcccaggatagcgagcattctgttactgtgagtgatctagtgccacaatatgtgttaatgcttctgtgccgtcatactttctagtgctaactgaatcacatgcagattaaggcaaagaaggtctcttggagcatgggctcttccttccccctcaagaaagccacaaagggtcttccaaagattcagattgatgatgattctgaactgattgatgaagacagcctcttgactgaagacgacttgaagaaaccagaacttccagttggtactgttttatagaacccttcagctttgttcaacgtctataaatttaatatgtagatcctgaaggtttgcttatgttttaccagttggggattgtgaggtgggagccacaaggaaggcatgcaagaactgtacttgtggccgggctgaggctgaggagaaggtggagaagctaaatctcacatcagaacagatcaataaccctcagtcagcttgtggcaatgtgagcatgactgctttttaagtgttatttattttatttttttttgcctttggtcctctccctctgaaaatccatagtttcatcctgttacccagatttgttgccttcctgttatgcttatgtgtgaaatgataattgcagtgtgggttgggcgatgcatttcgatgtggtacttgcccatacagaggtctaccagcattcaagccgggcgagaaggtaattatctctcctgaccctaaattcttgattcatgagaacaccaagatgccagttgaacttgtttttaagaaacaactcactgttctctgattggcagattgccctgcctggcaacttccttgcggctgacttgtgatgatagaaaggaacatcggcgacagcagcagataggaattggcttctttaattcgttcgtttgttaggatgttaagttgctggtcaagtatgggtgtgagtatggatagaagaggaccatttgctgtagtccctgctagttattaccactttctggttcccaggtttcatgtgtgagtgtgactcgcctatatgcgtcctgtttgaggatatctgtactaataactgagaaagtaccgcactgttgtttcattgtggaactgtcaaatctcaaatcgcacgtcgctgctcgctgctctctgttgatcttgcgaagtgatttttattttatatactctgatgtaaagtgaaacaagatacattctacccccgtgtaaaatgcaatttattctaatcagaatttaaattttaagttgattttaacttttcattgtgatttatatattcagcattgactcttaaatcgctaaaaacaaacgtaaaaacatcttcgtacattattttgttatagcatgcgaaacgatgcgactaaattctcttggtacgcaaatccaaacggatagataccctgatgacacgattagttttctgcacgtttggaacaaacacaaatggatggtctttgacgtgcccgtgcaaattccgctaccactagcatctatgcttaaagaaaaacaccaaaataattagggaataccagcgtattaataagcatcttcttctacttctactccgtggtatctgttgcacgccacggcaccacaaaaccaacagacacaccaacccgtcgcccaccgcggtcactgactggtggggccagggtaaccatcccaccaactaaactccctcttcctttcctcgcgagccagccgattcggccgcgattcgccgtctccatctcgtctcccgcttcctccccgcgtccgccacgccaccccccacctcgccgcctcgccgtggctgctcctcccctcccctcccctccccgccgccggtgctccggccttcgctgccgccgtgctttctctatctatcctcttcccccacgcggacgggggtgcggcgattcgggctctccgccggacacgcgtcgcttcggcctcaactgaagagccacgcttcggtctcgactctcgaacccccaaggtattcctctcccccaagccttccttcgccgcaccgcctgcgtggagtaaaactgcagagatccatctggaattgggctgtgtcttttgttggtgatggactctcttagcttgcttgattgggttgtgttcggagttttgttctagtctgtttcacttttgctgtggctaatctaatccgcatatttctttctctgcaatgaatgaataaatgtaataattggcccatccagtttgttgcgttgcagaagattcgtttgatgcgtgctgaagtacaatcgtgaaaggaaggaactgtgccaacaccacctgattggtactcctgtcgttcttggacaggagattgattttgcttcggtaggagacccaattgcggatggaatatgcacacgtgcgttgttaggtaatgacgagcttgcctgataggggtgtatcatcgtcttcatctgatccgttgtgcgagggtaacattgcaccttgttcttctagctcggaacagaaggaggattgtagcctgaaacaatcgaaaacctcgatcctgtcctgcgttttcaattcacctttcaatatctttgaggcgcaccaggattcgtccgcaaacaagtcgccgaaatcgtcctctggatcctatgattggtcgagggtattgaggaggatcgtgtgctctggctcaatgtggcgttttctgggcacctccaaggttctcacttcaagtgatgtgtggttccttggtaaatgttacaagctttcgtcggaggagtcgtctagtgactcagattccgaaagtgggcatgccacatttcttgaggacttctcgtcaaggatatggatcacttatcgcagaggtaggtttgtttacacgaccatatgcctggtacagcatgttaatgtgtggaaatcagttgtgagttgtttgcactgtctttttgttgcaggctttgatgccatctctgattccaagtatactagtgatgtgaactggggctgcatggtcagaagcagccagatgctggttgctcaggtgcttgtcgactttatttgattgaaataacagcattttttttaccactgcatttgtaaaatgtacttggatggatttttgcaggcattgattttccaccatcttggcagatcttggagaaggcccttggagaaggtgagatacatgactacctgctgatcttaagacaatgaaaattttcttttttcagttgtagtaggtgatgggcctcttttacaatgatcaaatgttcatatgcagccatataacccagaatatatagggatcttacacatgtttggtgattctgaagcttgtgctttctcaattcacaatttacttcaagctggaaatagttatggtctggctgctggatcatgggtgggtccatacgccatgtgtcgggcatggcaaacccttgtccgcaccaatagggagcaacatgaagttgttgatgggaatgaaagtttccctatggctctttatgtggtatccggtgatgaagatggtgaaagaggtggagctccagttgtttgtattgatgttgctgctcagctttgctgtgatttcaacaaaggtcaatcaacttggtcaccgattcttttgctggtccctctggttcttggtcttgacaaaattaatccaaggtaagcagcaagctattaaatctcattctttgtaggcttcatatggtcacccttgaacggttgatgtttctactgatggttgtttctagtattaatcacttcctgccattgcccttactatcaggtacattcctttactaaaggagacgttcacatttcctcagagcttggggattttgggtggaaagcctggaacatcaacctacattgctggggtacaggatgacagggcgctctacctagatccccatgaagttcagatggtaaaactgcattatttacttagcatatatgagcgccaattttatagatgtgtttttctatctgcaatctggtcaataagtaaaactttcatatgtagtaggttgtaatttagaatcttgatttcatcaatgtgataagtaattcatgcctttttaatggtgccctgtcctcccattcacaacaatggcaacacaaaaaaacagcaaagcggtatattagtgttcgcctttgtctattatgcatgcagtcagcgaccgttattatctggctatttttgcagtatccctttttgcttggaatccattttggttagtaaccttgtagaagtagatggattttgtatttatcaatgtaatgactagggagctatttttgtttttcatttttgagctatggtagttacagtggggtgttctctacatctcaggcagttgatattgcagctgataacatagaggcagacacttcttcataccactgcaggtatgttcgcaattgcagttatgatttggtaaatggtacctaatattcgttatccttttaatttttcaataatgaaaaaacttattatctagctgcactttgacagcactgtacgagatttggccctagacctgatagatccgtcattggctattggtttttactgccgtgataaaggtgaactgtgattgtcgaacaaatgtcgcgtcatcattttaagttcactctaatcttggttttcttatttactgtctgcctgcttatgtagatgacttcgatgatttctgttctcgcgccactgagctagtagataaagccaatggagcaccactcttcactgttgtgcagtcggttcaaccgtcaaaacaaatgtacaatcaggacgatgtgttgggcatctcaggggatggcaacatcaatgtcgaggacctcgatgcctcaggtgaaacaggagaggaggaatggcagattctttagtgaaggaacaaaactgacctcatgaggtacagaaaacgttgcgtccaacacgtcggtcgaatgcccttgtttatgtgtgggtgaatagaaatgactcgttgtgttgtctacagaacaagctggcactgtctcgataccccagggggttgggtcttgggagaatcagctttaggtgctaccgatgtaaaaatgtgatcagttcatcgctcattcgttggaaatctccttgtatcatacatgctcttgtggttggctataactcaaaatttattatacgttctgttaccatgttacagcgtcgtgatttggctttacctgacgaatgcgtgtggtgtagggctgctaaatatgctatgtttgcagtggcaacagttcattgttctcacttctctctctccctctctcttttgtgctctgtttcttttgttcaacagagttcgtgtggtgtagggctgaaataagcatcgttcagcacatttagaccacttaatttgaagcttcaccgatctccaatttgtctcaaaagtgtttgtgaggaaagggacaaaagctaacgagcaagaacaaaaagcgcagacaaatcgaccaaagacacctacaactcaaagccaaagaaaagaatccctttcatctacaacacaaaggaaccctacgaactgtccagaaaacataagcgatactgaagtcatatgatcctaggctttaacatctcctctccccagaaagaatcacgatacagattactctgtcatcacgcaacaacctaagctcccatcctttaagaattgcgtgctgcattgcattgccactatctcacaaatcaagactcactcttgtcagtgacagtaattaacaagctagagcaaagcacacacaagcttccaaacatgcttggtgtcctcctctcagttgctctactctcgatttccattgtcaaaggtaaggtcactaatcactatgcaaatttgagccagtgtgtgaatcagtgtgacgtgacacatgacgtaagcactggttcgtcttcttggaataggcacggatgccggcggcgtcggcgtcacctacggcatgcgggggacgaccatgccgccgccggccgacgtcgcgcggttcctctcccgcgacaccatcttcgaccgcgtccggctgctggacgccgacccgcgcgcgctgcgggccttcgccggcaccggcctcgccgtggacgtcaccgtccccaacgccgacgttccgcgcctcgccgccagccgcgcgtccgcgcggcggtgggtgcgcgccagcgtcgcgccgtacgcggaggccaccaacgtctcgcgggtcctcgtcggcgacgaggtgatctcgcaggccaaccggacgctgctgctcagcctcgtgccggccatgcggaacctgcacgcggcgctggccgccgtgctgccgccgtcgccgcgccgccgcgagatcatcaaggtgtcgacgccgcattccctcggcatcctggcc

SEQ ID NO: 56020 - DNA, 8654 bp, Oryza sativa
acccgttttacggcgggctcaccaacgacaccctcgacaacgtgctgttccgggtgaacgacggcgtcacggacaacgccacggcctgctctacgccaacatgctcgacgcgcagctcgacgccgtccactccgcgatgcggcggctcgggttcggcgacgtcgacgtcgtggtgtccgggaccgggtggccgtccgccggcgagtactgggaggtcggcgccggcgccgacctcgccagggactacaacaagaacgccatccgccacctcggctccggcgtgggcacgccgctcatgccgaaccgcaccttcgagctctccatcttctccctgtttgacgagaacctcaagcccggcccggtgtccgagcgcaactttggcctctaccacgccgacatgacgccggtctacgacgccggcatcctcaccgccccgcaggagatcgtcgggacgaaggtcacgccggcgccggcgccggcgctggcgccggcggaggatgggcggcggcggtggtgcgtgccgaagccggcggcggacgaggtggcgctccaggtgaacatcgacttcgtgtgcggacaaggtggcatcgactgtggcgcgatccgggcggggggttcgtgctacgatcccaacaacgtgcaggcgcacgcagcattcgcgatgaatctttactttcaatccaacggccagcatgagtttgactgtgacttcggccagaccggcgttatcacaaccgtcgatcctagtaagtactatcccaagacgttttgacctttttcctaaaatttataaaaaaatctagcaatatctacgacatcaaattagttttattaagtctaacattgaatatatctcgataatatgtttatttttattgaaaaactattttttttataaacatgatcaaacttaaaaatgtttgactagaagaaatgtcaaagtgacttataatataaaatggatggagtatattaatttatcttctacttaataacaataatagtgtagtttcattaattaagtttaaatgtccttttttttatttattactagtggtacatgatttttttttctcttgacaggttataagagctgcaaatttacatgaagcaagaggtggctatttggataatacttggctaaaaatggacttatgatgaaattattataggctatggttaacttgcgttgaattttgtggagtgaggtcgtctgttcgtgctgccgatccaaacatacaaaaaagctatggatccataaatgctaataggattttgcaaagatatttgttcatgttgaaccaaacaaaagttaaaaataaacaggttatatatctgtatcaataaatatatggaagctcaagatgtttcatctaccagctgaatgactgtgcactgcaacggaaaattgaataagagaaccacgccatacactctaaagtttcaaaaattaaaataaaactaccgtcgttataatttcttagggtcacattatatttgccatcatttccacctcacttcaaaagactttttttctatttgatgtaaggttgggaaagtaacaaaaatccatctacctcaatgttttaggattcaccactcatcaccatctttaaggtttacgttgaaaattaaaaaaaacaccaaaatatattcactcgtgtgtgatctcaagtggaagtgattagtgatccagttcttttggcagatatttgttggatctttctaatttcaaccatgacgagagcccatgattaggcgtccaattaccaaattctaagcccacaattgggaatatttttaccaaaatttctataaacgaaaagcgcaaggggccctcgacaaaatatcacccaagtcctcttctctcttctcttctccgccgccgcctccatccgcggcgcatcccatctcgccccggcgactcgtcggcgtcggcgtcggccatgggcggcgactggcaggagcttgcccaggcggcggtaatcggcctcctcttcgccttcctcgtcgccaagctcatctccacggtcatcgccttcaaggaggacaacctccgaatcacccgctccacgccgacctccccctccgccgcggacacccccgccgccccggccccacctccggcctccctcgacggcggccatggggacaccagcgacggcagcggcagcgacagcgacagcgactgggagggcgtggagagcacggagctcgacgaggagttcagcgccgcctccgcgttcgtcgccgcctccgctgcgtctggcacgagcgtccccgagcaagcccagcttcagctctatgggctctacaagatcgccaccgaggggccctgcaccgcgccgcagccgtccgccctcaagctcaaggcccgcgccaagtggtagattcgatccccctgcctccctgatcttttttctcttctggatttagttcaagcatctgttagagtcgggctccgcttaacccccactgtttcagttcgagggtttagggaaatggatcgaaatttatcgttatctaagtttaggttcagttactgctagaattgctgatcacgaaatctggtggtaggttttttgtgctttgcactgaccagaggagactcataaattcctgtgtgttaatcttgtagctatgattcttgttagaaacttaactcattgttattgcctctaggtttacaggtttggttcattggaagtgaaatctcctggtagctcgatgatctcacaaatagtagcattcctcagtcagatgctgcaattcaacttacttttgcattatgttgtttgatttattgtttcctgacttcctttggtggttttgaatttacccttttgaatttggcactggagtctgaattaagatatctactgtttgcagctaacttttattaacatcatactgtttgtcttttgcgctgtctatctctgtcaattttaaagacttaatctagtttacaagtatcctaattttcatatggtgtcaatatccaaggaatgcttggcataaattgggtgctatgccgacagaagaagctatgcagaagtacatcacagttgtggatgagctattccctaactggagcatgggttcgagcacggtaattctcttatgtcctcttgtactgttcgtattttgctacttgggatcccatcactgtattggcttattttatagtctgctttacatgattcctgaaaaaaaaaacaccgctcaatttgtgctagttgggatcccatcactatattggcttatttgataatctgatttacatgatttcagaaaaggaaagatgaagataccacagtatctgcttcaagttcgaagggaccaatgggacctgtatttagcagtttaatgtatgaggaggaagatcagggaaatgactcgtaagttttcgacacgaagtatatcctgtacctttggtcttattattatgtgttaaaacggccttgattcaagttcagttaggtttgtatttgggcatcgtctcttatggctgataaatcatagcaaataacaatgacatgattaattatttcatgaagtatgcaactaattatctccatgttggtgctattaagcattatttattcagtcatctagttacatgacagtgtttccatgattgcaacaaacttatctgtaactgcagtgaacttggcgatatccatgtttcagcaagggaaggagcaattgatgacatagcgaagcatctggctgctggtgtagaagtcaacatgagaggtttgtgttctgaactgttcaccattatgttctctttgtagcttaggcttagcatagctcatctaagcatagtttcatttatgatggtttcagatagtgaaggcagaactccactgcattgggctgtcgaccgtggccatctaaattctgttgagattcttgtcaatgcaaatgctgacgtgaatgctcaggtacttgactctacctttaatgcttcactcagtgcattctagtagaattcacgcgctgataaagttggtgagtatgtaattggagcaagaagctggtaatatatcttggcgtggcattttcattgggattacattatgtactacattgaataaaaagttgctattcattgtggccatataatagtgtcaataaatatgagattgccacggctaggtactactagtggatatatattggtttgataggcactgcttccctgaaaaagtctaaacattataatgagatcaatgagcaacactgtccatgtcccttttatattcaggacaatgaaggacaaacagcgcttcactatgctgtcctctgtgagcgagaagatattgctgagttgcttgtcaagcatcatgctgatgttcaaatcaaggatgaggatgggaacacggtgcgggagttatgcccttcaagctggtcttttatgaacctggcaaactgacgacacgatgccctctgcactcttttggttgcctaccagcaagaaaccgcactgtctatgttagccaaactagatgagttgttttacgaacctcatcgaataggtcactgtcaaaaggatatttctgtattagtgaaaggagattatcttgtactgcctatacagtttacactgctagtttgtttgtgctgaacatcaatgttggccaggtctgtaaatcatgggcacctaatttctgaatgagcatgatcggacttctcttcttttgaccctgttcctcactatttcttaatgagcctcgtcaggcatttgcacccccactgttcctactatgtaaatattgaatatatcaaatgtaccttgtaaactctttgtagcaaactgatccatcttaccggaatccctttgtgaaaacaaaatataataaagtatgcttaatgaagaggtatatctagaatgaagattgcaagtagtccgctgattctcatcgcctagtgatgcggtagctagtagttatcaattacattcgtgggaacgagtcttcgttactgtctagctcgccgaagagaagagcgaagcttgaggttgctacagataagatttaccaggcagcttgctccagagggcgattgtccactgttttgccaatccactgttgatcatttccttcaacaattctaggatgggagtagttaattcccttccatagaatgtaaaaatgcatttcattgacagaaaatataatacctggacatgacggcaggctttgcagggcaaactacataaggatgaccgcaatctacatatacaatttggacacttggactctggaatattctggttttggtaaccaatgcacacagagatgtaccatgtgtgcattggtgaaggaacaatgcaatgctttatgtcatttgacgaggaagactctggacagttttggattgctaccaaaatttgctctaccaatattttcgtagtctaaatagtacccaccgtttgtttgtttggattgatgccaactttttggtaatgcctataccaaatttggtggcaatctagaactttcttcactatagtatcacaacttggctatattttgatagcaaactaaataagatgaataccaaatttattctaccaaataattggtagtgccaaaacttgcctatgttttggcactacaaaaaattggtaaggcattgatccaaacaagccctctgatatcatgtaacaacggcttaaggacggtaaagccaaattgatccaagaaatgagaaccggtggattccaaaacaactgaagaaatagaacatacatatgattacaaaacaaggttacggcagaagtagtgaaacatcgagattggggatatcaatcaactactagtaagaatactactccctccatctatttttgatcatcatattttagcttgacacacagactaagaaagataagcccaggctcttatcagctatccaaggcctgcatggctcggcccacaattaaagctgggtgcatgcgagcgtgacgcttcggctccgcaaaatccttcgcctaaccgttcggattagcagcgctcgcgatcgcgcgaaataattttttgccacgccaatttttcgctcgcctactcgcgatcgctcgctgaaaacggatggggttatgcccgggcaaaattcaaaaattgaacttcacaggttcaatggccctatataagcagcgatttgacgacggcatgcaccaacgagttcagttttcaaatcttctcctccttgcctctaccacacacaaagctgtagatgatcaatggcggcggcacaattgttagacctcaatcttgagcctcccatagattgggatgccattggcgattggattgggccggctcatgaccttgattatgacatggtgtgggctgatgcagatgaaggtacttatctatgtgccattgtttttggtttaggaacctaataacctatagtttgattttgaatcagtttgctatcgtagatgctgatgctgccggaggcgaaggagatgctgccgccggagacggaggtgctgccgccggagacggaggtactgccgcccaagatggaggcgaaggagatgccgctgccggagatggaggtactgccaccagatagcttttgtttttagtttctgtttttgcctagctctctgcctacatgatctgttcagcgcttatagttcaatgagtatagttttatcattgcaaaacatctgttcgccgactcctgtaggttagaaaacatcttgtctgcaaaaatctgaaaacagtatgtatttagcttaccacggtcatatatacccttcaatcatgaatttagcttcaatcatgaaattaaacaaccctatccttcaatcatgaatttagcttccacctaccacagacatatatatcatgtcaagtctttatgaattacttctagtaccaacctgaaaatattagcaacagagttacagactcaatatttgtatggattgcatatgttttcagaattaaactgttttttttcagtatttgtatggattgctacactaccgtattcccaatttcactattgatttttctttgtcatttgcaggtgggactgtgaaaaagagaaggttctatccggatgacttgaagatcgccatatatctgaaattgctagcatgcacacatcctcctgtgatgcaccatggagtctccaaggcagttgcactgcagtttgatgtgccagttagagttgtgcagagggtgtggcgggaaggacagaatggtgggatagaaggtgtgaaaaataagcttaactttaattgtggtcgcaaaagaatagagatagaccctgaagctatcaaagccgttcctttggcacaacgcacaaccttccaggatcttgcaaatgcactaggactaatcagcagcaaattaaatattgtgaaccagtgattttaatacaggcataaaacacatgtatcgattcatcgattgcaaaagtagcaattaataccagtagcaaggtacatatacaggaataatcaccggttgcaaataacataggagatgatattgatgatgattacaccatatatagtcattgatgagcagatcagcacacatttgacctaggttagggtagctggatcttcgtcgtcatcgtcatcggtgacctcctcctcgtcctctgcgtagccctgtgtggcgtactggtcgatgagggtctgctcgtagttcatcttcttttcatcgatgaacttcctgaggatgtagatttggcgatgtggcacagcaagttcggccagctcctcctgagagcgattgtgatcaacgcacttgtagggctgcgtgatcatcacttcgacgaggctattcggcaccctgcacttgaacaccttcctcttcttcttcgcagccgcggcctccgccttcgccttttgcctctccagccacagctccagcatctccgccgggacctcgatcgaatcccagacatcgctcgcccccgggacatccggcgtgcgccacagcatgctggccgccaccgcctccttcttcctcctcaggacctcgcccccctcgcacgggatcgcattggccctccacttcgggaggatcttcttcttcgccttcttcccggccggctccgagtccgacgaagcgctcgcctccttcctcttcaccccggccgccccgacctccgcacgctcaccgtccctcatcgccgcccgcgatcgacacggtctctgtggattcccaagattttcggcggctgaaaccctacacacggaaggaacagaaggagaaaattaagaggaacatataaaagaaggggttgtctatatatcttgtgacagaaaatcccacctcctatcatttaaattttggaccattagatatgttttaagattcgtgcaaaccccctaaccctaactcctctccttccccgttcagatcgctgccaccactcctcccgtcctcacgccatcgtgcgattcccaaccaccaccgccccaccgtgccgccgcctgccttgccggctggaaagaatcaactgcgtcggcgagccccctcccccctctctttctcctcatggcggcgatggcgaggtgcccccgccccctccatcttccccgtctctggcggcccctcgccgccggatctgcaaccaccgcccgccgcctcctaaccgcactcttgctttgcccc

SEQ ID NO: 56021 - DNA, 25378 bp, Oryza sativa
  unsure (1)..(25378): unsure at all n locations
cccctcccccaacccctcctcctaccctcaccccaaccttaaaccctaacccgggtgtcgccagcgccggagttggaggggagaaggtggagcacaaatcttggcatggatccaatggtccaaaatctgtaagatttcatccccatatttcagtcgaatgacatatagcaatcccaataaaagatagcgaggatgaaggaaccaaatatggccaggcctaaccataagcacaacccgtttatccgatccggcccctttttttgttttacataaaacaagtcaattttttactccctcgactattggccgagtctaacccatatatctcaaccgtaaaaccgggttatatctcgcgtctcctaagtattaaaaccgtgcaaaacaattcactcgactgtttcaactaatgtagcgtattgaccctgatcaaaccggctaatctagggcacctagaactagagaaaaaaaattggaacttccacacctaagaggcggttgcatcttgcatgtatatctcatgaaggttcctttttcctttttttatggtgtaagataagtccattgttcatgtggatggaccaatgtatgtgaaattcatatagttaagagctagggagattaaatgtatgggattatataaaaaatagtttaatttttaatgattaattctaaaatatgtatgaaatggaatatttgcgatattcctatttgaaaagaataatatgaaaaatatataattctcaactatatactccctccattccaaaatataagacacaaccacccttaacccaaatactaaaaaataattattatcatcttgtagtttgaatcatcctaataaatataacccatgcatccaataggattagataacatgagagtagaggatttaaaaataataataatttaatggagaagatgtcatagttaattgcatgcttgcatgcatgcgttatattgtagaacatctaagaaaagtggttgtgccttatattatggaatggaaggagtatgttataattataaattgagcgatttgtaccgtgggatcactctcccaaaataaaaaaaaacttagggtcattaaggctgtgttcttaggtggtgtttggatccagagacttaactttctctgtatttagacactaatttagagtattaaatatagactacttacaaaactaattacataaataaaaactaattcacgagataatttttttaagcttaattaatctataattagagaatgtgtactgtagcatcacataggctaatcatggattaattaggctcaatagattcgtctcgcgaattagtccaagattatggatgggttttattaatagtctacgtttaatatttataattagtgtccaaacatccgatgtgatagggacttaaaagttttagtcccatctaaacagggtcttatctcccctttcccaactcacctccctcgttttatgtgcgcacgcttttcaaactaacagtgcgtttttttgcaaaaaaaatctatataaaagttactttaaaaaatcatattaatctattttttaaatttattttagctaatatttaattaatcatgcgctaggttccccatcagagcctaagtaaatacatctgtatgcaagttttaagtggagcaccatataagataggagatgatactgatgatgattacaccatagccattgatgagcagatcagcagacatttgacctaggttagggtagctggatcttcgtcgtcaatcgtcatcgtcatcggtgacctcctcctcgtcctccgcatagccctgcttgacgtaccggtcgatgagggtctgctcgtacttcatcttcttttcatcgatgaacttcctgaggatgtagccctggcgatgtgacacagtaagttcggccagctcctcctgagagcgatcgtgatcaacgcacttgtagggccgcgcgatcatcacttcgacgaggctattcggcaccctgcacttgaacaccttcctcttcttcttcttcgcagccgcggcctccgcattcgccttttgcctctccagccacagctccagcatctctgccgggacttcgatcggatcccagagatggctccccatcgcccccgggatatccggcgtgctccacagcttgccggccgccaccgcctccttcttcctcctcaggacctcgcccccctcgcatgggatcgcattggccctccacgccgggaggatcttctccttcttcgtcttcttcccggacgcagcggccggctccgagtccgacgacgcgctcacctccttcctcttcttcccggccgccccgacctccgcacgctcgccgtccctcatcgccgcccgcgatcgacacctctcgaacactctccaaaccctacgtctctggattatcggcggctgaaaccctacacatggaaaaggaaggagaaaagccgtaaccaaatacggccaggcctaagtaccataagtccaactcgtttacccgatccggcctttttttattttacatgaacagaaagtcctttttgactccctcaactatcagctgaatctaacccgtatatctcaaccgcaaaaccggttatatctcgcgtcccctaagtattaaaaccagtacaaaacaacttactcagtgcttcgattgacgtgatgcattgacgctgaccaaaccggctagtctagggcacatagaactagagaaaacaaaagtaaatgttccacgcctaaaaggcgattgcatgtatacctcctcatgaaggttaccatgaaggagaggcattctttggtaaccatctacgtgatagtccaaggtcgagaagatgccataatgattgaagtacacactatagtcatattagcaacatgagcaaaatgtcttattagtatgatccacgaaatacacccacaggattggttgattcatttgaccagaatggacaacccatcggctttgagcaggtaaccaaatccagccatattgttaactagaaaataggttcgtcggtcagcgctccaattaatatagcatgcggtggtattgttggttttgttcgatatatataaattgaccatttttattccttctttttcttgagagattgaataccttactctatacaagcagaagcaaataggctgataaaaaaagaaatgaaattattggaatgaaatttatttctggaacacatggcaattgtatcaactggaaatcatttagttagacatattccacaaaatcaagttaaagtaagtggtgtaagataagtcaatttgttcacatggatggaccaatgtacgtgaaattcaaatactaaaagctagggaggttaaatgtatggggttatatacaaaattagtttaatttttaatgattaattctaaaagatgtgtggaatggaatatttgcgatattcctatttgaaaaaataacatggaaatgtataattctcaacaatatatgttgtaaattggcaataaatcctaagcgatttctacaactggatcactctcccaaataaaaaaattagggtctttaagtaaatgtctctatatgtaagttttaagtggaccagcatatatgggctacatcctccttttgatcccacctgatcggaatgttctaatgttatacatgttgtgatgttaagttactattttttttaagaactagattaaggtactgcttgcttttagaattgtcatagaaaacttatgccattttctatcttttgattttttttttctttgatgaaatctaggattaatttgataacttatgggtgccacgtggcccaatcaaaagctagtttaaccgtcagctttagattagtagatctcgctcttagtttactctattgaccatggttaatgaatcgagtctcactccggtgccttctacctagagtagaaaaaaatctgaaccgttgatcttatttgatccaatggttcagatctatttctactaccaccacacttagtggtagtagaatcgtggaggggtacttttatccaggaaaaattatctgcggagggatattttcgtccttccggaatcgcgcatctggagccgatgcggagagaaccccgcggctcccatcaccaccttgacgacctcgcctgctccaccgccctcgacgcctcctactccctcgcctccgtcgcactggctgcctcagccgccctcgacgagctcgcatctccgtctgggatcgccagagctgcgccctctctgccgctcccccgcgtcggcccaccttccgacgagttcgcctcccggatctccgcctccgacccagcaccgtgccactggccgccgccgagacctcgtccacctcgctatccccttcctcgtcgtcggcctcctcccccacgctcggctccagccctgtccatctccacccgccgttgatcccacagccgcgagggcgagcccccaatccatcgcctcccaagcggaacccgcaacctccggagccaatgaccaccaatctctcgacctccgaatcatcatccaagactcctctcgctggctatagcgctgctctccaacggattagctgacatgagaagactctttttctgctttgcaggtcagatttgatttgtttttcttgctgcttgtaggtttgcagctcgaacatctgcactgaatcttctttttcgttggcctctagttctcgaatagtttttctgcttgtctactcaagttctgtagttcttggtcataatttttcctcctagaagaagggattcaagttgaatgccagtaaactgaatccggagcaagtgagcttgttcagaatggctgagcatgacaaggtggacaagctaatgatcactacgtcaatgaacgcttgagagattcctggtgtgctatgtcctgtaattcctatgaattcattatctcaagatggctttgggtggctttggcttgttactgatggccatgttttttttttcaaaactatagcttattaacagcttgtggttttgaaagtgcctatctgtgtatatcatcgtttttgtacgtggttcaatgtatattacttgttgtaattgcaattgtaaagtctacgtaaaaaaacataccggattattcttccgttgccttgtatctgtcattgctggattggagtgtttcgatttgtccatcgtgtgtaatattcagatatataactaatatatttaaattttacatgaaacaatcaagctgaatggaaaccaaatacctacagcaagaaacatctatggaacgcgatgcacaagcgccggcggtggccggacctcgcgatctgcttttctttttctttccctgcgctctcctttttgatggagagcgactctgctgttcgatggagagggatcgagcgacgcttgaccataggacgcacaaatgagaaaaaaattaagtgccagatttacccctattcggttttagcactttactaatttaccctttaaaataaacggtcgagattaattctacttggagtagaatactgcaagtagagggcaccggagcgtctctctaatgaatcagttttcaccaaatcgtttcatccatcatctttttagcatatgtgggttactatagcacttatggctaattatagactaattaggttcaaaagattcgtcttgttatttctcttctaactgtacaattagtttttctttttatttatatttaatacttcatgtatgtgtcaaaagattcaacgtgatgcctttatagaaattttggaaaaggtaaacttggaaaaggttcctgatctccttttcacgcagccgcatcagcaaaaagccaaaaaaaacaaaaagctagctgctcaccctgacaagcccatcactcgaccagccccgccagcttgagctcgctcacttctgctcccaagctacagatcgctcgctgtctcgctcaagcgcgacctaccacagcatcggatcgaagcgagcggcggcggaatgggagggccgctcggcgccatcataggcaggcacccggcggcggcgggcggcggcggggaggatgagctgggaggtggcggcggcggcggagatggaggcggcatcattcggcacaaccggcggtgccgggatttggccttcctggtgctcttcgcggccttctgggtcgccatgatcgtcaactctagcttcggattcaaccagggcaatccactcaggtgaggtgacccgcctttacccctcctctcctcaagattcgccgatctgtgctgtcggtgctgcttgatttcggtttcctgtagctagatgctaagagcgttcatccggggagcttttcctttgctgggtggtgattagtgccgctgtacattttgagctgttctttagacagcaataattaccaagaacggagctatttcaggtgtttagtgcataccttcacattcttgttggctcattcttcttcaccttgacgtgttactttcagactttcagtctaattgaactgacatagagagagaaaatgagggtgccagttgctagtatggaacattcttgaggtcattaaagactttagtaacagatcttgcttatttcggaatgaaacttctagctcccggctttgttatgtgtactgtgaatcgaataatcttttcttgctttgtgtcaacctcccaacaggataggtaaagaagcccacttttgctttgcagggagaaaatgtgcctttagtggttactcctatgggcgacgctccggtgctttctacttgtagtatatactacaactagaaataatccaaaccgttgatttccaagggcatattagtactttgttagtactacgattaggggtaaacttggtattaggaaaatattcgtgatttttattacgtttcaatcttgtatcgcatcgatccttcgctgactttagcactattgccgttgttgccctattccggtagatctcagccagcgttcatcactgtcgcaacgctctgcttcgctaatgtctgcaggcaatttgtttggtaaatttctcacatggtaaatccttctggtattttggtgtgactccttgatggtattttcgtgaacgaaaatcttctagacttttttctaaaaaccatctggcgttagcaacactcaaaacattaccattatcctgttcaaaattggaccgtgtgtagtacactaccgataggtgattggggtgacatcgtccaatctcagaaagagctgcttttttactgatcaactgttttgtggaaccattgacatttacacatgcacacagagcaacagtatagatagcacttgcactcattcaccgaacatgacgtcacaagggcaccagaacatgtaagcatagttgagatcagataaaaacttgatttctaaaactatacaattcaaggtcctaggttttcctatgtgcaaaattacaaccttatcccagtttcgagccaacatcaaagaagtcagagaggcattggaccaataaacatgtaagcacagttgaggtcacataaaaacatgacttttaaaatactccttgagcctcgcattggcatctggttattctcctttcttctctagtctctgataagatcagaaacagcttcgagcctccctcaagaaactaaacaaataggagtgcttcacagcactaattgtaagataagatagaaaatattatgagcaactaatgttagtcaggccacagataaattagtagctgtttacccgaaagttgatccggagatgtgttgcagaggcatcggagttataggatatcatcctgtatccaatctattatattattaaaacagccttgaaaggaggcaccacgttcgttgtgggggctagaaattctcacattaatcaaagaaaaagaaaagaaaagtccaagtagaaatacaatttaaaaatagctgaaattcggaattaaaaataagcaatattaaaagaatagtccatataagaacccaatacgagattaattaaaattcagaataaaaataaaataatatcaaaaattataaaaactaaaagagagttcaaataggaatataattttgaaacaacttaaattcaaaaaaaaaatattaaaattacactatatgatattaattaaaatttgaaaaaaaataaattctgaaattagaaaaataaaaaagatttcaattaggaataaaatttgtaaataactaaaattggtgataaaaagaaagactattgaaagaaaagaccgtctaaaacacatgacgagataaattaaataaaaatttgaaaaaaaatataaattctgaaattataaaaagaaaaaaagatttcaattaggaatacaatttgtaaataactaaaaatgatgatataaaataaaaactattgaaagaaaagaccgtctaaaacacctgaagagataaattaagtaacatgcctataaaggagtacattggtggacggttaatacgacatataaaaactgttaataaaacaccaaatagaatcctaatgacgattaaaaggagggacgacaggcaagccgtgaagcaaacaggcaaggcggttgccgggacaaaaaaaataaaccccattgataatcatattcgatttttaaaatctcaatgtcaataaaaaggagaagcagcgggcggggtgcataggagtagagttgcagagccgccgacggttggcgggacttctagaaaataaaaaatgaattccaacgatagttatgctcgatttttagaatcccaatgacaataaagagtaggcgacagatgggtcgtagaggagtatagtggcatcgtttgactggacttctaaaaattataaaaaataaaacctaacaagacaataaactctaaaatctacaaggttcaatttttaaaggttcggaacttctaaaaagtaaaaaaaaaacccaatgacaataaagaagggaggcaacgggtgagccattaaggagtacagtggcaaagccgctaatggtttggtgggacttctagaaagtaaaaaattgaacccgaacgatagctatgttcgattttgaaaatcccaatgataataaagagaaaagacagtgcacgggctgtagagaagtataatggcagtgtttgacggaacttctagaaattataaaaacgaaacccaacgagacaataaactctaaaaactataagatctaatttttaaaggtttcaaggagaatgaatagaaatagcggtagatcgagcaagcaaataaaaaaggatatgacagaagtaaggagtagcagctggtgtgacttttaaaaactatataattagaaatacggggatgatagctatttagtttagtctttcaaagtcttaagacaacgagatagctatttaataaattttaagtaaaattatactaaaaaatatacgattttgtttgggtgctagccgcgcaattgcgcgggccacccagctagtttcaataataacatgagtaaactcaactccaaacaacatgcacggtgcaggaaatggatgccaaataagaggcaacaatgctgtgaggcttgccagcaacacgagggagtggacttcatcagggtactcaacagaacacatttgttagctgtaatggaattactataaatttttcaatatactagttcacaattcagttgtgagttgtaggatactagtattttctggtagcatacaaacatgcacagttgttgcctcctcctttatgcattgtactattgtagttcttttaaagcctcaagatttctgtcatgcattatccaaatatatgtactgaacctactactaacagcctgaacgaattattttcgtttttcaaggtctttttcccgaagagaaaacagctgatcagtacattactaaccaatgctaaattgatagttccgtaaaagaacaagcattcatctaatcagtcatacaaaacccgactacagaattcagtttttacattcaactacaccattcgaatagagcaatcaaagatcagtaactgatctgcatgggagtaaatggaaggacaggacgttacctcttatgtgatgatgagcactgcatttgtgatcgatgatcacagtttcatacataagagactggatttttaatgaacagtaggtacagaaggtagcatcactgttatgttctggtagaagaacacacctcataacagatggaacagttgttcttcatggagttctcgatgctgcagtgcttgtcgttgcgcaggctgaccgagtagcatgatacagtgtgtcaacagataaaagtggaatcgagagattcatatcaaaccttctcactagcaaatagtaatagcttgggatttcagtaccgactaccgagagatgtaggggtatactcaccacgtcgccaagcccgcgctatcggtaggctgaggcgtcggaggaggtgagggcggcagaagaggcgagggaggcggaggccgtaagccggtgagggcggaggaatcgtcgagggcggttgaggcggcagacgcggcgaaagaggtgagggcggcggacgaggcgaggacgttggagcaggcaaggtcggctgaggcggtgatggcgggggaagggaggagccacgaggcggggtcgctcggcgtcggcgccggatgcgatttgggacttctcttcgtgcggcggcgtgaggaacgaacgacggaggagagagccctactagggttagtgaatgtaaaagacgattgtacccctccgcaaatattttttcatagacaataataccctccacgattctactaccgttaagtgaggtggtagtaaaaataaatctgaaaccttggattaaatgagatcaacgatccagattactttctactccaagtagaaagcaccggagtgagactgtgtgctccttggaattgtattccctctctctctctcaaaaaaaaaaaaactttcagtgcagctatgcaagatttgtgctccctaaaagaaattcacattacggttatatattatagaaaccaaaactcactactgagtgctgaccaaaggaaatttgtttagggataaaactcagtgctgtgcgacttttacatggctatcattttactattattcagacgctatgatgagtaaccaaactactatttagtaatactgatgtcttatcttgttttgatgacgcaggcttacctatgaactagactacaaagggaacatttgtggcagtaggcatggtgacccggatttgcatgagcttgatgttagatattggatgaacccaaaccaggtgtaccaaagtggggtcaaggacaacaagattaaccttgctgatgccaaagccatctgcctgatggagtgccccattccagcagcagacggattaaactttgtttgtgattatccagaaggggacattcgcctctctatcgatgattggatcaacagggactatgattattttgagtttctcgcaccagatatgagaaatagttctcttcagctgcagggtccatgctaccctgtcatatttccaagtgtgaatggtaatctttgctcagtctgtactacttccatgtgagcatggattaaattaagggctttacttcttcatgcaataagttaaaacgatgagatagctgatccaaaatctttgttcccttcagtctactggagctgccaatttattgcgcgagcatccaatgtctctttgaagcattggcagcagatgggtggtatcaacatcgacgaaaatattctcatagataaaacaatacacaaggccatcaattctaaatcttcagtcttgaaggtttgtaaacttcctggcactgttttattacctgcacattcctttttgctgtcgcaaacatttctgatttacgttggaagtgaaaagtggcccagctattcctatagctaacactgaccgtacattacaccacagcaatactttttatccttacaaaagaattttgttgcaccgttgctctgaaagaagcatattactttcttgcaactaaaatggatatgcattttgaattattctgagaaattcctgatgcaatatcattcatatagcactggagtcccattttgtctttgaagatattaattaccatttcctttgtctgcagagatacgttgctgacattgggaagtcatggcctgtgttaattgtttgcggtggactgctccctcttttcttgtcagttatctggttgcttctgattcgttattttgttgctgccatgccatggataactgtagtgctcttcaatgctctagtaatctccgttactatgtttttttatattaaaggtatggttcaatttttcaaatcataattccaaaatatggcaagggaaattccattgtatgccatttcacatgttgcacacatacgattctaattggctacattttaattcagctggctggttaggcaatgatcccttgacagttgtaattggtgaaagtgatccatatgtgcatataactggacgggtaagtatatcaacttttgtcaacttttttacaatatccagccctgttgtctgattattcattcttttactaggaaataagccaccttcatgctgctacggtggtgatgacagttgtaatgatcattgcatttctgtcctccatagctattatccggcgtatactgatagcaacacctgtcctgaaggtacgcgaatcattggatacaagcttgattagctacactatataagcacctcgcaaaaaaaaaacactatataagcagaagcttggttttgaagacatgcagcatcaatgccattcctcctctttgatggcaagagtatagttaatatatagttcctaagcactaaccatgataattgttatcttcaggttgctgcgaaggtcattggtgaagttcaggcactaattattttcccagttgtgccatactttatcttcgctatcttttatatgttctggttttctgccacactccatctcttcagctctggtcaagttctccgaaatgactgcaatacagattgttgctcatatgatctgaagttgggcaaagtaaactgtgacaactgctgtgggtacagcatccattacacccctcatattggtattgccattcttttccacttatttggctgttactgggcaacccaattctttattgcgtgctcttcaaccgtgattgctggatcagttgcttcatactattgggcacgtggtgaaatatccgtaagtgaattgaggcacttaaaaaatttactctatatttagcagttagtttacttctcctttccactgactatttgagctattcctatgcagcatgacataccatttgttacagttgtttcttcattgaagcggttgttgcgttacagccttggttcagttgctataggttcacttgttgtatctgctgttgagtgggtgcggtttatactagaatgcctcagacgcaagttgaagctatttgattccgctcgtgaaagctgctttggtaaaatgacatcatcctcttctcaatgctgcctgggctgcatagactggaccctcaagtctgtgaatcgaaatgcctatataatggtaagcatacaaaaattcttgttcatggagcaattgctccatgcctgaaaccaattgtctcccctgctttgttttggtgtggatgcaaaatcatctggaaaacatacactatccaagttgatgcttgtattgaattcattaggcttatacccttcttttggtgttgcagatagccattactgggaaagggttcttcaaagcttctgttctcgcaactggtttgatcatgaataacatactgcgcattggaaaagttaacgtcattggagacgtcatcctctttctggggaagctctgtgtgagcttgttctgtgcgctctttgccttccttatgttagacactcacaagtacaagtctgcacataacaagatatcatctcctcttgttcctgtagtggtaagcatttcatcgttctgtcattgcggctcgcaaactgacaaatgccatttccattgctaagacctaaaggtgtctgtatatattctgatgctgctacactgcaggtatcatgggcacttggttttatagtcgccaagcttttcttccaagtcgtcgagatgtcgatcgacaccataatcctctccttctgtcaagattcagaagagcaccaagggaacgcgcagtacgctccccctctcctagtggagacactggatgaacagagtgaactccatagactaactcaagggccttgacttttcttcttcttgcaagtagaattaagtcagaatggagaaattaagtagaagccttgtcattatgttctttgttgctggctagtgggtaatttcaccattttggtagtgcactctgatgctgaaagtctggtctatagcgtgactagtacccctggcctgatctaacgtatgtactcctactatactttgctaatacaatgatagtgaagaaggttatatcttgtctgaatgtctgaatattgttcgcttcaaatttgcttacataattggggctggaacttgaaatttgcttatggccgtgcgatcagaccagtacgctggcaggatgagccttctgttgcaaactgaaaaatgcaatctcagttgttaagacgtataatgtgactgtatcctggatttctcagttgatacccagctgcagctctacggactctacaagatcgccaccgagggaccctgcactgcgccacagccgtccgccctcaagctcaaggcccgcgccaagtggtagattcgatctccctggctccctgatttttttttctggatttagttcaagcatctatcagcgtcaggctttgcccccctgatattgacttgtttgataatctggtttacatgatttcggaaaaagaaagatgaagatagcacaatatctgcttcaagttcgaagggaccgatggggcctgtatttagcagtttaatgtatgaggaggaagatcagggaaatgactcgtaagtttttgaattgaggtataccctgtacctttggtcttatgtattaaaactgccttgattcaagtgcaggtagtattgtatttggacattatctcttatggctgataaatcgtagtagtactagcaaataacaatgacatgattaattatttcatggagtatgctactagttatctccaaattgatgctaataagaattatttattcagtcatctagtcacatcacagtgtttccataattgcaacaaacttatctgtaactgcagagaacttggtgatatccatgtttctgcaagggaaggagtaattgatgacatagcgaagcatctggctgctggtgtagatgtcaacatgagaggtttgtgttctgaactgttcacgattatgttctctttgtagcatagacaacgtcgcaaatgtcaatgttagctgaactagatgttttatgaacctcatcgaatcgaataggtcgttgtcaaaaagatgttggtgtattagtgaaaggagatatatcttgtactgcctatacggtttacactgtttagtttgtttgtgttgaacatcaatgtaggctaaaaaaatgattaccagttctgtaatccatgggcatcctatttctgaatgcacctatcggacttccttatttttgcagatgattgtttctctgtagatattgaaacccttaatagcaaactgatccaccttagtacaagaagtcgacaatcccttgtaatcttctatagaagcatgatgacacagctgaaagctcctccaattgtactgttcaacttcatcttcgtagtttgtgttagggtgttaggatttatttttttacattgaatttagcagcagcggaaaatttgggtgaacgaaatgatttttctaattaatcaatgtgaactagaatttataagttaaatcaatgtaatagatttaactcgaactatattcatattgtacttttgataatatgtatttctgtttattaagactttaaggtcagtatttgcaactctgatgtgggcacacattggaattttcttgggtccaccacctgttgttgccctatcaaaaacatgttatatattccattggaaagtataaacgcacaaatgtcagattacttacgcgtgtagttacccatatgtacacgttcatattgtttgtcataatttacagcttttatcatgataatttgtttgtcatagggaacagtttatatataccgtcttggctaaatttgtcacctaagctcatcgtggatattgttgccaatgtcatcgtagtcatagtgatcatccatgtaaacaatattgtagaaagataggtagtggttcagcatctcttctagtgacaacttgttgtccttgttatcatcagcctatgtcattatcatatttgccaaaaaaaaaggtagtttatagtggttatcaattaaatagtgaaaattgcttactagttatatttggtatggttagttagtcaccttcatcaaaagctttgcatgtgatttagcatatgaaaactctcccgagatgaggctctggattactggacgtgcttcttccactgtcaaatagctgaaaaggggaaaggtggagtaaaaaagggttatcttgcaaatattcactacacaaagtggtgctattttcttctgtttcaagtattacccgtcattgttagaatcgagctctcgaaacttcttctcagcttcagcacaactagtatcatcatcagcactatgctctacaatggagttgtggtcgatcatgtgaaactgactgataaactcatccaaacttaatttcccgtctctatcgtgatccattccactgtattccatgcatccatgcagatgaaaaagataaatcaaatacatcaatttatcatattagtggaccgtaattagcaacattataagtatatgcaagtgtttggacactgcttgccttaatttatccttcaacagccataatttcactttctcctggctgctatcttctggatgcaagaagctatagtatatatgcaacacacatagaccaagggttaggagagtttaatctattgaatttccgatgtactcaacaatctaaaaaaaggttcagaaatgagtgtggtactcgttgagctctatgaagtccatggcgccgctatgatctctatccgcgcttatgaacttatgcagccaccatcctggttcgccgtgctccgtgtcggtccaatctatgcagttaataactcataacccaatgaaattgttaacgcttaaatttggcactagtttagatttatagcaagttcaaaccaaatatgaaaaataccaaagctttcccgtgaagactggtctgaccgccaatgtatagccggttagaccaaacaataaactacggtcagaccacgtatgtctgggcggtcagaccttcagcacatagttcgaatcgaattgagttttttcatttttctttccttaatcttagggttttcttgattgtaaagctttccaaacgtgaaaaagagtcatgtaaacgtaagatcacccctcctataactatagaggctaaggcagattgaaaaaacaaccaatcaatcatcaaaatcaatctattgcccataagggcatcagcagtgtgtatgtactagggtggtattaaggtgggaccaaccttaagatgggacccacactttttaaaaaaaatcgttgtttctctctccatccatctcttcttttctctttgtcattgagagagtgaagttattttttattcttttaatgccataagagcaggctataagcatatggacaactttagctagagaccaccctaaaaatcccctcacaatgtatgaggtctactttggtgtcgtaatacccacccatattcccacattgtgaatgccctaacctctacattctacatctcccttcctcttgctacttgtacccaagtctattcacctctcaacccccaattgcttatcgtctctcgtctctatgatgttagagaatgttctagctggcctgccgagactaggataaactgacgcgcgttcactctgacggggtccctcctgggtgttcattcggtacatctacctcccttgcgacgacgtgttgtcgggtgccgctgcggactgcatataacgtgcttaaagcgtggcgacgcgtcaacaaaaaccgtgcagacactgacactaaaattacagttgtccgtaccaatgtgttgatcgtggtcgacggcgaggtattcgcgcagcgtgacgacgccgtctccgtccttgtcgtgcctcttgagctccctccgcgcgacggcgtcgagacggtccgccgcctgccggcgcagccaggcctccagctcgccgcagctgacgccgccgtccttgggcgcccggtccagcatcgggaacaggtacagcagccgctccttcacgttcagctccccgtccgacccgaagtacctgcatccatccatgcgcgcaaaacatcaagcactccgcgtgcgcgcgtggaagaccaccgagttctgcagcgcggcgagcggcgcacgcaccgttccagggggccgagctcggcgtcgaagtgggaccagtcggggaggcggtcgagcgtgtcgcggcacgtcctgatgtccgggacggcgccgccgccgtggagcagcagctcgacctcggtggcgaacgggccgaacgcggcgtgacggccgaacggcacgtcgtggcgccccgatcggcggtgcgggatggcggcgaccggcggggcagccgggtcgacggggagaaggcacaggacgagcagcacgctggtcgagagcaacagggccatcgccgccgcgcccgccatatatggttccctcgatcgtcatgccggccggagggaggggaggggaggtgacgccgtgacggtgctcacccacccccggtggcactggcaacggcacggtggaagatcgatcccgcctcggctggggcgagcaggcggtgcaggtgaggttgcatttgtagcagcgagctccgaggatgacgcattgcctccgaaaccgatggaaaaccacaccgtgccaacctccacgccatggtcgccatgtgctccgcgtgttttgattttgcgtgtttcttgtgccggaaatgcgcgccgccgccggcgacgagctcgtgttttttttccccgttgggcctggcccatttcgagccctcctctaggctcggtgggctagatagagcgtagagcccatgcaaaattcatctgtacatgtacgatgggtacgcgtatgcctgtagagtgtagagtagggagaaaaacagagcggatacggacggataatgctcataccatgttcgtttttatattttttgccatatatagaaacaaatacggataattttgaatatgaataagaattgaatatgatcggacacgaatacggaaataatttttttctcggaacacgaaaaccaactcaacttcttatagaaacaaatatcaacatatataattagctcattttatataaaatgtaatataatttataaatatattataaaaaggtaaataatattaatagtgtgaactagtgttaagatatgaactactgttaaaatctaaaaaagctatattaaaggtcatagatttataaaaaaataaggtatgtctcatggcttctgtagatatccgaataacactgttcactggatatccgaattattatccgtatccgatagaaaccccgataccatattcgtatccgtatccatgagaaaatattcgtattcgtatccgaactatctgggaattatccgatctgaaaggtatccatattcgttcttattcagagcatacagaaactatccgctccgtttttatcccactgtaaagtatggggtcgcgtcaacgagatactacttggctctaaagaagcaatagagttacagtcatttgaaagagctaccgagggacaggcgaataatttgaaagagaatatacatatttcaactttgaataccaacgatacaacatgtagtatatgtaagaaataccatggcctgctcacaagacctagtctaagtcaacactatactatgcatagaggtcaccccatcattatctatcagtatgtgatgtaaagtactaatcagatatactcccattgtttcatgttgtaagatgttttttttatcaaatatagtaatatttatattaccaaattagttttatttaattaatagttaaatatatttttataataaacttaccatgattcgaaaatattactatttttcctataaacttgaaacagtttgtctttaactaaagtcaaaacatcttataacctgaaacggagggagtatattactatctccatatcattttaagtgtagttgtaggttttggtgtccaacgtttaaccgtccatcttatttcaaaaatttatgaaaaaataaaaaaaatagtcatgtactattcatgttttatcatatagtaataacaataaaaatactaatcataaatttctcaaataaacctgtagttttcaaataaaacggatgatgaaacgttagatataaacctgtaaaactatagtctttttgaaagaggggtagtactaatagtatgtttatgcaacatttgtagttttgtactaccaacttgcctcctgcactagcctagctcacccatcccatcctcgagccaacgcaacaatctctgttagtgaaggccgaaagacagggacacctttcttgtattcctccgaaacctttacttgctcttgcaaaagaaaaagaaaaagacattttattttccatgtaccttcaccgtaattaacgtgtaccactacatgcatgcagtgacgacagtcagtagcgtgctccacgaactgcacccacacgattggtcgattcatttgaccagaacgggcaacccatcggccgcgaacaggtaaccaaatccagccatattaattaaatctcgctcttaattgcgaagcttactccattgaccgtggttaatgatccagtcttcaccaaaccgtttcatccattctcttttctggatttaaatctaagcgaaatcttttgaaacaccatcaaatcttggacaaaaatttgtgcgaaatctgtgaagttggtaaagtttccaggtctcctgctcccactctccttttcacgcagccgcagcagcaaaaagccaaaaaaaaaaaagaaaagctagctgcacacactgacaagctcatcactccaccagccagcttgagctcgcccacttccgctcacaagaagcacaaccgcgagctaccacagcatcggatcgagggcgagcggcggcggaggcggcggaatgggagggccactcggcgccatcataggcaggcacccggcggcggcgggcggcggcgggggggatgagctgggaggtgtcggcggcggcggcggcggggatggcatcattcggcacaaccggaggtgccgggatttggccttcctcgtgctcttcgcggccttctgggtcgccatgatcgtcaactccagcttcggattcaaccagggcaacccactcaggtgaggtgacccgtgacccacccactcgccttcacctctcctctcctcaagattcgccgatctgtgctgtcggtgctgtttaatttcggttccctgtagctagatgctaagagcgttcatccggggaacttttcctttgctgggtggtgattaatgccgcggtacattttgagctgttcttcagacagcaacaatttaccaagaacggagcattttcaggtgttacgggctatgttccttgttggatgtgtttgggtgtttagtgcataccttcgcattcttgttggctcatttttttcgcgcggatcctggtcaattcttcaacttgatgtgttattttcaggctttcagtctaattgaactgacatagagtgagaaaatgagggtgccacttgctactatggaacattcagatgacttttttttaggctattaaatactttaatagcagatcttgcttatttcggaatgaaacttctagctcccgactttgttatttgtactctgaatcgaataatctttgcttgctttgtttcaacctcccaaccggataggtaaagaatcccacttttgctttgcagggagaaaatgtgcctttagtggttactcttatatattagagttgtgtggtccttggaattgtattccctccgaaaaaaaacttacagcccagctatacaggatttgtgctccctaaaagcaattcacactacggttatatattaatagaaaccaaaacccactactgagtgctgaccaaaagaaaatttgtttagggataaaactcagtgctgtgcaacttttgcatggctatcattttactattattcagacactatgatgagtaaccatactactcctatttagtacatgctgcatgtgtatctaagtaatacagatgtcttatattgttttgatgacacaggcttacttatgaactagactacaaagggaacatttgtggcagtaggcatggtgacccggatttgcatgagcttgatgttagatattggatgaacccaaaccaggtgtaccaaagtggggtcaaggacaacaagattaaccttgctgatgccaaagccatctgcctgatggagtgccccatgccagcagcagacggattaaactttgtttgtgattatccagaaggggacattcgcctgtctgtcgatgattggatcgacagggactatgactattttgagtttctcacaccagatatgagaaatagttctcttcaactgcagggtccatgctaccctgttatatttccaagtgtgaatggtaatctttgctctgtttgtagcacttccgtgcgaccattttttgtgagcatggattaaattgagggctttattccttcatgtaataagtttaaataatgagatagctgatccaaaatctttgttgccttcagtctactggagctgccaatttattgcgcgagcatcaaatgtctctttgaagcattggcaacagatgggtggtatcaacatcgacgaaaatattctcatagataaaacaatccacaaggccatcaattctaaatcttcagtcctgaaggtttgtaaacttcctggcactgttttattatctgcacattcctttttttttgtcataaacatttctgatttacgttggaagtgacaaattatccagctattcctatagctaacgctgaccgtacattacactgcagtaattctttttatccttacaaaagaactttgttgcactgttgctctgaaagaagcatattactttctagcaactgaaatggatattccttttgaagtattttgagaaattcctgatgcaacatgatctatatagcactggagtcccattttgtctttgaagatattaattaccatttccttcgtctgcagagatacgttgctgacattgggaagtcatggcctgtgttaattgtttgcggtggactgctccctcttttcttgtcagttatctggttgcttctgattcgttattttgttgttgccacgccatggataactgtagtggttttcaatgctctagtaatctctgttaccatgtttttttatattaaaggtatggttcacttttgcatgtcataattccaaaatatagcaagggaaattccattgtatgccatttaacatgttacacacatacgatcctaattggctacattttaattcagctggctggttaggcaatgatcccttaacagttgtaattggcgaaagtgatccatatgtccacataactgggcgggtgagtatatccaattttttgactttttacaatatccagcttcatgttgcctgattgttcattcttttactaggaaataagccaccttcatgctgctacagtggtgatgacagtagtaatgattattgcatttctgacctccatagctattatccgtcgtatactgatagcaacacctgtcctgaaggtacgtgaatcattggatgtacaagcttgattagctaactattatacactgtataagcagaagcttggttttgaagacactcagcatcaatgccattcctcctctttgaaggcaagaatatagttaatagttcctaagcactaacctgataaattattatcttcaggttgctgcgaaggtcattggtgaagttcaggcactaattattttcccagttgtgccatactttatcctcgctatcttttatatgttctggttttctgccacactccatctcttcagctctggtcaagttctccgaaatgactgcaatacagattgttgctcatatgatctgaagttgggcaaagtaaactgtgacaactgctgtgggtacagcatccattacacccctcatattggtattgccattcttttccacttatttggctgttactgggcaacccaattctttattgcgtgctcttcaaccgtgattgctggatcagttgcttcatactattgggcacgtggtgaaatatccgtaagtgaattgaggcacttaaaaaatttactctatatttagcagttagtttacttctcctttccactgactatttgagctattcctatgcagcatgacataccatttgttacagttgtttcttcattgaagcggttgttgcgttacagccttggttcagttgctataggttcacttgttgtatctgctgttgagtgggtgcggtttatactagaatgcctcagacgcaagttgaagctatttgattccgctcgtgaaagctgctttggtaaaatgacatcatcctcttctcaatgctgcctgggctgcatagactggaccctcaagtctgtgaatcgaaatgcctatataatggtaagcatacaaaaattcttgttcatggagcaattgctccatgactgaaatcaatcgtctcccctgctttgtgttggtgacttggtgtggatgcaaaatcatctggaaaaacatatgctattcacgttgatgcttctattgaattcattaggcttatgcccttctttcggtgttgcagatcgccattaccgggaaagggttcttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56022 - DNA, 703 bp, Oryza sativa
cctacacgtgtctggtttttaggttttttctttcggtttttctctggttcttctgtttttttgggttttttaatatatatatatatatatatatacaaactttgtatacatacatatatatatatatatatatatatatatatatatatatatatatatatatatatatatatatatatatatatatatatatatataaagattatatacacgtataaaaaatatgtatacatcatatataaagtgtgtatatgtgtatatatttatatacataaaaaaatatatacgtataaaactccgtatatatatatatagagggagtataaaaaaaatagcacgcaccactgctagatgtattagccgccgcgcgcccaccctatccgcccattagacgcacccatacatgcactggtatcactaaatttttcactcattaattatacactcacactcagagtcatctaattctagatctacatagatcattgttccctgcttcatgtacacgataagcttcaaaatctttataaatgagggctccctaaaatacatatggggaagagcagatacaatcacagatattgagcccgctctaaaacacatatcacagataaatgaagagagattagaggagcggcctacatatttggtacccgctccaacataaactacgagagataatgtgtgtgtgatatgtgggacc

SEQ ID NO: 56023 - DNA, 1129 bp, Oryza sativa
ttgtacttgcacctcatcccaccatcgccgccgccgccgccgacgccaccggccaacgccggctgcacggcgcaccagcagaggcagcaaaccaccagcacgctgccgacgacgtcgacggcggcggcggcaagcgcgcctcctcgccgcgccatcactcgcaacgccacagctcagtgacgacgcgagacagtggcatacttacattatatacacttggtcttggttggtttaatgagcagtgacgtcacctcgccgccattgttgctgtgcttttgtacacacgtacacgtctgatatctcgtcgtcatcgttgggctaaggctaagctgcgcaacgtttgcatgttgcaaccgatagaccgggctgggccggcacgacaaggcccatgggccttactgggctatctcggccggaaagtgttctgccgtaaagtaagttcactttgactcccttaactagaggcttaatctaattcgtatccctaaaccacaataccgggatatctcgactccctaattactaaaagagaaagactacacaacggtataccgttgaatggtataccgcttatcccccatgacgcggccccgcgtgccggcttctcccgagtatgtcgcgtgctgctaggattatcatcacgcatgtttgctatgtgtatcagtgtatagtcttgttcctgacagctagctaatacccagcatgcctgtcctgcctttgatactagcctagctattaaataaaaccgaaagtactactagcttgctgtgcatgtcaaatccctgtaatagctactagtagtcccgtaccctagccatgtagggtacttattatggcagagcctagtagcctagctatgtgtttaagatgggttgcatctatttgcatgtgtcctataccatgcatggattagaccagacaaataattacctaaattatatatggatacaatgtattctaattagatatgtcatgttgggctcttggttataccacatcttagaaactctagtatgtgatatatagatgctagattatcatatctgatatccaagtactgggtcgaatacctaggtaccaagtatgaaacctataaatacaagatctgatgccgagttatcgggtctga

SEQ ID NO: 56024 - DNA, 738 bp, Oryza sativa
tctagggacaaaaatccacttccggtatatcaccaccacccatcactctctacacctgtcgctagctcgatagtgctcacggtaacggccggaaactgcccctcgaatctcgatcagcttagcttagctataaattcagcaccatgcatgccattgcaacctgcgcctgagaacacagctagctcactctcaagctaagctaagctaggagattagacgaagaagaagacctctagctttttccatggcctactcctcatccagcacattgaggtcgccgctggtgcgcgccgccgtcgtgctgatgctgctgctcgtcgtcatgtccgccgccgtctcgcgcggcgagcctgatcatgatcatgtgcagctccagctggccgtgatcaccgggcggagaatgctcgtcgtcgccgggagcaacactgccactacgatcagctcgcagacggcggtggcggcggcgatgccgtactccgagtcgaagaggtcgagccccggggggcccgatcctcagcaccattgattgatcctgtgggaattttgcatgaggctgtccaactccctacgtggaatcaatcaattagtaactactaattaattcactgtgttgttgtgcgcagctaattaaggtggtgtttgggaggggagggacttattttagtccctctcacaaaaacataagtctctcctctagagacttatgcttttgtttagcccctcccacccaaacaccat

SEQ ID NO: 56025 - DNA, 734 bp, Oryza sativa
ttatagaacgcgtcgttgcaacaaatcactcacatattttggaaatcctctattaaggaaatttatttctttttttccaccaaaaatatttcacctaatgtttcactatatatagatctaatgttgcagtgaactaaaacattccattgcaacaaaaaaacccacatattttggaaacccctttattaagggaattcgtttcattttttgttccaccgaaaaatgtttcacctagtgtacttataatgttttattatgtatgaatcaaatgttgcagtgaactgaaacatttttccgctatttgctgaaacattgtttttatataaggtgaaacaacacccgatttaaacgagtgaaacattttcgatctacttagtacaacaattccaatatacctggtggaacatcgtgtaacatttaaaaataattcaataattaggtaaaaaaaatttcgtcggaatatatccatgtgtggtcttgttttgaagatttaattgcaacgaatttaatgatgtaatcggatcataatttaaataagtaatttaagagaaaaatcagtttaaaataaatttacacgtaaatcagacgtcagcgtccgatttcacccctgctgatcgggcgccgacagggagtcgtgtccctgttattcgtacagttaaggcctagtataaaaaatcactgtgctcaaatcttttggctttgtgtcatgaatatcagtcatgcatgacaccgta

SEQ ID NO: 56026 - DNA, 14296 bp, Oryza sativa
  unsure (1)..(14296): unsure at all n locations
aaccgcaaacatggacggaatagttcatttggatttgtccattcgtggaaactgatttttttttaaaaaaaattaaagctttcagtctttgcaataactaataaaacatgagaaattttataatatttgagatgtaccaaaatctttaatctaaatttttatttatcggaggtaccaaaatttacagtatattttttgtaccgccttaaaaattataaaatcattcgtaatacatactattatgtaaccataattatttttgtcactaagattcaaaccctgacgaatgaagctgtacgtgcccgattccacgccgcatgaatggtgcttcacataaactgataaattcaagttgcgttttgtttgtttccagagaaaagaaataatcaaatgccactgtcagccacgtattgttttgttcttaattagcaaagcgtgtaaaacacatcccccgctaactaaatgccatcgaaatttctgttcatgtgtttgactgccgtatagtccatgagctttaatctagttattcgatttatcagataggcaagtggtttaaaagacatagttattcaatggtgagtcgaccgaaactaaactcgatttatcatgacataatagacacggttgccacttgccacagaaagaataagagcgctgctacacgtacttaaaagtgaaatacttgcaaaatccttacaaacaataatctgaactgtttgatttaactagacgagagttacagaaaatctatatatactcacagtttgataagagtttagtagaaagaatttcatatttatagcctttttccagaagaaatgatcaaatcaagaagtgaaaccggccggagaaagtctacaccggcaggcccggctcatgcagcccacgttaggaagcctggctgcactgggtggcccaacggtggggtgggccacctcgggccagccgcagcagaatgcatgggccggcccataaatgggccactccaaagcagaccggcgctcagaggtccatcctgatgaatgaacattcatgcaggtgaccggcccaaaataattacagaaacccaaaaattacagaaaaactacgggttgttcatgttataccatttcagaacataccatttttttaaagttgataaatatacgtatccattaagttttttactaataaatacgtaagaaatcctgtcaaaacttggcaatattgctaaattgttgccaaaactttataaggtttattttagctacaatctaaacagaccttatgtatttgctaaaaacttaaaaaaaagtgcagaaaattaggaatttgctcaaaaatatggtaacagtttggaccattagataagcttaatgatttattctagcgagagattcttgctggatgtatgcatgtaaatatattgtaattacaccgtaattatgctatagttatatttgaaatatttttatcttaaagaactgatatgttatatagctacttccgaaaactagcacggaaatgcttttttgaaaaaagaaacatatgttctcctttctgtgtgaataaagcacgagcagttccagttgtatatatatgcgtccaaatatactgtcccgtggtttattcatccaaacgacaaatccttttttctaaaaaaaaattccaacgcattactttcttcccttttctctagcgaaaaaaagaaagcaccgaccaaagtggctcaaaaatggacgcgtccaaagatcgcgctgccacatgacaacggacttcgatgaaattatcgtcaatttttatcaaattccgatcaaatcattcctcgtcggcgtccatcccggatactataggtggacaccttcgagtcgcttctctcttctccggcgacactgccactgccacgcgtccctcccttcctccccgcccaacccccacgtgtgcgtccacgtggcacccgcccatctcacctcctcctcctatatcctcctctcctccgccattgccgcacctcatcacctcctcgtcttcttcttccacctcgcaaatccgatcaacacatcagcttgagaaacaatggacgcgccggccatgctcacgaccaagcacgtccccgaggacgtcggcctccgcaacgtcggtgagtttgcgtgtgtgtgtgattgatttgatcactgtgtacgacgccgtcggcggcggcggcggcggcgacggcgaggttggtgattaatggtgggggtgtttgttgcagcggcggcggaggaggaggggggacaggggcagatgcaccgtggggaggagaagcagcacaagccggtgctcaagaaggtgaaggagaaggtcaagaagatcaagaacaccatcgccggcggcggcggcggcggccacggcgggaacaacggcggcaggcgctagcggaagcagtagcagcagcgaggagggcgaggacgatgtggcggcgcagaggatgggtgacgtggaccagcgcgggtaccaggaggacgtcgaggaggacaagcccgtcgccatggagtccgatcccgaggtccatggcgctccgagtaagctcctgctccgttgatctctctccctgcgtgcggtgccgccgccgccgccgtcgtcgtcgttgtcaggttttgagaacttgtttggttggttgcagtgtacgactcggcgaggatcccctcggtgcaggaggtggagggcgacggcggcgcgccgagggtgcggctcggcgacctcggcggccccgtcgtcgaggacccggcggcgccgcgctccacgacgcgcgtgccgcgggagggggaggacatcggcacgacgcccgtcgtccgcgccttcgagtcgatgagcgtctccgacgacccgaagcacgtcggcgcggccgggaagccggacgccgacgtgcagaacgacccaatgccggtgtcggacgccgccaccgccggtgaggagtggaaggacgcgacgcccgacagcgcagctgcaggcgcgacgcccggcgcgacgtacaccgacaagatcaagtcggcggcggcgggcaccacggagtacggcaagaagctggccaccacggtgtacgagaaggtcgccggcgtcgggacggccgtggccggcaaggtgcggcaggtgacgcagtcggccggcaccgccacaccaggcgtcgccggcggcgccgccggctcacagtcgcaggacgacgtcgacgcctccaccaccctcgcctccggcgagccggcgaccggggggcagcagcagcaggacaagggggtaacagtcaccggctacatcgccgacaagctccgcccgggcgacgaggaccgcgcgctcagcgaggccatctccggcgcggtgcagcggcgcaaggacgacgtggcgcagcgcgttccggccgtggcgccggcggcgccgggcgacacgatcgccaaggtgcgggaggcgcccgcgcaggtgctcgccaaggcgcgcgacgccgtcacgtcgctcaccggcggcacccatgtctccgacaccgtgcagcccaccaccaccacaggtacataaacacaaacatctcaaatttcacttgccattttcgcagccggatcatgagctgatgatcgagttcgttttttttttctctttttcgtgtgatttttttttgcagaggcggatggcgcggaggtggaatcggcgccggtgattcgcggggaggagatcggcgagacccaacgtcagccgaacgtaagcatgacatgaagcgttgtagaaatggatcctctcgtgtgtgtctgtatgttgccacgtatacacgtgtaagtgtaagaaaagtgtcagtgtgcttggaataataagccgttatgtacggcttttgtgtcgatgtgcagtttttgttttttgatgtcttctgtgtgtatgtaagcaagcccgttttgaaaatggccaagttcagttgaaacttgtaatggtttgtggacttgtgatacacactgtttgtttcaactaattgctagtacaaaagtgttcaccgttttcttcctgatcactgatgaaagttcttcagaaaacacactgggaaatttccaatctttgcagctagctatttttcacctgctgagtggcgcccagaagttcattgacgttaatgtccccttttgcttctcttccgagcgattcagaccggtcatctccatgcattgtgtgtgaaagaaactgtgaacagctaatcaaaatcaaggtgcacgccgaaattgccaaatgtaacagatgactacttactccctccgtttcatgagataaatcattctagcactttccacattcatcaagttattatagcccttcttatatttatcacccctccgtttcaccgtgtaaattattttagcacttttcatatttatattgatgaatgtagaaaatgatagaatgacttacattgtgaaacgcaggaagtagcttacaagtgccatgaatatttcgaggtgcgagtgcgacaacgatatcgtgttagatcaccggacgattgagtaattgactaccaacatctccggttcttcctgctgatgcatggcctgaatatgaagcaggaatgatttggatttggacgtttggtccaaagtggcaggacgaagctagagccgtgtgcctgtatgggagtcgagacacttgggtggttgactgtctgaccccatgattttggaaacaaccttctttactgcgtctctttacaataaataatcctacaagtgaattttaacatccgatacataattccagatcgatattgaagtcctataattagtttcataaaaccatattgttaactatcttgcgagacccaatttttcctcttcttttttgggactttgagttactactatagcaaatagcacagataataaatgaaatgcttaccttgttactgtggccaaaataataataaaatgattatcttaagtggctaaggcttacaatgaattgaaagaattcataaatttaatttaactttagagcttatggtggatgaaaaaaagaattagtcgatgacgtggttttatgaaactttagaatcataataatactatgtttattgttacgtgtcaacttttatttatgtaaagagttatagtactaggctaatttatttcctcaccattttcaacttctacctttcgtttttcacgcgcatatgctttttgaactgctaaactgtgtcttttttttctttgcaaagttttaggtattccaatataggtacttctaaggaggttcgctagtactcagaaacccaggaggccaggcagtgaaacgttccgcagactgctcacccggccacacctcggagccgatgaaggctggcaatacaagcatcatatagaaatgttgccttaaaaaacatattaatctaatttttaagtttattttagttaatacagtattaaattaatcatgtgcaaataagttgtttcgttcgcgtgcgcgtaggattaaggtccctacatgttttgtccaacccagcctaagatatttctttttttttttgtaaaagtgttttctaaaagggcttaattgtgaaaactacccaaacatgggcctcgtagcccaacacaagataccatttcggcccagacaaaaaatcgattcgctaccagtagcggcccagtacggcgccggcggtgccgaagccgaaaatttccatccctcgcagtcgcagcagccacctctcgccaaactccctcttcgcgccgccgcccgccattgccgccgccaccaccaccgtgcccgagctcgccgaccaccaccccgccgtggctcgcgcgagatgcgttcacgcgagcccctgagcgctccctcgcaatgaacccgggcgctcgcccgcccgcgttgcagacgctctccgcccgcctctggccgcgcaggcggctctgcggagtccacgcggggagccggagcgggggcgaggggcctggagctagggagagtggtggtggtgacgttcgcattggaaggggggaggaggaggaggagggagggttggatggcggacgcgtcccgcaggaagtgctgctccggctgccgacgccgcccggccgggctgagaccgacgacgatgatggcgaaaacttgtcccctggcgcggggtccggttccaggaggaggttctttgaggagctgaggttgaaggcggataggattgtcaagatcctgcttcaggatggcccggggttcaacacccgccaggcgctcgacgaaatgcgcccgagggtgtccaatgcccttgtgagggaagtgctgctcaaatttgttgtctcgatcgatggcgtgaaccgcgctaggtacccgaggctggcttacaagttcttcctgtgggcggaggaacaggaggggtaccggcacggcacgagcatgtacaacctcatcttgaagatctttgcggagtgtggggagctcaaggcgatgtggcggctgcttgaggatatgacagataaggggctgcctgtgtcttcccggacgttccacctcttggtatgcacatcggggcgggctggattgaggcggaggctggtggagaggttcatcaagtcaagtaatttcaattatcgcccatttaggaattcattcaatgcgatactgcacactctgctgaccatagagcagtattcgttgattgagtgggttcaccagaaaatgatcgccgaggggcactcacctgatgttttgacatacaacgtggtgatgcgtgccaagtatatgctcaggaaattggatcagttccataagttgcttgatgagatgggaaaaaatgggcttgcacctgacctctatacgtacaatcttttgcttcatgtgcttggtaaaggagacaaaccacttgctgctctcaatttactgaactatatgagcgatgttggctgtgtaccgactgtgctccatttcacaaacttgatagatggtctcagccgtgctggcaacctagaagcttgcaagtatttcttcgatgagatggtcaagaaagggtgtcaaccagatgttgtttgctacacagttatgatcacaggttatgtggcagctggggaattcgatgaagcccagaagttcttcgatgatatgttgctgagagggcagcttccgaatgtgtacacatacaattccatgatatgcggactttgcatagtaggagaatttgataaagcatgctctctgctgaaggacatggagtcgcgaggatgcactccaaactttacagtgtatagtactctagtgagtaggttgcgaaatgctgggaaggattctgaagctaacaatatcattcagtacatgacaaataagggtcattatcttcatttattgtcaaggttcaggagatatagaagatgctgatatgtgaggccccatagtcagttacattgtaattttgttgtattgtttccaacttggaaagatggatcataagggagtactttgtgaggtaaccattcgcactctaactgttactctagcacatagggttccttatctatttattcagtacagaaatgcaacactgtatacttaaactgttttacgcactaatggaatgggataggatggggtggcctggcgtgtcctaaatcctaaccgactcatgatggaggagttcaaccctgatttactagtcctaaataggaaacccaaccttagttctgttgcaatgtagtacacaatatttgatttacttccacttctggtctcctgaaccagattacatccaatcttttgttttcaatatactttttacagtgccaagaacttatgctcaacaaaatatggggcatatcattttgctaaattacaacagaacttaggcttttgattcggttggatgcaaagcacaccgtatttctctcaattctcatttctgtcaaccctagcataggtttagcttagtggattatatgtcatagatcagataagatccatataaacattgtgcattatcttgcagcactaagagatgaaaagcctatgcaatcttgtcccttaatgatgctctttaggtcattagcatctctcgtcacagattgcttttatcattatgcatttatgtaatgtatgattaaaaattctcagtgtcttaaaaagatagcaacaaattaacacaccgttaagactgcctccagtcacaaataagtgacatttttggcagcgacaaagtctccaaacacagccacaacttctaatatctattgtgatatattatacacacggtaaaatgctatataaaatagaaatatttaagcaaaatatacacacaccattttcgcatgtccagtttaagtatttatagagatagcgattgttaagctcttaatgtttggttgcatctaccctggcctgaatcaccactatcttttactggaggggatattaaatattgtttaagtcagtttcaaccttggtatctctgactctggtcatccattattttttgttggaaaaaaatatttgaattaatcaatacgataggtacaggcctgcaaagattcatcaaattagcaatgttctctaagttcttttagttgccaaattgactttggcatcataaacataaagcattaaagttgatgatattgtcatatgtgaagacaaattgctgagttacagcgtgttgatgttaatagagcaattgacaggttgtaattttttttttgtaactgtaagcaatattacttacgtgtaccaatatgttctttacagtattatggtacagagtaatttcacataaaacatcgatcaaaagtccaaggtattggctgtttcacttgcagatgggagagacactatgcaatggtgttatatatttcataattttatcatttcttctcttctttcttttcctctttcttctcctccttcttctcttccttcttctcttctttcttctcctctttcttttcttccttcttctcttcttttgcaggtccaacagacacaatgtcaatcttcccaatcttctttaacttctttgcaattgccactgtgtccatttcaccgatgatggtcatcttattgtccttcaaatctgcagctatggaatcgatacctgtacatgaaatgaggtgtgtaatgcattagattttcttgttgacacagtaatagtttatcttacaaaatacttctttgaagatccaatcttgcatcattacatgttcagctgataatacatgatgtggagcatccagttcttttgtctaacctttagaaactaatgtacagttgttcaccgcaaacagcacatattaataatcccatacataggggggaaatcattccgtatgcctaactatatcatcgatcgtcatcttcattgtgttatgtgatgtaacaaacaatttccaccttacatgatatctcttatcaaacctctgcctaaaaccatgctaatgcttccaaatgtgatttgcagatgttttttgaatcagagatcaaaacatatttttcaagtttcagcagccaaagaagaaaggggatggtacagaatgttaccgtagatgtctgcaacggcttcaatggctttctgcttaatcttgtcgtcggtcatggttggaaccctcagcaccaccttctgctgagaattatcatccgacgacacgaaggcgtgaaccgccgaaggaatcagggaattgaaccataaacaagagttgcacttgcttacctgagccatctggaagctgtgaatggagtggaggaggggaaaggcttaatgttctgctgaggtatgaacaatgagaagaaaccaaggctggtgatggcaccggccgggcacctttatatgcaaagggtgcaagtgtgctgtcactattctggaagaaaccatatcaccaattccattcagcactggtatttatttctctttctccacccaattggtgtttggcgatgagtcagcagccaagccaggccagtttctgtttgctgcaagtgaccagtttattcatccgtccgtctcgtcgatatctgatgcgttggagatgaggtacgcaaaaatactttcaactctttcggccgctgccagtttcaattggttcactcatccctggcttttctttctgatcaaaattgttgtgatgtccctttccatccattcctgaacatgcctttgctacgtaggattgcagggtcggtcagtgtcctggtgcgaccgtgggacgggtcagtgccaaccgccacgccggcacccggcgcgcactgacgcgagacgacgggattctgtccatggagagaagtggtggtggactggcgtgagagtgcgggggcggcagctagtgacgggacggcggcggcgtggtggcgacgacgtccagacatctctagtaaagcggcaaaagcgggtgaggatcatctaccataatgtcgctatcattataatcactgaatacaaaaggacgagaaggttgcagcggcttggaggttggaagaaaaatggcagggctgttcgcctctcaagtctcaacgttggttggtagtggggcagtgaggctcaggagcatccagcagacatgcgaccgtgtgagtgacatgatccagaggaatttcttcgcttcttttactggaggatctagaagaatttggtttgtttggttttggtgtttggcagtattggcacagcgcatgattgaaactaaaagtgttttgtgaaaaggatggaagctcacaactgatccctttcaggcttgagtacacgagaacgtgcacaattgggccgggcgtgtttttgttggtgggcctgttcttgaacctgatgggctttgctggctgggctgggctaccacgagttcatgagtggggtgatatacagggtcagtcagtcattgtctcctcgttgcattcgttttatcttgtgaaactatagtgccaaagaaagattcaacggtacgaattccatggcgacatgtatgtatatgtggtttgacaaatacacctcttcatggacgggtgcaaatttctgctccagcattacggatctgaaagtgagactagcagttttggaaatacagatttttgaccaactcgaaatgcaggcaaaacttggctatcaagtttgcccccccagccaacttggctcccaagttttaccggaccgaagacacgcaatttgcaaataaggcggtggttcgttgggccttttctgccgcataatcagttttctgtttgcaccttttaacgcataacctcaaattatttgtttccactaggatacttaaaaaaaatctctctaacaaagttctcaactctttgatttacgagatggtgggggttatagggaatacaggccacatcagcgttgagttttgttttttaaaaaaatgcacctataataagtctataaccacaaaaaaaaagccacattttcgtaacttccacaatgtccacctataaagttgcaaaaatatggtaaggtctcactcaaatcatacgtagtatgtctttgtatttttatttatttatttataaaataataactcgttataaaatttggtaatacctaagtagattacttttcgggaaaaccaaacataccattatatttactgatcggatttccctcaaaaaaaaaaatactgatcggatatatcaatcccagccaaagcctacctcgcagccgcagccgcagccgcgcggccttcgtctccgcgagtcgcgaggagcgccgccgccgtcgtcgccgtcgccggtggcaacgccgccgtgtctttttctccacacacacccctttcccgatcgattccgccgcctactccgatcaagcaaggtaattaattagtgtgatcatgcctgcatccatcacaaaaccgtcaataccactttgtcatccgattccaattgatacttccgtttccgactcttggaagcaagaacgccctattaatttgggagaaggccactccggccggcgacgcgcggggctgcttccatctcgctccggaggcaatgactatcaccggcgccatggagaaggtgagtgctcgtataatatactccctccttccctaaatgtttaacgctgctgacttttttaaacatgtttgaccatttgtcttatttaaaaaattatataaaatatgtaaaactatatgtatacataaaagtatatttaacaataaattaaatgatagaaaaagaattaataattacttaaatttttcaaataagacgaacggtcaaacatttttaaaaaagtcaatggtgtcaaacattttgggatggagggagtattagattagaaatttcttgtgggagtgctcgtatgtttgtctggtacgcaagcagtaagattgaatggcttaattaataatacctacagtacacacaatagattaaaaacaaacaatgtagcttgtatttctgcgttagcattgcgctgctttggttaattcctcgcaaaaacagctctttgttttggtctgatgcatttgatatgatgttgtgtgttggtggcttggtgcagccactcgatgagaaggagctggaaaggaagctgaagaaagatcagaaggtactcactctagtaggattgctgttatgtacttctgttaacaattcaaaggaatcgtgtccagttcaccagttgtttggtgtatgaataagtgtgttatgtatgtaataggcaagagagaaggaggagaagaggctcaaggcgaagcaaaaggaggcgattaggctacaggtgttaaaaataatccctgctcagataaatgtgttttactgtcaattctttgtattgatgtggttgtctgcaggcacaagcagcatctgatgaaacaaagaagagcgacaagaaacaaaagaagaaaggcacaccggatgagaatcctgaggatttcgtcgacccggatactcctgctgggcagaagaagctgcttgcttctcaaatggccaaacaatataatccagctgctgttgagaaatcgtaccgcctctcttgctttattcctcgatttaatttattttcaatgaggatatatctttcatatcgttagaaccttaggaattcataacatgaaatttctcacttatctgtccttttttccggtatgttgttttcatgtagatggtattcttggtgggaatcatctcaatattttgtagcagatgcgacgagttctaaaccaccatttgtaatagtaagtccactataatgcaaagagtgcatgattatatatttgtattcaggataaatactttatcatgattactgtgtgagtagtatgtcctatatgaaatacacaattgaagctttatttctacttctcattttgcatttgcaatgtttatttttccagatcttgccacctcctaatgtaactggggtccttcatataggccatgcgattacagtagcaattgaggtatttattgattgattctcctgtttattcattggccatataagcatcagtattgatgtctttttggttgttgcatcgtgaacaattcaggatgctatgattcgctggcggaggatgtcgggnctataacgctttgtgggttcctggaatggaccatgctggcatagctacacaggtctgtcatgcatataacatatatatggtatctgtttctaacatataacctctacaggaattattgttaacttgaatacaaattgacttttgctgaaacatcacattgattgttaaccaactttctgttttagtttttaagggtagcaggctttatgtaacaaaatttctcttcatatcaggtggttgtggaaaaaaggcttatgcgtgacagaaacctgtcaagacatgatctggggcgtgataaatttctattggaggtaatcatttttttcttacctattgcatattgtattaacttcacagttagtttcatttttatttatttttttcattcttcaatcttcttggcaggtcctccaatggaaagatcagcatggtggtaccatattgaaacaattacgtacacttggagcctcacttgattggtcacgcgaggtataatttgttttgatttcccctaaggttgtagacagccagaggagagcaccatttatatctaagcaatatattttgttgaataaatatgacaaaactccagacattatggttcagattgcacaaaaccacatgttttttggcatgttgcacataaccaaaggcattatggtcctataattggttaatggtgtggtttagtgaaatcttaataccataatatttgtggttatgtgcgatgtgccaaaactctgagttttgtgcaacttgaaccatacctggggtatataaaatgtattcatatattgttttgctttgttgttaaatggggtgca

SEQ ID NO: 56027 - DNA, 3475 bp, Oryza sativa
gcgtgcaataggtccgcctgcgaaaatagcttcttgcgctaaaagaaaaaggcagccaccgccgtttccggcggtagcttcccgttcccattccagttcccactcattccctatccaatcgagtgaatccaaattcaattcatccagttcatccaaaaatcaccgaataaattcatccagttcatccaaaatcaccgaatcaattctagcaaagaaagcaaataaaaacattcctaaaatcacggccgcggcccgccgtcatccacgccgctgccgcacggctgcgcctcgcccccctccgaccagatctgggagggaggggccgggagccgccgttgccccctcaatccccctcgccgccgtggccgggagccacgccgcctcgaccctcctcgctgttgccgccctctgccgccgccgtcgggaacacacgccgccaccgccgggagccgccgccgcctccggcctgcggtcggggagaggagaggggaggggagggccggaggggacaggaggggaggtgaggggaggggagaggccggtgaggaggtgtgagaggagaggggaggggagagaccggtggggaggggaggagaggtgtgagagttagaaaaaatgtagcgcccgcaagtctatttatattcaagtctattttcgcaggtggacagtaaattttacccgatttatatttttgtaggcagtcatttggctctaagggtcatgcccacctacgaaaataaaacccccacatcagggaaaaaatgctttttctaatagtgagatttgttatgttcagatttgttgtactagattgtatgaaatccaattctaagttaattccacttaaattcatgcaaaactttttcagtgaaataggcgcaaaaccagtctgttgtgcaatatggtttgtttacgtgccacgagaggaggtaggagagctacgtccaaggttaggccctgttcagtttgtgaaaaaaaaatttaggtattacatcggatgtttgaccggatgtcggaacgggtttttgacacgaatgaaaaaactaatttcataactcgcctggaaaccacgagacgaatcttttgagcctaattaatccgtcattagtacatgtgggttactgtagcacttatggctaatcagggactaattaggctcaaaagattcgtctcgagatttgtacaattagtttttatttttatctatatttaatacttaatgtatgtatctaaagattcgatgtgatgtttttgggaaaaaattttggataactagacggggcctatttacacgtaggtatatatataccattttttctcttcttcttttttctttttctttgaccaaaaccctatcaatgtaacgtccgtcgaatttgatcggtcgtccgaaaaaaatatggtttgtttacttttgatggtttgtgacgaagccaactttaattacctgcaaatctgggaaggcttcaattcatgatttcgtcgccagcatgcccatgccttgcaccgatcaggcataaacttgggacgttgccggcagggaaaatttcaggtacgtgtcattcagtacattaatgcactcgctttcctgtttgagaggcagttgcagccctgatttctcattttcctaaaaatctggttatgcatgcatcatctacctgttatataattgtagaaaaatataaatataaattttttaaagctcttttatcgtaatttatttttcaatatcggttttcaaaccgcttatttctagctgttatttattttttttccaagactaactaacgttccgtgctttgcaacgaatattacaagagatttaaggcaaaagcaaaacttataaacttatagcatagttagttaactagcatggtggtccgcgcaatctgcgcggatagcatcattatattttctctcgtataatagcatatatgttttctcaatgtgttattcaaatatattaaaatggcaacatattttaaattttgtactaattttacgaaactactaatttgtaatattcatattgtatttttatatacgtgttagttattaactttttaatatcaaattttagttatttttaaattatattcctatatgtactctagactcatcttttaatatttctttttttaattctgaattttctgtaaattatatttctatatagactctatgctcttctttcaatattatttatttttatttctgaatttttattatttctaattgtatttctatgtggactctaaacttatctttcaatatttttaaatttttaatttcgaatttcagttacttctaaattgtattcctatatttgtattcctatattgaccttaaactcttcttcccatgtttatcttaatttcgaattttagttatttgtaaattgtatttttacacggactctaaactctactttttaattttattatgtttattccaaattttagttagttttaaattcctatatggactctatactctacttctaatattccttactttttaattcctaatttctattttttttcttaattgtatttctatatggactctatacttacttctaatattccttatttttaattccaaatttctattatttcctaattgtatttctatatggactctagtctcctcttctaatattccttattttttattccgaatttcagttatttcctaattgtatttctatatggactctggtctcctcttccaatattccttattttttaatttcgaatttcagttatttcctaactgtatttctatatggactctagtctcctcttcttatattccttaatttttaattctgaattccagttatttcctaattgtatttctatatggactctagtctcctcttctaatatttcttatttttttaattccgaatttcagctatttctaaattgtatttctatatggactctgccttttctttttctccgattaatgtgagaatttctaagccatgagagcgaacgtggaggctcccttttctattactttaataatataatagattaggcatataatacatccaaagaaaaacattaatgtgtgcatgagtacttcatgactttggatgcaaacccagacatcaccactaacatcgtcatttaaagtagtgtgtgtgtctatatatatatatatatatatcatacaccgtttaattattattctatgataaaatttaaactacagacttaaatttatttagaaaatgatggagtacatctctgtacattaacctctgctttctgcgacacgccgacacctcctgtctataaatacccaaaccaacagccaaattaagcagcagccagcagccaactgcatcgatatcgatcgatcactcgaccgaccatctcacaagcaaagcaaaagctcgtggcaacaatggcgaagtgggcggcgatcatggcggtgctgctgctggcggcggcgtgggcgc

SEQ ID NO: 56028 - DNA, 10128 bp, Oryza sativa
  unsure (1)..(10128): unsure at all n locations
gtgtacgtgcgcttgaataaaggacgtgagttaatttgatcggtgtcgatggtgtgtttttttggtattcaaagtttgaattccgaatttggtcatcagtttatatatcttgagctcatctatagccgtgtttagttccttttcaaattcttttttaagtatacggacacatatttgaagtattaaatatagactaataacaaaacaaattacagatttcacctgtaaattacgggatgaatctattaagcttaattaatccgtcattagcaaatgtttactgtagcaccatattgtcaaatcatagcgtaattaggctcaaaagattcgcctcgcaatttatatgcaaactgtgtaattggttttttcatccacatttaatgctctatgcatatgtctaaacatgtgacggaatttttggaagtttgaagggaactaaacacagcctgtgttgtctagtttgtactaccccaatctctcgattgaaatttctcataaacaaatttgaaccctgggataatacgagcgttctgatatgatcaaaaccaagatgaatagatgatacgtgcgtgcgtccaacttgtacttgaaaagaaaatgatatactcaattttcttcacaaagtacaagtaaaatggacctttttttttcctaatgactttactggttgtcaacctttttcccacgataattttactggtggtcttaaaaaggagagaaaacctcggaacgtaaaagacattaagtgaaaactcaaaagcatgcacgtaagaaattttttcctaccaacactttttttttgttttcccaaatctcaattgagtcttctcagcccttgaaccttgcatatggtttgggggaagaacacgagggaggaccttctgaaggtgagtgtttcctatagaaagggtgataccttcggtccctaatcctatcttattatattataataaagttataacctactgacttctaaaacttaacatgcaaatatgccacattatcatccactaacaagttgatacatcatcatccactaacaatcaatacatttaatatcatgcaaacatgctatattatctataatttaatttttttatattttagagcttttaaaataaaagtatattaaattatcatcccacataattaacataatatttcaatatatatcttcattattctttataatatcttatttacttacgtaagttcatcctcacttagttaatgttattttttatcttctctatcagccatatcacatcaattgattttagtgcttatgcaagtttatattgtttagctatttttacttattgttacatactaaaattcccgcgcgttttccgcagcaacgcgcggggttttacctagtataacagcaaaacaataccactaaactggtattaaatgccaatccagaacacataaattttacaggaatttcatatgattaagtttaattctccgtaaaattccgtcgatttaattttttcgggaaaattccttcgctctaagaacagagtcctcaggtagaggaatgctaataaatgagtcgaaccaatattttgaccatcaaggagcaggacaaacataattaagaatgacacctttacaagcttgagtttttttccaacattttaagactacgtcaagctccaagaacagagtcgtaatcgagataattggatgttaagggcagctccagctctagttcgaagccacaattcactgttaacatcgatttgtagaaccgttagccgtctccgttaccgttagccattgacgtgtttaaaaagacatctagtgtggccactagatgtcgcgatgtccacacgcggccacactcagagctttttgcgttcagcgaccctgtcgagtagtcctgatttccgtgtccaacgtttaactgtccgtcttatgtgaatttttttttataattagtatttttattattgttagatgataaaacataattaatactttatgtgtgacttgtctttttaattttttttataatttttttaaataagacgaacggtcaaacgttggacacgaaaatatagagtttgtcttttttttttcttcgaacggagggagtaggtgtcgtgcagcgcgggtacgagggatgctcctcaagctcaagcaacctgtgtacatggatatgacgacgtcgctgggagcgagagagaaaatggattctcgggaatataaagttgatatatgtagcacagtgataatcaacaacaactactcgtatttaaaaacagatgccccttcgtagctgcattctggaattccttgcaaatcaacctgaacatcacctctatgcaggagcttcacaatctgcccagaccaagccggattccgaccaaacacttcgaaatcttctagtacctccgcttctgggggctgttgaatcatcggcagacgtcgtcttcagaaagcagaacccctccggcctccaccgcccggctaatttcaaaatgtctagaagatgcaaacctcaggacggaaaggttaaaatgcgccgacaggattgcagtagaatctggaaagaaattctttcctccttgctgcaccccaatgtaacaaactaatcatatgtattgttctccctttaatgaaattcaggtgggaaagctcttcccccgataaccagttaaaaaaacaatggtgaagaaatgctctttactctcggtttagaaccctctgtagttcggtttttctatgaattcgggattaaaaatcgctatgtttagttctggttcaaatacccatgactaaatatcgatctttaatcctgattagtaacaccaaccgggagtaaagaggggaatcttttagtcccggttggtgagggtagcgccacgtctctggtcccattcttctctttttttttccatattgatttcacaccaatctcaccaaaatcatcacaattccaaatagagatgctccctacatctcagatcaaagtaacaataacacaaatcataatattcacatcacaacttgtcgaaaagaaacatcacaaattctaaaaaaaaattacatcacaaatacatcatagatcaaataacacagatccaataaatcataattccccttttttttaagnaanaaanaanaanaaaaaaaaaggggnaaaaaaaaaaaaagnnaaatccggccgcagcgagctcctgtcgcgccgccgcctcctcctgcttcccgccgcgggccgccgcccccatccggccgccgccaaccataccccgccgccagcctcgctggccaccgctcgctcctcgtcggtagcaactgtgagaggatgaggaatagaaagagaaggatagaggacaagagtgagagagaggatgaataggagatagaaaattttgaggataagagagcaagagattatacacggtatattgatttttggtcctgattgggaacaactactaggactaaagttaggattttagtcccggttaatgttaccaaccgggactaaaaatatctgggacctgacagcctctgacacgaggtgaaccgggactaaagatcatcttaattttactcccggttggtgttactaaccgggactaaagatcacacagtccctttatatttataaactgctttttagtcccggtttttaatggaattgtaactattgtggatttggattgaccgactaaagatggtttctcttactggcgtccaaacacaaacaacaaattaagcttgatacatgcatgttgatgtaaaaagttttgaattggtttcgagtgtccacaaaaaacaaataagatgccccatggatgcctgcctgcaaacttatactgtctgcttggatgatttccttggtgcgatcctgttcttgttgtgatccaattaatttggcagacaccaattttctgcacgcgtacatatatatcgatccattgttactagtcaaagaaacccaaatgcatatgtatacgagtatccaaaatgcacgaaactgaggatagatccatgtctctttcttcttcatccattcttcctccgttttgctagagaagaagaacagctctggcactagtactactactactacgacaaagcctgaatttgttttttggtacgaaaggagtatacacgaaatgcatggcctgctttctgacatctcgtctataaataccctgatgtgcatccttttcctacaccaccacatcgataacattcgatcacattcggctagtaaccaagcagttcttacgctagagctagctcgagcaatggtgaagtgggcagctgtgatggagatgcttctgctgacggcagcagcgacggcggtagcggtggtggcggcgcagtgtgaccctgagcagctatcggcgtgcgtgagcccgatcttctacgggacggcgccatcagagtcgtgctgctccaacctacgcgcacagcagaaggaggggtgcctctgccagtacgcgaaagacccgacgtacgcgtcctacgtcaacaacaccaacgcacgcaagaccatcgccgcctgcggcatccccattcccagctgctaggctcgatctcccgccgccgccggccatgatgcgtacgtggcatatatacgcgtggtgtgtacgtgcgcttgaagaaaagggcgtgagtttgaattaataattatccagtacgcgatgtttgatcgatcgatgatgtgccttttttttttggtatttgaagtttgaactctgaatttcatcttgtgttaattggagtatgatagctgtgtgtacattcgttttggaggtagaggccggtttaattcattatctgttctaggcttgatcgccgcctcccgttggtgcggccatgatacgtgcactagtggagaagtgatctttactgggacatgcaaaaatcatattagtccctgttcaagtaggaacggttcaaaagtccataggttctttttatctttagtcccaccaaaattaaaaaaaaatcgtgaattgctgccttgaaccgtgcgcctcgtccttatctcctcctcccctctcattttctcaccctctccttcccctctcctccccctccccctccccctcccccctcctccgacgacggcgacgccgggcggcggcctcccctccgccagatcctacggaaggggagggcaagcgacagcctggcggaagcggccgcggcggctggtggtggcctccccttcgccagatccgacgagagaggaggctgggaggcggcgcacggttgggcagccggcggcgactgtggctgtggatttattttttagattttgtgaatgattcgtaaatattgttgtagatttttttagatttggtgacgattttgtggatgattttataaatggtttgtggattgtggatgattttgtggatgggcctatgaattgtgaatgattcgttgtgcatgatttgtggggatttagggatgacgacgttggtgcttgaaatcaatatatgactttagtgaactaatgaatgaaaaaaacaatgaaaaaaaaagaaaaaaaaactctagtggactggctagcgttaccatatttattttaaccacatctttagtccctaattggacgttccagtttgcaaaccagaactaaattaaaaaagattgtaaaccgggacttaaagagccctcgccgagcggtgttggcatagatactgtgtgcacttgaataaaacgatgtgggtttggattaataattaacgatcgattataactttattataggtgggtgtccagctaacgaataggaaaaagaagaaaaactcatatcatgagagagattaatgattgtgtgaaaacttaaaaatatgtaagattttttttccaaacggctgtttttagggtatttttccatgtcataaaagaattataactgagaagaattcttacatgcttccaaacttcaatcactactataacaacaaatacccctaaacggctgttgactggaatccagctaaaatggagagagaaaaatcctacttcaaaactcagaaattttacatggatttcaattcctgtgaaattacttcattctaaaaacgacctcatgccctaagagcgaagtcctgagatagatcaatcactatttcattactccctcagtttcagattatagtcgttttgactttgatgaaagtcaaattactccaaatatttgactaattttatagataaatatattaatttttacagcaacaaattagttttattttaacatattttcataatatatttgtcttggattgaaaatgttacaatttttttacaaatttgaagcagtttattttgatcaaaattaaaacgacttataatttaaaacaaagatagtactatagatttgattttttggaggagactctcggtaagttacggacagatataaattctctcgcctgcaacaatcgctctctaagggaccatttaaggagccacattaatgctagtagtaatagatgattcgacccaatattttgaccacaaagcaacaggccaaacataagaatgataacttgacaagcttgagttttttcaagtgaaaacacttactcctctatttaaaataagttaacttttagctataaatttgtagctataaagttagttttaattgggacggaggatgtacgcgagatgttgatgatgtgtattgttatgtccaaacgccttcagttcttttctgtagagcattgagagtgcaatgaaggccaaacagattaccacaagattgatgagtgatgacccatttattggtgctcatctgcccgaatttatttgctagtactacatccgctgtttccgttcaacgttcgggcttggtattgaaagctgcagtgcaaaatgtccgaaacggcacgcacaagtggaagtggtagctgccactatcaaattctactaaaggctgagtttagttttaaatttttttttcaaacttccaattttttcatcatatcagaactttcctatacacaaactttcaacttcaaccaaacttctaattttggcgtgaactaaacatatccaaaataggacggtactgcagggtacagatactgattcgtcctaatctgatcctaggtcgctatatagtgaaacgaaaggggtattttataacggtcaccagcctaccaccttataactactcacaacagaatactagttttctagtgatatagtataataactcatataaatcaactgttaaaatcatctttaatgaatgataatgttgataatactgagagcatcgtcgtaaagttaccataaaagtgtttttacggttcgtaccgtggtaacagagcagaagtgtaagttacttcctccgttttatattataagactttttagcattgtccacattcatatatatgttaataaatctagatatatatgtgtgcttagattcattaacatctatataaatgtggataatgctagaaagtcttataatctaaaatagaggtagtaaacattatagggcctatttggagagcttctagctgctgcaccttttcatagaattataaactctcccaaactctagtttctttatcaagattctaaagttgtagaattcaaaaaataaactaaaagctagatgctgggaaactcatagttccgatttccgatcttgtgggagcgtgaaatgctactacttcagagttcactattctgagatgatttatggtgtcaagtttgcgatatctcaactcaacaaaatcgtccaaaaatttcgcattgttggacatgttggttatgaaaacagcaccttcaatcgataacaacagatacttcggttgtgttcttttggagggtaaccctcccctcaacaaacggagcaacaaattcacacataattaattatgtgttatttaaaaactttgaaaaataaattaatatgatatttcacgtctacttttctatatatatagggggtgtttagattcaggggtgtaaagttttaacgtgtcacatcgggtattatatatggtgccgcatggggtgttcgagcactaataaaaaaataattacagaatccgtcagtaaaccatgagacgaatttattaagcccaattaatccgttattatcaaatatttactgtagcaccatattatcaaatcatggagcaagtaggcttaaaagattcgtctcgcaaattagtcgcaatctgtgcaattagttattttttagcctatatttaatacttcatgtaggtgttcaaacgttcgatatgacatggtgaaaaattttagggtgggacctaaacagggccatatttcttaaaagcacactatttagtattttggaaagcgtgcgtgcgaaaaacgagaaagtgaagattggaaaccttaagttaagaaaggggttctgaatatttttgccccttccatagataaaaaagaataagagtttcatatttaatattcctatttaatttttttaataatggattaaaccccggaataattaactatatgctactattacgagtggtgctaaattatttaccactggatctacatgttatggacacatgaggactcacatgtcatatacagcctctacatcccgtaggatgtacgtagccccaaagagacatagtctgagcatttaagcttgcaatacaggttacaaacaacatagatacttcctccgtttcataatgtaagtcattctagtatttctcacattcatattgatgttaatgaatctagacaaatatgaatgtgagaaatgctagaatgacttacattatgaaatggagggagtagaatacaaaatacaaatcaactgtctgtgattgaaatacgagtgtaattttgtgttacccataattaccagtgaaataaatttcccttggtagacaaaccgtttgttgggtgatgatgttacctagcatatggaaatattgaagagtgctaagctaggatccaaaatcaattcatgaaatagtagagcaatgaacattggcaacgaagcaaactagaatcaaacaccgcagatgtaaaaatcatcaacaaaaactccaatccaaattcaactggccataactgcttccatgccttgcattggtcgagagacgagaggatatgtccccagtggcaattgatgttgttgctgttgtcgccttggaccatatccctctcctctgatctctcctctgcagccagccagaacgtacggtgtctccggccgtcgtcacagattaggaaggggagatgcaggcggcggcggcggcggcacggacggcgagagggcaaggcgagactcctgggcagtttttttccctggtagtaatgggccttttccgacggattgtaatccgatcacagcccatccaaacgcacattttcagcccaaatggaaaaaattacggggcggtattatacacctgttttaggcccagaatcagtcataagttgggcatagaccgtgtcgacatggaatccagctaaaatggatgaaaaaatgtagctgcattaaatgcgagtcctactcttaccaggataaaggctctttaaaagatgtaaatctactctaatctaacctacttaaaattttttaaaaattcataattctacgatcgtcacaatacgtttttgtccgacgtttgcctaattcattgctgtagcgcgcatatcctatcgtccatcttggttcgttgcatgtattccaccgaatcacctcctgatcgagctcgtatcttggtcatctccaaattccaaactgccaactcgaacacgccactggaagagggggaacttcaattagtcaaatcggactcaaatccatccaaataaaatcagcatagggagaactctaatccacccccaataaaatcaacaaagaaatagatgttattgcaacacaaataaatcgactatcggacatggggtctgtcggtgacatgggatcaggagtatcatgactagaggtttgaggcagacacaatcgcacacgtggccccgagggacgtcgggcccgagggtgatgcgttcgccctcctcttagtccccccgagggggtcgggccgcacccccctcgccccgagggccgaggcaccccgacccctcgtgggttttttgctccgcgtatgggttagg

SEQ ID NO: 56029 - DNA, 17661 bp, Oryza sativa
ggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtgggggacaagaatgaccgacgtaactggtctgacaccggtcatgtcgtcagcagacagccacgattccacgtcgcacctgctcccggcgaaagtggaggtagttgtggcccgtctcatcagaaggtgactcggacggcaactatacaaatctccgtccatttatgaaaaggtagggtaagtccccacagaaaaagagagagatggtgcatgtggtatccccttaagatataaaaaggaggaccttgcccactgagaaggggaggggacttttccagattttaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaactctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgaccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgtccctgttatcctccgacccagaggtcatcagcacagaagacaagtgcgccccgcgaggctgcttggacgaagagtgccccagggatgcggcccctagcaaagaggatcggccccaccgaaaggtgcagcggcccgtctactttgttaatgaggccctccgggacgccaaaacccgataccctcaggcccagaagatgctttacgctattctgatggcctcgaggaaactgcgccattatttccaggcgcatcgggtcactgtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccagctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcctagacgggataacatgattgccgacgaactctcacggctcgcgtcctcgcgagcccagatcccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccgcagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcatctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcatcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggcgggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgcgccccgaggcgtggtgaactccggggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggactgggggctcaatccgatgcgcccggatcgccggcctcgacgtcactgtcgtctgcaccaccggcattgccctcctcgtcggagttgggggcgaacgcaagccgaggggccgagccctcgaagctgttgacgatatggttggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccctggcggacgagtccagcgagccctgcagatcggcgatggtgcgttcggcagctgcgaggcgggcggctaagtcgctttcgcccgtggccgccctgccgctgcgcgccctcgcgtccagctccttcgcccgcgcctcgagctcagcggcccgttggttcagtacggccctctcggcgcgggcaccttccagattgcagcgcgcctgctcctcctgcgctgcctcgcggagggacaggttgaccgccagctgttgcgccgtggcctcggccccctcgagagctcgctcccgtttggtgagcgcgtcctcgcggaggcggagcgtgaactcttcttcggcgcaggcagcctcgtgcgccaccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaataagggcagccccccgctcctcctccacttccttggcaatctccgccagcaccttcttacgggtttcaagctccgagacgtgccggcggtgagccttacggcccacctccaccatggcctccatcgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgacgccagctgccccggaagttgtcgcctgagtgtcgcctgagggagtgggcccaagcgacgcgcccgcggcctcgtcgcgagctgcctcggaagtcgccatcgcctcgtcctggcgaaatccgacctcctcccgagcggcttccccggcctggcgggcccgggcggcctcctcccgagcggcttccccggcctggcgggcccgggcggcctcctcccgagcggtttcctcggcctggtgggcccgggcggcctcctgggcggcctcctcggcttcccgtaggcgacccgcggcctctcgccggtcagattcccacctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttaagagaatacagtcacgatgggtgagagacgaacctgcgagggggtcggttaaacgaccactttggaggggaaatgaggtttccccgagatggttctgtctcccccatcttgcggggccgcttcttcttgcgctccccctcgggctgcgatgttggcgcggccccctccgggcgcctactgctggcacgcgccgccccgccccctcggggaggagatgggggaggtgttcctccctgcttcctctttccccgggcgtcggcagggcggctgctccccggacccctgtcacgggacccagaagcacgaccccctctcggggtagattgttcccccctgcggctcccgcttgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagccattccccagatctaccggcgcccgccagctggaggcctgcgctgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtgactatctcccggccggtggcagattccggcatgaagcggtgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttcccgcgcccacgcttccactaatcccattcgcccgcttgcggcgcatgaggtggatatgcggttgtggcagtcgagatagatcatatcgtgcgcgcgttaattacgcttgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccgcgagggacgtcgggcccgagggtgatgcgttcgccctcctcttagtccccccgagggggtcgggccgcacccccctcggccccgagggctgaggcgccccgacccctcgtgggttttttgctccgcgtatgggttaggtgagtacagtggggcttacctaaccacatttattgcggtttggttgagcgtgtcacgccgcatgtaacgcagtgcagtgcactcgtttatccggtctgtgaccagtcacagaccggtcagatcgcgggttaggtggcgacaggcgatctgacacacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtgggggacaagaatgaccgacgtaactggtctgacaccggtcatgtcgtcagcagacagccacgattccacgtcgcacctgctcccggcgaaagtggaggtagttgtggcccgtctcatcagaaggtgactcggacggcaactatacaaatctccgtccatttatgaaaaggtagggtaagtccccacagaaaaagagagagatggtgcatgtggtatccccttaagatataaaaaaggaggaccttgcccactgagaaggggaggggacttttccagattagaaacccagaacaagggagaggctggctcatactttgtagctcctttatacacagatctcccaaaaacacaggagtagggtattacgcttctcagcggcccgaacctgtatacatcgcccgtgtcttgtgtgtttcctgtctcgcgagccttccacatacagagagcttagaatctctccctgagcccccggccgaaccggcaaaggggggcctgcgcggtctcccggtgaggagccccacgctccgtcagggtctgttcgactggcattttttacagctgcacgaaggctagctgcagctgcacaacacaagcgctgcagccgtagcactgtcgtaggaatggcagtcgaacatgcccatgggatatacgactccatcttgacctccttcaggcttaggattgatcgatgggggtctggtcccgctttaagggaccatttgattccgtggccatgccgtcactaattgcaccctctctccactgtcgcctatacccagatccacagaagatgggttagtcaccgacctcagtcctgctcgccgctcttcgcccattgtctatctccgccttgttagccgtcctccgctgtaggcctccacagaccttgagtggagatgggagggtcgaggcggaggacgggaggaggagaaggaggtggcgaacccgcagccaccggctactcaccttctcgatttaggtttaattatcatgcgggtacgttcaccttctccctttctttctcttgacactgacgagagacgagctaggagagagattgaacaagaatcgatgagagagcgagaaagagagagataagtcttgaccggctgctcgtgctgatctggcccagccggccaactcaacgtggcaaacgtgtgcaaactaactggagaaaacgttgcactattgtattgtgtgattatacaatgcacgggcaaaaaaaagtcatccatttttgaaaacactatactacctccataaaaaaaaatttctatgaaattaaggacaaattataaagataaacaaatgatcacattaaccttaattatttaatgaacacagtacacgcacacacattatatataaacttgattaaaaataaggttgagacaagaggttaagagatgaaatggaaagaaaggagattacaaggaaacaaattttgatgtaatcaatttgttttgttaggtcccacattagtagacataaaatttttatgggacaaagatttaaaggtagaaattcaatttttatgaaactaaggcagtagaagtttcataaaagaaaacgtgtgatgcaaaaatatttaatgacctcagtctaaattttcatcaattgactacagcgcaaagaaccgagtcgttcacgaattaaattttaaaatatactgttcattcatttttttctcaaaaatattcgggatgcaaaattttttacagaaatataccgtcggtctcgcacaactgttgcgcaaaaatgatgtgggaatgacgtcgtgggcggtatcgcgtaacggaatagcgagaccgaacggtctcgctaaagcaacgagcgacactgtctgacagctccttttgattagtgattaattactcaattaacaattaactaataataattagtgattaattatcctgattaatgattaaataattattaatcaataattaattaatcgctaatgaaatcggcatggcacggtatcgcgcattgcttcaacgagactgaaatctcgcgccgctgcgcgctttcagtgcgcgataccgtctgacgtcattcccacatcatcttcgtgtaatggttgtgcgagaccggcgatatatttttgtaaaattttttgcataccgaatatttttgagaaaaaaatgaatgaacagtatattttgaaatttaattcaggcgttcacccatctgtttctcccatgctaaatcatcaggcacacacatcaagatcatcgttcacatcccgaacgtgtagagccattgtttcaaacaaaaatataccttttgtggtaattacactccgtcgatgtttatgattttgctccggtgcttggataaatcattgaggtcaaacctcatccaccttaccattacccagtgcaatgcaggagtattttgcaaattttacaaaaaaaaatgaattaacccaactagcaggatgtctcgagcactccatgaatttatataacgatgcaaaaactatatatacgctatatcctatattataagtagttgaaagtttgtcctaaatgaaacttcttaaaagttgattaagttggtataaaatacactgtattttaaccataaaaccaatattttatgaaatatattcaatagtaaatttaattaaactaatttgatgtatgccgtagaagatgttatattttttctatatatttagtcaaacccaaggaagtttaacatagtacaaacccataacatcttatttttcaataatttacaataatcaactcgttgactttgtttgtcaccaatagtagatttccatagtagtagtagtttcactgccatctcatctagagttctgactttatcatagaagtactagtgctacgaccgttcttcttggcaaaatttaccacatgataccaaaaagtcatctaattggttgggatatatcaatggacatcacaaaatttgtgtaactggttgtagcgcacccgagacaatattgtatcatttccaatgaaaaagatatataggatagaaatttcaaaagaacataaatgcctccggcctcaacagcatgtaaaccggcctggcctattggatcttgttcaagttcaaccggactcaatcgcactaatcgttcaccctcacaaccgaaatccccatccaaacctaaccctaggcagccggtggcggtggctttggcggcggtgggcgagcggatctgggaatcaattgtggggctttaatggaacctcaatgctcgtaaaaaaaagccactttcttccctgctaacttcttcctcggcgacatcatccccaatgccgtcgacgcctaccaatttcacagctccaccccccgtcgattcccagagccggtcgctcgccacctccaaccacctagggttagatttggatgagaatttcaggtatggggttgaacggtgagtgcgtttggttgaacctgggttacatgctactgaggttgggggtatttttgtccttttgaaatttctctctcatctttttcaccggaaatggtaacatattatctcggatgtcgctattgctaattatataaaggcaaattttgctacaggacactccttatatgtggttttagccctaggacactgcccaaactcacttttgggggaaaatactccataaacgtggtaatttgccagtggacaccgcgccgattaaaataataatttccgattgaagaggaaagagaaattgcgtgaaatgtcaaaaatgcccttgggcccacatgtcagctctatctcctatctctcttctcctcttcctgcccacatgtcgctccccgccggtcgtcgaccgtgcacgcgcagacagcggcggaggcaacggcgagcagcagcagcaccccggccctctggcggcccaccagccgcagcgcgcggtggagcagctgcagccgctccttctccccgctgcctcgccaccctcaccctctgcccccacccttcctcccgccgccggccgacgcgagcaagtcgtagctcccgcaccgcatctccagcgccaacgccgagccactcatcgccaccgccgccgcctttctctcatcccaatcgccgaatcacgacactgctgccgacgacgatggtgacgagttcgaggaggaagaggacgtgcgtagctcgtcccccgcccgccaccacccgtgcccgccgcatccagctcatctccgtcggctgtcgcccgtcttcaccggcggcgcggagcggggcggtggctggcacagcacgcaggccggcgaggaggtggttcgcggatccggcggtgcagagcggggcagtggcggacgacgacgacgatggtgacgagttcgaggaggagcaggatgcgcgcagctcctcccccgctgccgcccgccgctcgtgcgcagctcctccccctgcgcgggcatggccgaaggccggcttggagagcgaaatgtgggcaagaagaggagaagagagatagaagatagagatgacatgtaggcccaagggcatttttgatatttcacgcgatttcactctcctcttcaaccgaaaattattattttaatcggcgtggtgtccactggcaaattaccacgtttatggagtgttttcccccaaaagtgagtttgggcagggctctagggctaaaaccacatataaggagtgtcctgtagcaaaatttcccttatataaatcttgtggtgcctatcagcaatgtcacgtatttgcgatgtctcttaaccaattacaatacttataatgttatgcaacaaattttatcaagaagaacacagtcgtagcactagtactactatgataaagtctgagctatagaaaccaatttcttttggtactaaaggagtacatgaaatggtctgccttctgcaacacctctcatcatctataaatacccgggacgtgcgtgctttcccctacaccaccactagccaaagcagcagtcaactgccgcatcgatcacatcacatcaaccagtaatcaattgaccaagcggttcttgcgcctagctaggtagctcgagcaatggcgaagtgggcggcggaagcgacggtgatggtggttctggcggtgacggtggcggtggcggtggtggcggcgcaggcgccaccgccggtgcagtgcgatcccgggaagctgtcggcgtgcgcggtcccgatcttctttgggactgcgccgtcgaagtcgtgctgctccaacctgcgcgcgcaggagaaggacgggtgcttctgccagtacgcgagagacccgatgtacgcgtcctacatcaatagcaccaacgcccgcaataccatcgccgcctgcggcatcgcctttcccagctgctaggctagcttcgatcgccatgatgcatggcgtatattaaatatatggtgtgtgcttgaataaaggatgtgagtttgaatcagtaagaactatcgatcgattaatgcacccccgtacgtacgtgtttgatcgatcgatcagctggtgtctcctgactatttaagtttgagctaatttccgatcttgtgtggtactatcagtagtagtactactacactactactagtactactactataaacaaacatatattttttatgtataaaaaaatatacacatatacaaattttgtatatgatgtgtgtcaggattacggataaggtataccttctacccttggatttatgctgtataccgatacggtatacctgtgcgtacacggatgtttcctttactcattaaggaaattcatcgtgtaacagaaacgaaatccacggacggaaggagtcctactcggactgaactgggtcgttactgtatcgtggtctgatatctccgagttatacttggagatcaactgacccgcgatataaaagggacccccggggggacctaaggcatcgaatctcatcgccaacacaaccaccacagcctgcgaagtcggatcctacaggagccaagttgccgggtgatctagtcgaacaactcgactacagtctcgtcggtatcatcgagttctactattccctttgtaatatgtggtttccattatataatcccataccaactggattagagctattacctattaaggggtctgaaccagtataatccctatttcttgtttgcttgatgtcgtattacatagatcttcgtaccagcgtaccccaataccctctatatccgatctacgagtatccatcgtcgacaatgtgtataaactttatatacgatgtgtacaaactttatatacgaagtgtgcaaactatgtatatgtacgtattaaaaaaccaaaaaaaacatcatatgtatacatatacgtatacaagtatacatactttatatacgtatgtataccaagtttgtacatacgtataaaaagtttgtatacgtatatgttaaaaaaccgagaaggaaaaaaagaaagaaaaaaccagaaaaaatgaattcaaaaatgaagaaaattttctgcgcatacaaaatgtgcaagctcgataacacatgattaattaaattttaattattatatatatttaaaaatgaattaattttattttttaaaaacaacatctatataatttttttaaaaaaacacactatttaacatttaaaaaacgtgctaacaaaaaataaggaagttaaccatttaacagttttaaaaccgcactagcggaaaacgagaagtttaagtctcaagttgaagaaaagaacgaagccttagtcattgtctcgtacctgcaatgcacgacacgtactctacaggatcgctgaacatgacagcgccaagaagaaaggatagaagaaaggaagaagggaagtggaactagagacgggcggatgcatttggatttttgtcagttcgtgcagggagggcatacgcaagtgttggagggattttcgtttacgtgggttgaacaaattgatgtcaacattgtagctatcgagagccaaagttttgtgcaccttctgtgaactgtggcttcgaactagagctagagctgtccttaacattcatctacctcgatgaggactctgttcttagagtttgatgtagtcttaaaatgaaagaatttcatagtattgatctgagctaattcatatttttgtaagatctatatgtgttataaaactagctccgaaatcgacattggtagctaaacgcggaagaaacaccataggagatccaaacacgataatgacaccgagacacgatatttagtaacggagttcagccgcagcctacatcttcggggcactgattacaggtgttcctcttcgatctagcatattacagtgtatcagagctacagcgactcacggccggttgccgccggcagctgctccctctcgctatgctaagttgccatgaagttacaacaagcacacccttctacttatgagagatcctaggatagagtccgactcttactctagtcctaatacctattacaactctaagtcctaaactttaaccgactttgtaaacatattcatcacaaactctaacaaactccacctaacactaacaaacttcaccttgacaaatatatcacgccaacccgaatctgttacttgctcaaacctccgttacatttccagccaacacagtcacctctcacctacaaccatagtccccacgtcttcgcctggtcgtggtcaagatctggacgctggagcttgcctaaccgccaatgcccctagaaagctgccaccgagagcctccaccgctgtcatctccatccgccgtagccaaaccgaccatccaccaccatcgtcatgtgcattcgactgacctgccatcatgaggggagggctagcccccaccgctgccagtgttgccaaccctcaccacgggtgacagtgaagggacgaaggactagtcaatgtctccacccaacggcaccgccgcccaccaagttcaaaggtgacagtggaagggacagcggactagcccccatccccgcccaacactgccgtctaccaagtctgccaccaccgccagtcctctcactgtcgatgagagaggaagggacggcgattagatggttgttactagttgagatgaacaagtatgtagagaaattaaataaaagatagttgtaatttgctgagataaagaaagtaggtgaaaattagctcaatcttggaataaattttgaatgctcaagatgggaaatacatcacctgttctttaggtggacataagaccaccagtaaagttatggtggtgaaaaaggttgacagttggataaattttcatggaaaaaaagagtatattttccttttcgagtagtacggaacactcttttgaagactgaggaagaatgcattttttttctccatgcaaattggatgcacgtccacacactcacacaacccagaactgctatttttggtgcatgcatttccagtaccatacgcactacagtttacacacgtttatatagacgtgaagagaagtgtgtcgctcatcgtggttttatcagacggttgttttatctatagtccatacgatccaagtgtttaaatttttggacgattttgtttatgagaaatttgagttgagaggtcgatagacaaacttgaaaacacaaatcatcttagaatacttaactcttaaagtagcatttcacgctcccacaagattagaaattcaaaactcaaacttaaatcccagaagatacctgatcgatcgatcaaacacgggtgcattaatcgatcgatatttatgtattcaaacacacatcctttatattattcaaatacacagtacaccatatatttatatatgtttccacacattgtcctttattttattcaagcacgcagtacaccatatatttatatatgttgccacacatcatggcccgcaccggtgaacggcggcgacggagcctagctgcagttgggaaaggggatgccgcaggcggcgatcatcttgcgtgcgttggtgctgttgatgtaggacgcgtacgtcgggtctttcgcgtactggcagaagcacccctgctgtgcttt

SEQ ID NO: 56030 - DNA, 1507 bp, Oryza sativa
  unsure (1)..(1507): unsure at all n locations
cgcaaccaccaccagcagaagcatctccatcgcagccgcccacttcgccattgctcgagctagctagcgcaagaaccgccgcttggttactagccgaatgtgatcgaatgtgatcgatgtggtgtaagggaaggatgcacgtccccggtatttatagacgagatcgaggtgttgtagaaagcagaccgtttcgtgtactctcttcataccaaaataaattgatgtgtagagtttagactttaccatagtggtagtagtactataactgttcttctttagctgaacggaggaagaatgaatgaagaagaaagagacatggatcctctcagtttcgtgcattttggatactcgtatttttacatatatgggtctctttgactagtaacagtgggtcgatatgtacacgtgcagcaaattggtgtctgccaaattaattgaatcacaacacaagaacaggatagcacccaagaaaatcgtccaagcagatgtacaagactgcacgcaggcatccattggagttcatttggtcatcttatttgttttttcgtggacacaggaaatcaattcaacactttttacacattaatatttgtcaagcttaatttaaatgttgttcggtttgaacgtcatagtcactccacctgtttttaaaatatagttgttatagactatcaccgtgcaaaatgtatcaagcgtatatgtttatagctccattttctctctcggtaccagcgacgtcgtcatatccatgaacggtggttgcttgagcttgaggagcatcgccttctcgagaacgccctctcgatgtgtatcttcttcttaattaggccctgttagttgcttcaaaaacgaggaaaattttctgcgcatgcaaaattaagaagctcgataacacatgattaattaaatattaaattttacatatttaaaaagaattaatttgattttttttaaaaaaacttctatataatttcttttgaaaaaacacatcatttaatatttgaaaaaagtgctaacgaaaaacgagaaagttaaccatttaaccgtttgaagaacgtgctaacggaaaacgacgaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 56031 - DNA, 14382 bp, Oryza sativa
ctgcaccccttctactgttctgtggtaacagatggcttgaaaacatacgtgattggtgtatttcaagacagctttggtggggacaccgtataccagcttggtatgtaacgctagaagatgatgaggagaaagacataggttcttacattgatcactggataattgcaagaaatgaaagtgatgcaatcctggaggcaaagcagaggtatccagggaaaaattataagttagaccaagatcctgatgtgctggatacatggttttcatctggtcttttcccattgtctgtgcttggttggccagacagcacagctgatcttagttcattctaccctacttctgtacttgaaactggactggatatcctcttcttttgggtagcacggatggtgatgatgggaatgctacttggtggtgatgtgccatttcagaaggtaatatttaggttatttcattcttaaatagttcttggtcaaatctgttagattctagtgatagtgatagttcagtatgattgccttctaaaattatttgatatcattttaagtttggtaacttagcttttggtccttgtcgaatcatgttaacttttctatgctaaaaatgaatcaatcattaacacgcggttagaaacttcacaagtactagtaatttttaaaccgtgactcatgactgcttatctgtctcaggtttacttgcatccaattatccgcgatccacatggccgcaaaatggcgaagtgcctaggaaatgtcattgatcccattgatgtaataaatggtatatcacttgaagatctcgggaaaaagttggaacatggcaatcttgatccaagtgagttagaaaaggcgaaagaaggtcagaagaaggatttccctaatggcattccagagtgtggtactgatgcccttcgttttgccctgatctcctacacttctcaggtaaattttcccaccagcttttgttgttccttttactgttagtaaaaatttcttgtagtaacatttcttgtcttgttcagtctgacaaaataaatctggatatcaagagagtgcacggatacagacaatggtgcaataaactgtggaatgccgtccgttttgccatgaacaagcttggagatcaatacactccaccagcggctattgcgttgtgttctatgccacctctctgcaaatggatactctcagcacttaacaaggctgttggcaagactgtttcatcgatggaagcatgtaaattctccgaggccacatcgtctatgtactcttggtggcagtaccaactttgcgatgtatttatagaagccgtaaaaccttacttcaatcaatctcaagagttggaatctgaaagaggtgcttgtcgtgatacattatggatatgtctggataccggtttgcggttgctccacccgttcatgccttacataacggaggagctttggcagcgccttcctcagcctaaagaggcttgtaggaaagattccataatgatatctgagtacccctcagttgttcaggtaaatacatacttcgtactgactttggaaaaaaaaatgaattcttctagcttgtaacttttcagagatcagtatggtagagtcctattgcataacgattaaaagcaaaccactgtaaattctagcactataatcaatatatgtaaaaatgatgaagaaatgattaatgcattgtctgcctcagttggagagaccatagatttaagaaattctgcaatcctatgaaaaaaaaaattctgcaatgcctattttgactagaggttttcttttgacggatgacaggaatggacaaatgatcaagttgaaaatgaaatggagactgtgttggattctgtgaacaagctaagatctcttcggccacatacagatatacatgaaaggtatgcttatgttcaccagatgtatattcttttggtgtgcttcaagactgtcacttcctttttatagttttattcttattttgattcataagaatttgttcattttgaagctaataccttctgccctattttcatctggacagacggcctgcttttatgctctgccgtggggtagacattgctgccattattcagtgctaccaggcgcagatttcaactcttgcttctgtttcatctcttaaggtttgctcggtcttatacctctctggctctctcaactcggccactcacctcaagtcactgtttatgaatgccttgttcttgatggataatggcataatttctatttctatttcaattcaattcactcgagttttgtctacagatgtgcttatatttttgctaatatattttatgtctaaaatgcctaaaaagccaaaaaaaaaggagggaaaaaactgattcaaagggaacttttgcagatactgacagaggatgatccaactccacccaactgtgccacaaatattgtcaacaaagatctatccgtatacctccagctacgaggagctctaaacactgaagctgagcgtgagaagctaaggaaaaagcgagatgagattcaaaagtaagtgccctgttaaaccatctgaacataaatttgaacgaaccaatttgaacataaatgaaatttgtagttttgttagtggtaagacgttctatttcccactgtaattgcaggcaacacgacaccttgtcgcagaaaatgaatgcctcaggctatcgcgagaaggctcctcagagcaagcaagatgaggacatgaaaaagattgctgcattactggaggaacttgagatcattagagaagccgaaagtgaactagaatcaaacaactgaaagggttttgatgtataactttttaatgacctactgtgacttgtacgaacgcaggtgattggcatattttatgaactcaagcaagctcgctttcagcttgtagggatcaagaaacacttccactttgtaaatccattcgttctttatattttaaaggaatgaaaggaaaattttctgttgatgtccatcataatttggccttctcttgaccttttgtttaaactaggtctaggtcacgcgcttcctcttctccccctccccatccggccgtttcaggccttgttaggttacatggccaggattcgttccgggccggaaataatagaaataatagatataacaaaaaatttataataggtagaacaaaagaaatttatagtaggtataacaagagaccaggatttattcatggtcggaaactaatatactcatattaagtacaacaaaacatccagattagttccatactgacatctaggccgtgtttagtttcaattttttttttcaaactttcaacttttctatcacatcaaaactatcttacccacataaactttcaacttttccgtcacatcattccaatttcaaccaaacttctaattttagcgtgaactaaacatagccctagattagttctatacgcgtgaactaaacacagccctagattagttctataattcttggctagtggatgattctttctatacttcttagctagtggattgattcccgttctcttatttcttgctagtcatttccggcccgaatttgaatccgggcataaccgaacaaggcctagggatccctcgccgcgtgtccttccgcagcgtgccctccggtgatgccgccgcatgaagacaccctcgatgccggcggcggcgacgtgctcaccttcaggctccaccccctcgccgtcttgaaattatccgaccgcatccgcgagttccagtaccaggcggcggcggcggcgcgcgtcagttacagctcctcctcctcctcgtcttccgggacggcggcgccggaggatcctcctcctcctcctactcggatgtctgggtgcgtgatcggggttcggcgtggtgggacggtggatgtctccgacatcttggacatcttgatcttgcacggccccgaccccgcaaccttcgaccgcgccttactggagaaggatcaggagatctgtaactaaagctgctagctacccccaagtcctcccgtcatttttaggatccatcgattataatttgtgggtggttaatttgatttgtgtttcttgcggttcagacaagaaggccttccccgacttgtccgttctcgggtggtactccattgggaccaatgtgcacgccaccgacatgggaatccaccatggggactacaccgacatgcaaatccaccagacagtgagttttttttataaccatttaaatcaactctatttgttcgagtgctaaatatatcacactctcatttggcttgtgctttagtgtttggtcttattatgaacaaaatgtggggtattcgggtgtaattcgctgttagtatacttaccactagttgatggtagttgagatgttcagtggacaacaattctgatttaatgagtggagtgtctgctggaaatcctgttgcgagaacacccttgccccgaaacgccacgtgtccgagtttccctttccgagtaagggcccctttaaatcacaggattaagaaaatctagaaatagaaaaaacgtaggattttgataggaatgtaagtgtaaaacagatgattgcaaaacacaggaaaaacacaggaatgaccgtttgattgaaatacaggaaaaacgcaggaattggatgagagagatagactcaaaggaaagttaccaggaggttgaaactcttgctaaattttctccaaaatctctataggatttccattccataagaattttaaaggattggatatgattcaatcctttgtttcaaagggcttcataggaaattttcctataggattaaaatcctccaaaattcctatgtttttcctccaaatcaaaggggtcctaagctttgttagacacgtgcttatctacacgtagagaaagcagctattctgttgtctagcatgaccatgcatagctttagcacagctttagatgagttttcatgcatttttttctaccttatgaatatgtagtctgatagaaagtaattgtgtaaaagttcttgatatgaatgttccgattgctgaatacaattcatattggaagtcttttaaggcatcacccaaagctaactggctacctgctgaaagtttcttttcatcctgttggaaatcgcctaatagaaagtttcaccgttgaatgtctcctagtagaaagttttaccattggaagtctcctaatagaaagtttcactgttgaaagtctcctaacagaaaattttcttctccatataaaatgcattttttaactttgatggaaatctgcttctactcttttcagaaccctaagtgaaattgattgattacacactaagaaaaagcaaaataaattattttccatgcaagccaagcagtgaatttgtgtattaaaaaaaatcccagtggctactggtttgaatgcaaacaaaaaaaaaaggcgtatcatgaacttagcttgcaacaagaggaaaatgataagagttccttgctcatgcaaacactcacatccacgtaccatatttttattcaatccattatatttcgcatatttatacttacaacataagttgataaagtcttttagtgcttgtggaaggttggggactccctcattatagtatgcgtaaagtgcatagccggtccctaaacttgtacgactgagtcatttgagtccccaaactctcaaaatgcatatatccaaatcccaaaacttgttaaattgtgtcaatccgatcacaaactgccatgacacctccaggatcctacatggcatgccacacggacgatgatgtggcagcatcacaaattctacaccaactgacaaatgggccccaataaaaaactttttttaatatccttttctgttcattcccatcttgtcctttcttcgtttctcctcttttcttcctactgcattgaccgtagccatggcctctggtcgagctgcctcttcgatgacatgaacagcggtgcgtccatgggcaagaaggcaccggcgcgacagccgtgtcgacggaggcgctgcagcgtgtgggcagcggtgccagcgcggtgatggacgcggttgtgtcctgggcatcgaggagactccggccgggagcggcgcgactgcgtgtggctcggcacgtttaccagcgaggccgaggcggggcacgcctacgatgttgcggcacggcagttccgcggccatgacacagtcaccaacttccgcccctcgtcaagtctgacccgaaggctgccgtcgagctctgtttcttcgcctcccggtcaaaggccgaggtcatcgacatgctccgcaagcacagctacctcaaggagctcgttgttgagctcgcgacgacgtggcggcggcggcagcagggcgagctcgtggcaggagcgcccgtcgcggtggcgacggcggtgcgaggcccacggcggtggcggcgtcagccgtcggcaggagctcctggaggtggtgctgtcggcggcggtggctgccgacggcggccgcggtatccggagcgtccacagcggctcacggccggtctgggtgtggccgagtgttggtcggctagcaacgtctgttggcgacagcggcggcggtgtggtcgtggcagttggcggcggcggttgctagctgcttggtggtggagggcgacggcgcagcggcggtttgcggaggcggtggctcgcgtcggtggcagcggcgacggcggccatgactgtggaggcagtggcgatgtcggcggcggggatggtgacggcgaggtggctgagcgttcggcagcagcggctgcggtggtggtgaccgtgtctgcggtcatcagaggcatggcggcctcggatggcttgccgagggcgtgggagacggctgcaactggccggcgcggcatcgtttggtggaggggtcggagaccggcttggcgcagagaagcgcagccgatggcagcggaggccggctcggcacgagaggcgcgggcggcggagatggaggccggcttggcgcgagaggcgcggccgatggagggaggccggattggcgcgagagacgcgtccggcagaggaggctggcctggcgcagataggtacggccggcggtggaggaggcgacctaggtgtgaggaggagctgccggtgggtgtggagcagtctttggcgcacgaaggctggccgccggggggtgctggtgcaggggtcccacatgtcggcagagctagtgttgtggtggagcattggtgcgtcagtcgtggattcgcaggtggtgagcggtgggtgaaaacctagtccggccttggccggaccgacaacgatggttcattccccctcctgagggcgttgtcgtgctgtctcacccctcaagggtgtttgccgggtgaaagcccagtcttggctccttggagtcctgatggacggctgtggcggtcttccgtcgcttctcttcttgaagacgtcgttttggcatccccttgggggcaatctcatctgtgtccctttgttggtctagtggcggtcggtcccgcttagcggcggccgttccggtgctagccttctcctaggcttgtgtgttggtgatgtcggtgtgtgggtggtggtataattttttctttttcctggctacgaccctccagggtcgtaatcttgtattttttttccctgctctatcaatagaacttcacaccgtctcgtgcgagtcgttcaaaaaaaaaacaagtgcgccttcacctccatctcccatcacctgttcgacaagatggtgatcccgaagcaaccagaccccgaagaggccacgtcgccgcctgccaccgccgtcggtactggtgttgcgcatggtacacggcctgctcaagaacggcggcagtggcgttgtcgtcgccgcgagggtggcgaggttggtttgccgttgcgcttgccgtcggcggagccgttctggccgaagcttagggttattgccgctggctttgacttcggaattcgtcgccatcgtcgatccttatccgaaattgaggtctctctcatcttctccatgccaaactccctccttcccctctcctccccgtgccgtcctgctgttggagctcaccggcaaggtacccgtgtgccgcggtgccgcctacctgttcggccgccattgtgtcagcacgatgcgccgccgctaggcgtccccgcccaagccgagaacacctccaggctccagctccaagttgacgccctgatgctcctaggcagccagccgtgcccagtcggaagctcgccggagcgccgctacttcgcatgcccccgccgcttgtacaacaaaaaaaagagagagaaatagagaagagaaaggaaaaaaaagtgaaaggagaaagagaaaaaggaggaaaagagagtttttaagtgggtcctatttgtcagtcaatgtataggtattgatgaggccacatcagcgtccgtgtggcatgccacgttagcgccatgtaggatgccggaatggtggtggctatgttggaccaaaatgacatactttagcaagttttgggacttgaatctgtattttttgagttcggggacccagatggcacaatgacacaagtttagggaccgggtatgtagtttactcttattattgatggtcggtaaccacttgccataacctaatcaatgtaaacacattttgcttctaataaggttgtattcaaagtttaacatttgaggatacaatgttcactcctgtgagaatgaaaactgaaatttttgatgaggtaacatggcattgggatatagttttagcattagtttaagttcttggagagtctgagtttaacaagtatgcggaatgattacggctgatgaaatagccagcaataattgttatgttgggatgtacactgttcttaaactttatgtagagctctagcttgttttgttggatggatggaatggtggaaattgattttggctgagaatatatggttgagagaatatttgtcaaaatggatgtttgtttgatctaattttactccctgcataacctttcccttgtactatttttatgtagttgatggatgctaatggaacagccttttatcttctattaaatcctgcaatcaacttttcccagaaggatatccctgtgactatttatgaaagaggtaagaatcattgaatgtatcacaatgtccctgcaaaaaagaatgtattgatttctcttgatccttggttccaccctgaatcagttatgatacttgagggggtttatatgtgctgcattgactgtcaaggtttgattttgcgtatgtatcagatatgcatgacttttgtgaatctttcctcgtgtgtaaactaccaagtttagcattcaacatcttagtgaattgcatgctgattaactttattgtttagagcagcaaatgatagttatttagcgagctgaagattaactttattttgcttctgcaatttcaagtgttgtgccattccaatgggagtcccccggtcatctttgtccaaggaaactatacagttgaagtttgtattctccccatgtgtttgtttagttacaaatactacttacaaacactacaagcatgttttattgaagattgtaggggtagagaggatatctttagaccatgctgattttgtctatccaagtccatgcgtagttttcgatgttcttgcgccacctcttggaaaagagtaagtacaaattttatttccttcctatgagatatgacttgaatcaccttacaagtaaatgtgggatataaaacttcacaaacaaaacaagtttaatactgtggggctgtttggtaggttcagtgttttgggctgtgttgcacagccccaccatttggctagagtaggcatagctttgtgctcgccatttttgaatgcgaacaaacgctgttgcaggtaactactttgtgctggctacagccgctttaggctctgtaaatatagatttgtttcctcttcttgtcacatatgccttgaatctacggaaatgctatataccgggatcccgtcgggatgggatcccttcgtccccttgcctaatccaaagaggagtgagagctgagcgcacgcctgagccatgaggaggaggtggctgcccgcgaggacctccggcgagggccggggaagaggacccgctcgacgagaggaggacgcggccgccagcgacgagccctgcgcagtgagctcgaggaccttgtctgggtcgcgtcgaggcaatggcgcgtcgcggccgagccagtggcaggggagacatcgacgaagagagggagggcggctgcggccggagctacgggaggggcggctgcggccggagctacgggaggggcagcggcggtagtagccggagttgggaaagggagcggcggcggcagtcggagccatgggagggaggggcggcggtggtggtagccgggggagggagcggcggcggtggtagccggagccaggggagggagggacggcggtggttggagttacgggaggaaggggtagggcgacggcggtagccggagccgagaaagggagcggcggcagtggctagagccaggggagggaggggcggtagtggttgttggcgtcagcgccgggtaggtgtccggcttctgatacccattagaaatcacctgatatctagtaagtagcgcctgatatctcataggtatcacttgataagaatcgtatgataccttacaggtattacctgatacttcgcaagtatcacatgatacgtgataggaatcgcctaataccttataggtatcaggtatcacctgatacctcgcaagtatcggcttatacctaacatgtatcaggtataaccatcaagtatcaagcaattcctaccacgtatcagggatacttgcgaggtatcagatgatatctatcaggtatcatgcgattcttaccacgtatcaggtgattacttccgaggtatcagatgatacctatcaggtatcatgcgattcgtaccacgcagagggtgatacttgcaaggtatcaggtcctgatacggtatccggtatcgggtgatacctaccaggtatcgtgcgattctaccacgtatcaggtatcagacgattcttatcacgtatcggcgatactcgcaaggtatcatgtgatacttatcaggtatcgcgcgatttctacgacgtatcggggtgatacttgcgaggtatcatatgatacctactagatattaggagctgggcatcgaggcgtcgttgccggcggccgcgtcctcccctgtccacgctccacaccgaacccgaacctcgtcgccggcagccgcatcctcccccgtccacggtccacatcggagctcatcgccggcgaccgcatcctccgtcgggagctcgtcaccggcggccgcgtccgtcgtccacgccttagccggcggccgcgtcctccacgccgaagctcgtcgccggtgccgttgccatcaccacacaggatcctccaccgtccacgccccacgtcagagctcgtcgccggcgccatctttatcaccaacaggatcctttgccgtccatgcgaccatgccccacgccggagctcgccggcggccgcgtccgcgccgccggtgtcagcctcgtctgcgctactcccacggaggcccgcgctctcgcgtctgagggaggtggagagggagcgatcccgttgggacagtatcccaacgggattccggtatatagcagccccctgaatctaaattactaaatttataaaatcgcaacaaaacaggctaatttactaaattactttggtcttgtacttgcagaaaaaatgcatttaggacgatgctgtttgaaaccccttcgggatttgtaatgttccgtgtttcagatgttttgtttagatatcctgaggtatgtataacttttcattcaccctagtgtgatgcataattcatttttcttcttttttctctgttacatttaggccctacaccttatctgattttcctttccttttgtaggacatatggtcgagttttactgatccacgtaccgcacaccaggtacattttaactcctaaatttcctttcatgctttttgtttgtttatatctatttatcgatttattgttttttgcacctttactatctatgtacatcctaaccattactgttttatttttttttgcacctttactgtaaaagtacatcctaagccaactaattattgctttattattttttgcatcttaactgtacatgtaaatcctaagcctttaaatgtgtttcatacaattctatttgtatgtcatttgttctcttggttttattaagatcctaagcctttaaatgcatctatttgtaggctgttcgtaccattggttttattgaggttggtaacaaatctcttgtatgggataaggatattggtcctggcgaggatttagaacaatttatcctaaaattcccaattacaaaatcattggttgttccaaacgcacagcttaaattcgttattgagaaaaaacttggaagtttacatctaccctaatgtattttaatgttgatgtttatttaatttttttgttagtgtggaattattaatgtttccctgttatatatttcttttttcagaacattggctgttggtttaatgggcgtattgttcctgagttgatttggggactaaattatgccctggatgaatttgtgcctcaagagaagggcaacctatcaaatgaatgccattttccactgagcaagcaattgcatgagcagttaaaagcatatggatttagtatctcaccacaattagtatgttttctcctttgctaatattgttattattctctgctgaccatccttttattgttttcttccttggtctgttgtgttaccttatttatttatttattgttttgtgttaccttatccttttattgtttaatcccttaaaatatttgctactgtactatctgttgggttaccttacccattattgtttaatcccttgcatatttcttgctattgttgtgttgccttattattttatccttttcattttagattaacagagagtttataaccagtttcggttacttaaattatctggaacgtacttcgaagaacatttccggggatttacaccagaaatttgatcgtttcttttgtggacttgagatgtctgagggagtgtttgtaaaagttgttgcggaccgtctctgttccatggaggtcagtagatttgctaaaagcaaatagtactaataattaagtggtggctactgatgaacaatttattttctttgttttctgtaggaagtggcatcaacaccaggcagacgagaggcattgagcaacgctgaatttcttttgacggttcctaagaagaagtataacacattatctcgtcttaagcgtatggaggcagaagttaggggttcagggccttgggttttcgtagctgtttttgcagtggccttcggggttatggaaggattgcgcattgcaatgaagcgagcaaattagaactgggtaataggaccaatgaggctaaattaggatccgtatatatggtgacaacttttgtgatctaaagtgaccagtaaacaagtactgttttaccaccagttcatatattcattttttttttgcataaataccaacacgcgtcatttactctgagaaggcgaaacgtggtgcacatgcagtgggagaccaggaggaccggtggggaaaccggacaaaaaaaaaggaacggttccattgctcacccaatcgaggagtttctgcacctgcatagtacatggcacacctaccgaggagccgaaaaaaaattcaaaaaacagagccctaccaggctttactatcttattattactctagtaccatcctcttttgacactgcaaatgctaatgaaatttcagaaatcatgtaggtttcagaaaatcccagaagaaaattcataaaacacaggggcaagactgtaatgtagtagatgggtttaactaatatgctctattttttctagatttctgtaacgtaatgggtctaactaatctgatctctttttctagatttgtctactaattgctgatacaacagcatgtactgatacacatactgtaagatggtcaacatgaatcaatagaccgttcactgacagttcttctgagcacatcaacgtagggcaaaatcctctctacatcaggcccataatacagcgagaatatcgcatctgcccgggcgaatgcagcagccgcgcttgcgccatctcccatggaaagctcgatggagacgagcttgatcaactcgtgcgcgatgatgatgtgcctggggtggtaaagcttctcaagaatctgcatcatcacaggagagggtaactcagaagtcagaacaatgaataacagatgtttctatagtccctagaagggcgagtgagtgactccgagtgatgatttgag

SEQ ID NO: 56032 - DNA, 14389 bp, Oryza sativa
  unsure (1)..(14389): unsure at all n locations
tgttccacactacacataacatcaccactaaatccagaaaacccctttgtcagcgccttgactccatccatggatttcatatgaacaattgcaattgagttgactttaatttgacatatcaaaagaaccaactgcagatatagttacaagaattagcttcttcttcagtaattataaataaatatgaaaatagtgttccatcagttctctacaatctacatcctagggggcagaagtatatggcagaattctgaaagtttaagaaatactccctccattccaaattgatctacatatagtatttttgaggttattcctaaatgatctacatatttgtgttcattcattaagcctattcgttatttgtgcattggagtaaatggacattgatgcatgcatccatgcacacaagtataacccacatgcaatatcttgatttgctattggctaagaaatagtggggatagtgcatgcatcaagtttgatgctagagtaaatatagtatgagagagttattaacttttcttggtcttagtgtacctatgaaatatgtagatcaatttggaatggagggagtactgagctaatataaacaataatgtcaaatctgatatccagaacaatccaaaaaatctgactaaagcagccatcaagctcaagccacagttgtaatgaaacaagcaattgaaaatgtaaacatacaaagggaactcttgaggacaaatgccacatatacctgtgataaagaatcctctgcccacgagacacctgatttataatagctctggaggcataagaacaggacagttgcatatatatgtgactcaaatttgctagcagaagaatcttgatcatagtggtgaacgagatcctgcaacagtttagttcattagttcctgatgtaacagtacttatgctataacatttgagtgcttgcagacatgaattctcttataccagatttggaccagagatggtagatctctttccgaccagcaattgtttctctatgtactgtgccattatccgcccagctaaaactatatcagctggcaaaacagctgcccaacaggcacctccacattcatgcctatgttcagcaatttgtttagagtctggagtcttgctctttgtagaagttacactcaattttgcaatatccaccacattattgttagattctagatgagtattttgattacaagacatttgtcctatagccttctcctggcacctgtttgaacagtaaatgggtattgtacatgaagggcagactacgacatctgctggagcttcactaaagcaatagtggcagtgagtatcccggcaagatttcatgatnaatctggcataccnaaaaaaaacccctttgggtttaaacccaaaaaaagggtgttttaaaaagagcatatagaacttcagttcaagattacaatagttgactgattatttaacaatgctcatagagataagctactgccctggcataataaaacagtaaaaatatactataacttatcaaatttcatatttgactaggacaaagatctaatgaaactcagtatagctttaggtggcacgtaaaaaactcatttggcataaacaattgaggagatgattcttgatcataccacagcaagaggatcctcagcatgaatcagtgaggctggagaaatatcatttggagacgacattcctctacctttgttgggtgtagaggtacattctagaataaccttaggctgttgctctgccatttagccatatcgttcacttagtatacatacgtacctaacctttttgaatactaaattggttgtctaccatcattaccgacctgtatgtggcatatctgcattgatgcaattgctgcttgctgtcccaacttcattcacattttgatgcttttgtaaaatcaacttcaactcttgttctatgttactctttccagaagaggttacttccatgctcaaagcaacctccaaatcatgtatggaagatgaatagttcctaaaagatgcatttaccatcccccttctgtaccatgcctgaaacccataaacagaaacaggtgaaatcatcagagtgacttagtttccattctttagagtgaaatcctgcaaatagagacagaacaaacaacccaagcatataagatgcattcaacaaagttcccaaaccgtattgctaccttagcataattaggtgaaacagaaatggccctgtcgcaatctcgcagacactcttccaaaaggcccaatttctgtaaacttcagaaacatgatcagaacgcatgcactatccagtaatgaggtcagatggcaggaaaaaaatccttagatacataaaagggaataagctgaatataacctattcacaatgcactgtttaccatgaaacaccaccaagaactagaacattacatcaatatgtccagaatgcaaacaggtaaatgaaagactcacatgcatggtagaggcacggttgacatataatgtggctatcaagcttgcatccgttccatcaggactaatcgggaagtaccgtaacgcctgtaacaacagagaaaaacaattagctatcatcaagactgatagattgaatatcaataaaatgggcattgtcccgtgccgatttgttccaaaaaaaaaaagacagatagattgcagtccacacacataaatgctagtactgaaaaggagtgaggatcattttcttttgcaatatcaacgcatcactctttaaaaaacagaacaggtgaacaacaacaaacttcgaacagtaaagttacttctgacttctgaacttgcactcatttttaccaatcgaatcagaacccatcacttcatcacctacacaatccaagcaatcaagaggaagaagaagaaaaataaacgagtaacacaacaaatcaacctgcgagtagaatccaagcgcttgctcgaactctctcttggagaagcacgcattccccttccccttcagctcggccgccctccccttgtccttgcggcacagcgcgagctccgggtcggtcagctcaccaatcacctgccctcacaccaacacgccacgcgaacgataccatcaaatctagccgcacccccccatgcctgggggaagaggaggagcagcggagcaccgagcgacgggaggtggttacctggcggaagagagggagagcttcgaggaaggcgagcaagcgggaggtggtggaggggaggtcggccgccgtgccctcgccgacggctcgccggagctccgccggcaccgccgacttgagccgctccatgggcgagggagagtgtgtgggctgtgggcagcagcacgcggcgctcgggctttgagcccaactggatgtattgagcctacgtgggctgagatgtgggcacagtatagttgggccttttgggcagaggctattcgtcccactacgacggcccaatgaggtgtgcagcgtagtttggacttttcatttgggcccctgaattgacaagtattctccatttgggccactgttgcattttcctactttgctaccttgcttggatgatggatataaatatacagaaaacctacaccacgggcttccgggacaactactatcactaaatatctagcatccttatcctcttctttgtctctttcccttccttctcccttctctctctctctctgactaccagcacgaagatgacgatggtggctagctgtgcggggtggcgcgttgggcgtggaggacgctcgtcggagccagtgcccgccgttgtccccgtcgccgtcgccccaccgccgcggggtcgaggcgacgacgaggagctcggcgataggtgcggtgaataagagggagagtgggagcgggacgtggaggccgctgctggcgccggggacggcgttgccgggcgggagcttctcctgtcggctcaagacctcggccgccgaggaggacgacgacggcgcggccccggcaagggtcgccctcaagctcgcctcccttaccgcgctgctctggctccccgccctcgttggtcttctcatcggctgccccaccttgacgaccatcggattcgccgctgcctcctcctccacactccgcctcgccgaccaccagattcgccgccgcctcctcctcctgctccaccacgtggctgccttctcctctctctctctctctccttctcctcctccaagttaccaggtaccaggtatcacggataccaggtacaaggtattaggtatcatggtaccagataccaggtaccagccggtaccagatttcaggtatcaaaggtatcagtcggtaccaaaggtaccaagcaccaggtaccaactgatacccaaggtactaggtatcaagatggagtgcacgtggaagcggagaggagtcacttaaattatcccgttacaacgggatcccgttttgtagccgctctcataaatatattataattataaccagtctcttatagttggattacccaccatggattagtctcttgtagttggattattcccccaccatggattagggtgattaaaccggacctcttgttgtgcaggcagtaaaaggtggttgtgtgcttgttgtgacacaacatttacccccaaatttagctctcatttgagctcgtcagctaattaaatatgtgaagatcaagttgctgcagttgatgattttgaattatggatcattcaatcatgggaaagagacaaagaatggtacactggtaatgatcggactttgagccgatttatatatgaggatcatttaaacatgggaaagagccaaagaatggtaagctggtactaatcggattttgtgagtcaatttatatatgaaaatttctgcagtggacaaaacacttggtactgctgtcataggagttctagaggccttcaagagcatggtttctggtcagcacggtagatttcatagagttgtggtgcagaacattctgaaaaacctatgtgcctatgccaaaccagacagtgactgccaatactccatgcagaaattttctgtagacaacatctcgatggtaagaacacagttttgtacctaataatttagctaaacagattaagatttgatagttgtgttgtttgatgcatacaagggactaatgtttatgctggttaatttgtaggcacttagaactatgtatcagacagacaatcttataggggaggacatggaggcctttcttggccttgttttgcagttcagcaaacttctctgtgagaccgatttcatcgaggctgtcaacggaaatggaatcggcttaaggaattttgtacagaagctgaaattaatcctgaagcaagcaaattcacatagaactgaagcaagcgtacaccctggaatcagaagatccgcaattgagcaggtcatatggatggcgcaactgaagcctgaacctcactgcatcgaccatttcatcgactgctaaatgcgggacgatctggtgatggcgcagcagacagccagaagggcatggcaagagaatttcaagctttcatctggaggcgtctctgtcctggagtacgaagagtcccttcgctctgttgcctcgagggcactgaagctgatcctcggtgtagggatgaaaacggtcggaaacggtcggaaaaaccctctaccatttccattttcattttattttctcgaaaatggaatcggaatggcatactcggaaacggtaacgatatcggtaatgtcggtatatcggaaacggaaccgttggaacgggaatctaccgatgtcggccagaagtcgaaaattcatgtcggaaacagcgaaccgtggtatcatcccacatttaactatatatgaagatggccttataatttcacctttgcatgatcacgctgccacaccccacaacaccgttatatgatgattaataagttgacaataaggtcgacaaacaatataaacaaagttcaacgatacttcaacatcaatgtggctaaagcatacaatgtgggttacatgataggattacagcataactaatattgtccgactttttttagatatagatttgagtcttcgagaacacggcttccttcttcggaattttgtcggaaatttgacggaaattaccgataaaaaacggtaccgacaaaacggtcggaaaaaagcccatatcatttccgctaacatttccggaagagattaccgttttcatttccgacaccgacaatttccgataccgactgaaacggtcggtgcaaaccggaaacggtagccggaattcttggatatttccataccgttttcacccctacctcggtgagcacaatgcgccggtaatccgcccgagctttctgccatgtaccagtagcgaccactcgtgagttcaggggaaatttcaatgcaagccttgttctgtttttctttgaagaatgtgttgaagtttaacacgaccggggcactctggttatatttgtgtttggagtaaacattgtaagccatatgtgctaaggttgttcaatttacatcgtatcgtcgtgtttcacttgaaaaaaaaaagagagagcgagaggaaaaaatagatctaacttctgattgctcatatatgaaaactcagcaagtgcacttctaggtcgctatcacgaaccaacacaatcacaccaaatttctcacacaagtgccaccgatatgttgcaaatccactcaagaatacaagtgctcaggaatacaatcaagagagtagaatcagggattgggaagagtaatatagggaaggcagaagcatgagattggaattagagaaatagaatcagaggaggtagagttggaggaggaagagagccatggcaaagccacaagttgaatatctgttcatcaatacccccaagaactgcagtgtggcttggttttatactcctccttgctgtttggttgggcctagagccagcccagcccatgtacatgacagtcgcttcctgaatacctgcatagtgttcatcaatctgggcagatcggtgagcccaacatctcacagtgaaccaagcctgaatctatttggttctcgttgcattgcatcaaacaactgctcgcaggatcgccggccacaggatcgagattagagagggaggccattggggaatgagagcaaccgggaggtggttgaaaggaagtagcggagccatcataagcgaaacggtatatttgtgaacgaaatgtaatttataagtaaaacttttatatccgtgttcttagcaatctaaaagtaaaagctaaaaaataaacttcgatgaaaagacctcaaaatcagcttcaaatttaaggttaaaaatttaaattttactccctccgtttcacaatataagtcattctaggatttcccacattcatattaatgttaatgaatcaaatatatatttaaattttactccctcgatttcatatatatggtaacattaatacgaatgtgagaaatgttagaatgatttaaattgtgaaagggaagtcgaggcagtctctcgccgtgccctggtcgagcttgaggaagatggggctgggtggctttacgtgcggcaggaaaatcggcccagtggtgttagatttcttgggctggatgtttctggttttttaatgcctgtttgattcgttgccgaaatcgacctcgccaaatttcgttaaatgcaaaaattagttaacatggtgaaaatgttgtttagtttgagaccatactgaaatttgatatggattggcgagtggaaggttcaggaataaccaaattttgatacgaatttataaggttatgagttatgacattaagagtttgtttggtttactgttataccaaaagtaattgtaacacctcaaaccagatacctaaattcaaggaaccctcacatttggctctttgcttttgggttgctacgaatggcaggcaacttcctccgtttcaggttataatactttctagtattgtgtatattcatatatatatatttagattcattaacatatatatgaatgtggacaatgctaaaaagtattataacctgaaacggaggtagtactatttgtttgggtggtcgttaccaacaattaattaatatcgatcatgtatttttcatttgggcccttgtttggtagtagcgatcatgaatgtttcatatggcctctagatttcaaccagtatttttcatttgggctaccagttgaatcgctatcagtggtaacgatgaagtgtttttcatgtggaccctggtttggatctagtataggtcgttaccttgttgttttttttttgttttttttttactccctgtaaattttgggggcttggatggatgtattacatgtgcaagaagccaagaactgtgggggttttggtggcctaaccgatcgtctcacacgggcaccgtgttgttaccggtcgataccaaaatatgggaccgatgtgggatgtcaggtcgcacagatgacggacacactcatgtaggtgaagagaggttgtggagaagcatcaagactcgggcattgttcggttggaagaggaaacttggtactgttctgggaggatatctggataaatgggtcatcgatttgttagttggcgccttccatctatgatgcggttcctgcgagatttcgcaatcacaggacagttgcagaagcacttctcaacaaaagatggattcaagacataactggtgccctgggaatgcaggctattctcgagtatcttagcctctggccagtgatgaagtctatacagctctcggaccaggaggattcgctgcactggagatgggagacgtcaggtgaatactcctctcggtcggcctatcaagcacaattcctgggtcgcattcgcttccagtccagcccaatctagaaatctttagcttcaccaaaatatcggtacttcatctggcttgttgcccttaacagatactagacagcagatagacttcgaaagcgaggacttccacatcctgccaagtgtgtcctttgtgatcaatgcgaggagagcattgatcacctgctgatcgtatgtccagaatcttgccagctttggtggatggccctcaatgcgattggacatgcaggatgcttgccactttcagattcgtctttccatctttggctatgtgacagcacgatgaagcaatgcaaggaacatagacggggatttgacaccattgtggctctggttgcttggaccatctggaaagagcgaaacaatagagtcttcaatcagcagcaaagatcctacatgtggccagtgcaatggcggcagaagctgaactttagcgacttgcaagattggcagtgccggagctgcgtttgtcggacggagacatttggtcgcaccatcagttgcgagattagctcctagtctttttattttcatgtaccttgtccccttcattgttttcttaatttccatgtaaataacttttattccttccaaagatgcactccttgcatattcccaaaagacttgggcattgtgcgaacgcttgaggaaatttttggatagctaatggaagtgttgtcaaatttttaaaagtagtggaggtgggtaatgttatggcactaaggtgctgtttggttcggtaaaattcagcccgcacccgattccagcgcaaacagatccggttcccgttgtttgtttgagatgctccgtaattggataccttggaacccattacgggcccagttcagaggcgataccgctcgatcaggagcgataagcgttaacgatacggagaggcaacacgagaaagaatcaagcgtcgcctccgccgctcccctcgacccacgtgtgagaaccaaacaaaatctaagtttgccgtaatctgattactatcacagtgctatctgatgtccttaccgtttacgtttgcaatctccaaccaaacagcacctaaagtttatttggtttgtttcccgtaccaaaacactttaaattaaatttaaggatcacgcatctcgtttggggtgttgtcaatggtagccaactatatatttagttgtctagagtcgctaccaataatattcatgatgtactagtcatttagggcctttgtttgggtcgttgttaatggtagcaatcacgaacatttcatcttgcctcagatttggactggtatttttattttggcccactagttaaatcactatcattggaagtgtcgtagcaatttcatgtggatccccctggtttcaatctagcatgggcaacgacccagtatttttacattttaaaactattggttttgggtggacttctaagcggtcatgtcacatggtacaaagttaaaacctattccgaaatggaaaaagtacgaattacccccccccccgaactattgcggtcgtccgaattacccacctcccgaatcacaaaaccgggcatttttcaccccccccaaccatgcaaaccgaacgaattacccccctcgacccaatccgcggtggttttagtccatgtggcgtacgcgtagcagtccagtcagtactctatttattaaaaaaatgtgggacccacctgtcatctcctcatcctctcttcctctctcttctctctctcactcttcctctctctctctcaaactggtcggcggaggcgtgggggagagacgcagcggcggcgtgcgggcggtggcagagcgccggggacggattcctccgaccactggtgttgtcgttgccgaagtttaggatctcgctggtctccggcatgaagaaaggcggtgccgcggcaccgccgttggacgcgaaatcagagaagttgagctcccggcggaaggggccctgctgagcctggctgctctgctgctgccactgaggcagcgcggccggctgcgagggcgttggggcgtgcaccgacagaccggctgggattctccgtgagcgtgctggggcgcgtcggtgagccagagcacggagggatcggcggcggcgtcggggtgggggggccaggaggaagcagctgcgctgaggttgaagagggcgcggatcctggggatgctatccccggtctggaagggacgtcggtggaaccgagctcgaggacaccggtggcgagggggaggcagaccatggtgcggaggcggaaggtgtaggcatgcctggcggggtcgcagggggcggtgcgaagccggtggcgatccaggtgggttgggcggcgaagtgggcctgtcaggccgcccgccgccgccgcgtcctcccccgcacgccgtcgccgaccggtttgagagagagaggaagagtgagagagaggaagagaggatgaggagatgacaggtgggtcccacaattttttaataattagagtgctgactggactaccacgcgaacaccacgtggaccaaaatcaccacagattagatcgaggagggtaatttgtccagtttgcatagttgggggtgaagaatacccggttttgtggttgggggtaattcggacgaccgcgatagttcaggggggtaattcgtactttttccttccgaaatataggactaatatgagatatgcttaaactggagaagatcggttatggagaagcatcttgtggcattatgcggaccatggatgaaaaatatggatgacgaagggaagcattatcaatttttctcatagtaaagatgggcaagaaaaaaacaaatgctttgaattcaccaacatgaactagcaagtaccaagagtagagaaaaagagaaatctgcatcagatcagccaacggtgtagcatccacccgtcgcctccaccttctcctgcatcacatcagctgagcgctgcatccatccgacgacaccatcgccttcatcagatttgcctccttgcaagcctctacctcagccaccacatcccagctgccgcatcgggtgcaaaaaatagccggcagaggagagtgacgggtggagcaggagggagtgggagaggggtggagcaagaagagaggtgctaggagaggtggagtaggcaggggaggagttagagcgaaatggagaggggtgtcacatgcttgctttactctgttttagaccaaatttaagctgatgtaggtgcttaagtttgcactgagggggtgtacatatggtgaaaaaagatgtaactatagctaaaaaattttcttgaccggagcactccctttggacatgtagctccgcccctaggagcaggagggagtgggagaggggtggagcaagaagagaggtgctaggagaggtggagcagggatggagatagagatcggtggagcgctgctaccctgcgtcgataatgagagagggaggaggcagagggtgaacgagatagagagatgcgagaaggatgagagactgggaggagataagattcaaccatgtgaacgtgaggaaacagagatgacttggtccttctagttcacctaaatatagctgacattcaatgcttctagtgttttgagcacaagtcatttttttttttacaaccgttccgtcccaatcagtttatcctaggacggaggaagtactagtaaactttctgtcactattaacaatggtaccaatcacgatttgtcttatttatgttggctcttacatctagaaatttagaccgccactggttgaatttgaatcgcgtatagcgatcaaatgtttttttcgttgtattgacagtttggctggcagcgacacctgtatcgtttttccattttagtccctacattagattagatcgctatattggttgcgatccaaaaaaattttcattctagtccttggtaatgaactaatggtggcagtgtggcactcgctccgctgctctattcccccctcgcgtccgccgccgacggcgatggccacctcgccgccgcgaccacttcatcgtctcccttcagatggcggcgcaagatctcgtactggtgagcaccggcaggggggcagtagcctcaagacccccccctccctcccccccaccgcgcaacgagaggcgcgcgccacaggtgttctcattgctctctctctctctccttcctaatatgagtatctctctgccctggagcctctagccctctactcgttttttgtgggggaatgacatagaagggttattggcacattgttcctcagaagaagggggaaaaaagaaagaaagaaggtttttgacatagtttctagactcgtttttagcacgcaaactaattcctgtctgtgaaattttcagtaaccaggttgctgcagttgataattttgaaagagttgatcatttaaaccgtgcaacgagcggtacactggtagtagtctgactttgtgagctcaattgtccaattgatatattagaaattctacagtaggataaaacaataaaatcaggtagtagtgaaaaaaaagagtgatattctaatatgcttctctgtcagttgattttttacgacgaatattgaaatcagggattcaattatttttaccagtgagatgctttcttgacttccataagatcatcatatatcagttaaccataagggatggcttttacaccatcttagtatttatttgggtgttgaaattaattcctatggtgcatctgtttgaattgtgcaagcacacctggaatatgaagcattattggaccacgaaaccatagaattacttcgtactataaaacgatgtattggcttgtctgtttatttctaacatgaatcaaaccagataaggggtcctatcattcccattggcaataagttcgctgactattggcaagctaagtaacactatgacagcaatatactaaatcatgacattaaaacagagtattttattgttccaacagacaagcatgttggcttgtcaatggttttaaatcatgacattaaaacagagtattttattgttccaacagacaagcatgttggcttgtcaatggttttgttcttgatttttttttcttttaaaaaaggatcacaactcagcaatttttttaccaagaaaaacttgagtagacttttcctatttctaaaccagtatcacgtagctcctggtaggaatcactcgtcagaatagataaataggagacaaggatttaacgtggaaaaccattacaggggaaaaaccacagacacacaaaatgatcactgtgttgagaatgtttacattggaactcttttgccccctttgtttggtgtttcttgccctaggcctgcagggccatatttgtgtgttacatgtagaaatagactacgagtatgaccccataaaaaccaaaattaattcagttcattttttaacaacctaactgctttgctgcaataattttggaagcaaaaaagtggagtattatctgatattctgatatgcaggatttttatttatccttgtggattccaaatgctgctacagagatgttggtgtgcattactccggtcttaatgacttaatc

SEQ ID NO: 56033 - DNA, 859 bp, Oryza sativa
caaatttataccaaggttgacagttatgtaaagactccttggcacattgatgtgattgagcattattcgttcataatttccaaatagttggtatactttgcctaaacactaacattcatttccatatgagagtatgacttgattatgtttgagtgctatccaacaactttcagttgaccttgacatgttcttctacttgactacttatactgctatgttttccaactacaatggttcctgcatcctgaccttcacttttcttgtgtttgtgagagccaaacttgtaagcagccagtgctccttcaacggggaggttgcattatcatcttttatgtgtatattaagtgtgtattccttattttaaactttgctacgtgtttcccataaacataaaatatattcttttgtaacaatgaggatttgacactctttaaaatagcatcattaagataagaacaattgtttttcttcttaaagtttgtagctactggaccattgactgcatcacaattgattggtcaccgtttctgataacgaaatggtttggcacctagctcacaagtcacaacttgctccacttgctagaaattgtgatgctttcagctttgtcctagtttttgacgactgctgcttttgcaggaatctacggatcattcagttttgaccagaacccatattgcaatgggtgttctacacacccctctctgagattctcacgggaggtgattgattccaaatcctctgtagtagcagataagtcaccaaactttagggtggagaatgctccttttgcttatcaggaaccatggcgctgcttgaagatcggtcagccattcctatatccttaggtgcatacctc

SEQ ID NO: 56034 - DNA, 3054 bp, Oryza sativa
tacctctatgaagttcagcgacgtaaggtgatccatcttccccatctgcgtaaccatacattaagttctgctttgaatccttcacgtcttaaatttatgagtaatatggaaaggaagattaagtgtatagctggtaaaattgatgatttgaaaaataagcgcttaaccttccaagtagaggtccatgattaaacagatcaacaacatgaaggaagtatgtgtaacgggagtacctctcttcctccaatttcaccctgtggtagagagaatgatcaggagaggattgtaaatatgcttctccaacgtgatttgaagcccaacattgcagtattgcctatactgggtgaggcttatattgggaagacaactgttgctcagctaatcatcaatgacaagcgtgtatcaaggcactttgatgtcagaatatgggctcatgtatcacctgatttcaatataaaaaggatatctgcatctatcctagagtctatatatgacaaatctcattatgacaacctggacaccctccaaaaacacatacaaaagcggctacgagggaaaaggttcctgcttgtcctagatgactattggacagagaactggcatgactgggaggaggtcaagcgtccattgctcaaggcttctgctggaagcaaggttatagtgacaacacggagtggggcagtcgcaaaattgcttggtatggatctaacgtatcaattgaaactatcaattgaaacctctatcaagtgaggactgctggtcattgttccgccgatgcgcccttggtgtggaagtcaaagaatataattctggagatttcctcgataggtaccctcttcaatcttaatctctccgttccaaaatataagaacttttagctttttcttagagagattaaggttggatgaaaaagattatgatgcccctcattaagtgagggatattttttggagtggggaagggtggttagggataagattgggtgaaagttaactgaggagtaattggtgtggaaagtagtactctaaaagtccttatattttgggacaaactttgaaccccaaaagtccttatattttgaggcacaaggactgagggagtaactagtactagcataagtaaattttgggcacaaatgctaaaacctcggcacctgatgccccatctctggtttttttagatgattgtcgtaacagaggtttttttaatataaaagttcatacagtaacactccgtattaataaatactataatcatcagatgtcctgacatctgatctcttctttcacccgcagaaagatgcatcaagtttcttatagggttaaagttaaactaatacctacttttctattcaccttttacagagtttatctctaacgccgtatacctttttccctctatcttaatgaaatgatatggagatctcctgcatgttctaaaaaaaactaatacccacctttctatccatcagtttttccttctttttttttctataacatgttctattttagcctcaaacatttctatgtatttgactattgcaacattgttcttcaactgttgcaaaaatggctgttttgcagattgaagatggaagttctacagaagtgtaacggtgttcctttcattgcggccagcttaggccatagattacaccagaaggataaaagtaagtgggttgctattctgcaagaggaaatttgtgatgccaatcccaattatttcattcgggcccgtcaactgagctatgcacagttacactcccatctcaagccttgttttgcttactgctcaattattccacgggaattccagtttgaggagtggcttatcaagcattggatggctcagggcttcattcagtctaagcctgatgctgtagccactgggagttcttactttagaactttatttgaacagtcgtttttccagagagaactggttcaccatagtggggaacgacaccgttatagcatgtcccgaatgatgcatgagctcgctttgcacgtctcaactgatgaatgctatatcttggggagtcctggcgaagttccagagaaggtccggcatttaacagtattactcgacgagtttgccagccaaaacatgttcgagacaatttcccaatgtaagcatttacatacacttctagtcactggtggcaacgcaggttatgaactgagtatccccaaaaatttactcaatagtacattaaaaaagcttcgacttctagaattggataacattgagatcaccaagctacctaaatcaattggaaatttgatacacctccgctgtctcatgctccaaggatccaagataagaaagctgcctgaatcaatatgcagcctgtacaatcttcaaactctgtgcctaaggaactgctatgatcttgagaagttgccacgcagaataaagtatcttcacaagctaaggcatatcgatctgcatctggatgatccttcccctgatatccatggattgaaggatatgcctgtggatataggattgttgactgatcttcagacactgtcaaggtttgtcacaagcaagaggaacattcttgacaaccacagcaatattaaggagctagataaattggacaatctctgcggggaactactcatttcaaatctgcatgttgttaaggatgcgcaagaagctgcacaggcacatttggcttccaaacaatttctccaaaagatggagctctcatggaaaggcaacaacaaacaagctgaacaaattttggagcaactgaaaccaccctccggaataaaagagcttaccatttcaggttataccggcatatcgtgtcctatctggcttggttctgaaagctacacgaatctagtcactttgtcactctatcatttcaagagctgcaccgttgttccttccctttggctattacctcttttggaaaatctccacatcaagggatgggatgcattggttaaattttgtggtagcagttctgccaatttccaagctctgaagaagctacatttcgagaggatggacagtttaaagcaatgggatggggatgagaga

SEQ ID NO: 56035 - DNA, 1648 bp, Oryza sativa
acttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagcagaaatagcttcagtccagaactttcttggagtcgtaaactcatcaagcatagttcgtgccatctccacaagggtgcggttcttcctctcaaccaccccattctgttgtgggacatatggcgaagaaaactggtgttcgactccagaagaatcacagaaagattcaaatgcagaatttttgaattcagagccattatcactgcgaatggctcgaagagcaccaggaaactccaaagccaaactacgagcaagagactgaaagaagccaaacgtttcctcctttgattcaagaaaatagacccaagagtagcgagagaaatcatccacaacaaccaagacataccacttccccccaactgactggacccgagcaggaccaaccgtattcatgtgaagcagttgtcccggtccatctgtcataaccattgtaacaggcttgtgggaggaagatgtcattttcccatgacgacatggtgcacacacaagatctttcggagctttcaacttaggcaaaccccgaatcaaatccataccactaatgcgagacaagtggtcaaagccaatatgaccaagacgtcgatgccagaaaaacaaatccctattctctgaggcaacgagacaacgagaaggaccgggagcagaagagtcgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaatttgtcattgaccttgattgttcctttagccatcacgcgtccactgctcgcatccccaaaagtgatggtctcatcaccggatgcacgagtgagagaagtaaaccacttggcttcaccggtcatgtggcgtgagcaaccggagtccacaagccaagaattacttctccccactccaaaatcctcaggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatcattcttcccctttcgcccttgtccctcgggcttcttggtcgtcttgtcactcttcttcttcaacttgggacaattcactcttatgtggttaggctctccacactcaaaacacacaaatggttcattggtttttcctctctttttatttctcacatttttgtaagctcttgagaattttctagcaaaaagagcaagatcatcttcagggatcttctctaattgctcctcagtgactgagtgtaaagcggcaagagagaagccaccacacacaaaagctgagtcattaga

SEQ ID NO: 56036 - DNA, 1191 bp, Oryza sativa
catgtatacaagctcctcttccattctccattctgtggcgaacccggcacttgcacttgaccttgcgaagtccgttgcgaagacctcctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccggtacttgtcaatttcccatcacaaaagaactataaccacacatggtttcacaaaactaaggtcgtgttgagtctgaactatcgcaaaagctcgatttacctccctctagatacttaaataccggaagttcatgactcttcaacttttcaaaccaaacaagtcaccccaataacccaatccaaagtggttttagttctatgtggcatatacattgtctgcctcggagcacactttgtgacaacggcatgacatggtagctgtcaagaagagcgaaggaggtccctacatcttctccatggtgccaacggagaggagtgcaggcggcaacatagtcgacgctaagaggggacattgaagtacgtggtctccttctagatctgaccgatgacggtcctcattgggtgtgcagctaacctccctccatcgtcactgagccaagcaccacattcccctcgaggacaatgatgagctcgaacattgtcttgcctcacctcctatctccctctgctctcccaccctccttgttgccaccaaaacccactcccctccttgctcggtcttgtgggccctgggccctgcttccctcattcctaacgatggtggcgatggttcctcgatgcgcggtcaagagaactggggcaacaacggttctccttgttggtgttgaggtagtggtcgtgtcctcttgcttggatcaagatttggttagagggaggggggaggaagaagaagatagtgataagactgacatgtggggtcttatatactttttaaaatatatcgatggccttttcattggatggacagccgcatagcaaaactatcgccatatgtaggattgaaaccactttagattgggctaaggggaactttgtccagt

SEQ ID NO: 56037 - DNA, 4925 bp, Oryza sativa
  unsure (1)..(4925): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgagcctatttatagaataaattcatcgatatgtgtatccttaaaataacagacaacttctaaaaccaccagtagtacgcgccgcgggaggatgtgcttaactaccgagattgcatgtgattcgatccgtttaagattcccgagccctcattagttgggtattttaggtcatcacaccgtgaatccaaaccttgatgaaggctccatcagcaaagaaattgctagtttaattttgttgtacgacacaagaacaagtggtcgatcgattagattattagcacacatatcagagacaatgaaccaagagtgtagtacgtacgtagtacacctcatattgacccggcgatgtttttgtggtactagtactgcatcccattaaatttgccacttgctcatatacaaattaaagattaattaacaaggaagttgctgatttataaataagcctttgttatgaccagacaggtacggcgtacttagggaaaatgggaagagatgccaaaggggggttcagactaagaagaatatatatggcagacaggctttgcaaattaagtggaactgttgcttctccgcatcccccaccatgcaggcatggatgctttttgttaattattcggattttatttgttcgcatccgacgttctctgtccaattgcagcacacgtatagggccgtttcataactttgctctgcttgtccctccatcccgttaataaaacaatctaatatcgaatgagacacactctaatattacggatatgaacgaattatctttttatattcagaatgtaggatatgtcgtctatccagtactaaattgctatctttacagacaggggtagtaactttgaactatttattagctttatctgatgagaggtttatggttttgttacattcgagcctcttcattttatgggttttcctaactaaggcttctttatcgttttcagctagcacgcttttcgaactattaaatgatgtgtttttttttcaaaaaaagtctatatagaagttgtttgaaaaattcaaataaatttatttttcaagtttataattattaatactaaattaatgatgtggttatgagctttctagttttgcgtgccctgaaaaacataaaactcatcctaagccccaatgaggtatatatgtattcgtaatactatgatgtgtctcattgggtactagattactatctttgagacgaaggtagtagacactgaactattcactagctttatctcatgagagctttcataaggtttcgttacgtttgagacccttcattttaggagttttcctggttaagacgatcttggactaaaaaccgcctaaatcttaaaccatgtccaattagttaaatccatgggtagtgtcatttattcaagctacaatacgataaccggatagtaaaattcaggaaattagctattattatgtatttttgcgtggttgcaatttaattaccgtaatagagttcaatcctacaccaaaactgcgcaaacaataatttagggggtactatatgtatgtacaaacacatccaatattttaatcatttagtaaaacaatatatcatatcaaaagtggacataaaatatttagctgtacccacaatggttttggtttaaaaaaaagctttagctgaagtaacttgtcaatcaatcaatatatatatatatatagctcaaaattatcaacttacaaacacacaattgttaactacatataagcaaattaagagacatttgatcggaaactcaaccagagtaaagagctaaaataaaatggaaatgaaaatgaaaaaaacatatgcataaatactctgaatatttgagggctatttaaatgagaaaatagatttcaagagcttaccttatattgcttatatatgtaattaaatttcagatattttgagggttcatattacttatatttgccttattatcttacaaaaaaaatataatggattttcttttgttggaaactcggtgcacattgttttttttttgacaagtcaaattccaagttcaactttcataataccccgtacttctcaaattaagttcttgtaaccactgtttattatgtaaaaaaaacacatttatatcctgtagaaaacttatatgcaaacttagataaatgctgtgaacttttaatgttgcaaattaattaacaggcccttaattaggttgacctttgtaaaccatttcattatctaaacaaaatatatagttcgaccaccggtacgtacagtgacgcccgcacattatacgtacatggagtacatatatatgtacgttagaacatcactaccatgcatgttgcaattttctccattaaataaattaaaaggaaaatttcttcaaagcctctttcttgatttgatgtgagtagtttaagtttctgaagcgtgaggccttgcatttgggctaatggtactgaatggcttacatttattaggagaaaaacctagctactactacctccgttccaaaataagtgcagccatagaaatccgtgtccaacgtttgaccgtccgtcttatttgaaaaatttatgaaaaatttaaaaaaatttagtcacacataaagtactattcatgttttatcatctaataacaataaaaatagtaatcataaaaaatttcaaataaaacgaatggtcaaacgttggagatgaatagtgtaaaattacacttattttgggacggagggagtagtacggtaaaaaggcatagggacaataaacaaaataatctagcttggtttctccctaatatttgtgcctccacttgtccaatatgcatgagctgtgtaatataatgtgaatcgcatggtacatgcatgaatccatcatatcgaaaaaaattaaaaaaagaaagcgcccatggttttgggtaatcctgttcgtagcatcaaggtcaactaaacgtacgaggcatcaatcaatataattcaggataagcctaataccctcttccttgcattattccacgagtattgcctactgttttgcaaacatatttccatgacgagttcccactaagatttcgtgttgaatgagaataatatcataaaattcatgagaaacgaattaattatccatccagaacctcatttagatccgtaccactaactaaaactatttgaatagtatgctgttagtagccgcatttaaaataaggattaaacaaaatttcgatctctgcattccttgcaacatggaataaagaagaaaggtgcacaaagagaggagccattagataaatcaaagacttctagacctaggttaatttaaatctagccaggcacgcacagtgcaaacttgcaaccgctcaagaatctaagaaaaaaataattcgtatgactacgtcgtaccctcataaactttgtaggtatatagtttttgtacttacgtgtaatcgcacagctcatcaatgacataatcctcgaccaatgtgtcatttgatttgaggctctcccgacgaagctgtgtgcaaagttgcaatgcatctggaccctcctccggcctaatggtggtatatatgctaacctttatcaaccgcccacttgatggctactccactctaattacgttttatttactgctactagtcaatgtgatcaatgatatttttctcaatttagaattgttggattagattaacgagaaggcgtgtggtctccacgcaaaattgttccacgcgcgtcgtgtgccaggactactaaattggtcagcactacagtttaatttgggtaaatggtaggtagcttacatgatcaatctgatcgaccgatcgatcgagatcagcttttgacaaccaggttaatatttagcaattttgagccatagttatttcattgtttttttctaaaatttgacaaggaactaagttgccaaaatattttttggctagattgaggacttggagttactattaatagaaaagaagaatataggagggttgaattggtgggacttacagctttattactagtaatcatgctttgctggtttatcttaattatatttttttacatgtatcttaattaatcttggattagggagtattcactactagagaacaaaccttttgacgtagtacccaaaatcacaaatacctcggttagattaaaaaccagtactaaaaatgctttagtaccggttataaaagtccaaatccctagaaacatctttagtcctagttgatattaccaactggtatctttactatcggttggtaacaccaacatggactaaagaccagtagtaaagcctccagggttagttcaaaagtaaaacatctcttcaagctagatgtgtgtagtaggtgagttggttacgcgtgtgagggctgaggtgagagatcttgagttcgaatcccatatcccacatatttattttcacttgctatgtatcggtactaaagattttgaacttgagtcccgatttgctcgtctcggttgctacaattggtagtaaaggagttgtaaaccgggactaaaaatcgtttcccctatagtgattgaaagctttggcagagggagtttttaaacccgcaag

SEQ ID NO: 56038 - DNA, 14958 bp, Oryza sativa
  unsure (1)..(14958): unsure at all n locations
acccccccgagggggtcaggccacgtgggtgaccgcggctacccaagtctctagtcacgatacccccggccccatgtcaccgacagaggaagtacaaattatacatttacccatgtgagatatcaatttgaactttaatcggggattttactatttacgctagattcacattgagttggcttggtgcaaatcaacattgagagggacgagtttgcacaaatgaaattttaggactaaaccgacccaagaaacatggcatttgcatttctatccctgttttcaatagcaaattgtgtgactttatctttactcttttaaccttatgatttttttcccttgttgtatgtttgctagtctatctatactccttataaaagggagtagctagcggtgatgattgttctgtcaccacccgaccatcaattcccaactttcttttagagcgaaaatggcatgtcggttagaggacccacgtgtcaaccaactcccaacaatagccgattggaataagaacgtggagcactactacacatattttttttaaaaaacaaaaactcttacaaataataatttcaacaatttgattaacatagatgagtggatatctagtgatgtacccacagcatatataacacatcagtgttattaaaagttcagtaagaaagttttagtatgtatagcctttttcgtcaagaacatagagcatatttggtcaggtttaattcaattttaagttcggacttaactatatatgtacttaattatatatgctatgaacgtacgatgtctcatcagctaggacgcaaacatccaaaaattcagaaacagacacacaattatttcggggaaagtaaaagtatatatgctctgaaacagtaaacccatcttgttgaggacaaaatcgaactaaaaatacatagaacaaatcaagctgtccaacaaaatttggggccccctcgctcgagacagaatctcctggtgttcatggcgcattccccaatcagatggcccgatcgattggtagagatgcaatgcacctaataagcacttggattccgagtgtacagggccatcagcaactggataccaatttatttatatatggtttagctgcaaatgattctaggacacttgccataaaacactagttttattgctcaacttgtggcaaacttgtgtgctgctggggctgagtgcatatgcaagtgttcatcctagttggcatgatctcatcaagcttagctcgtggtggtgattaattatatctagtgcctaattacacttcaggctttcctagttgatcttgcaaagcagtagtatatactatatgtgggaaaattaaagttgttcccatggtttcgaccttcttttgaaccaagatagcgtgtaactttttgtttctcgttgcttgattgagaaattataatttgacgacgcatgatagagagcgtgaattacgttgtcacacggatcatcagtccactgacagcccagttaattaattacgtaccggtacggtccctgttttcaaccggccgtcgatcgctcgttcctgccctgttccaagtcaagtggccacaattgttgacgacttgagttaatttgataatgtgcattaaattatgtagatcaagtgcttaattatgcagggcttttgctcccattcttcgacagtaacaggccagttactgctggttttagagcacgtctaactctgttaattttatactgatgaaagcccaacctgcttattggttaatgattggttaatcgatatgttaattgaacgaggtaaaatgaagcactaaaaggagaagaaagacatgtttagatgtgaactaggaggaaaacagaggggaattcagaaggacaaaagaggacttgaggctcaataaagcttttcgcaagtgggctgagaatgtagggcccagtgaggcccaaatagactaattgcgcaacaatatagcccacttgaaaattagcccagatatatagcacaaaatgttgatggcccagaagtttattactctatgttgggcttattctgtaaccgggcctaataactccatattcggcctatttgactatttctctaaccgggggcccatttcgcaagcccattttctgattcatgttctgattctatgttctgattctattccgacattgttgctgcatgatagcgtgttctttgacctacttatgcaagtaaccaaaatcataatggtcagaagatgctctcgatctgctagatatgttacgtactaccactagctggatgatcatatatactgtcaaattaaagctagctatcggcggtgatgagatgatgagaaaatcgaagtaagagaattataccaaaaccccaggtgatgaaacgcatataggcttacctcgtaatgcaagtaacttgagacagggcatgcctcctttgcctcacaatcaaacaactaatttaaccactgtttaatgcttcttctgctaactctcctctcatcaacagaatcatctgaccatctttatatcacgttgggccccatgcttctctaatcactcgatctctcccagatgctttatgcaaagcctatataaactttgtgttgtcccaaaccattcgcccgatttgatccacatcaccactttggttcctcccatttttcatttcaaagtgatactaataagcaagtgcaaggatagctagcttgacagtgtggaagtagtagtaggagcaagaggcaaattaaggggaagctgcaggtggtagatgcgtaatgcgagcggcagcagctgctgctctcgggtggcggcgccgttgcatgcgcaagtgcttggctcgccgtctccttctcatggctacggcggcgccggcgacggctgtcttctgcaggcacctcccccggcagtcgtctgcggggagatgctggcactgacgacgccggcgccgccgtctcttctccatgcactggcctccctcaacgtcctcctcctcgtcgcctacctcctcctcttcctcctcgccaagctcgccgccggccttcaccgccggtgagtgagtgacagagctagcttcagttcagagagatctttgtgccattaattgcatggacgtgtcacatttttactgtgcgtatgtatgtagaggccatggtagctgtgacgagcaccaggtcacggagacctccgggagggaggagttcgccggcgccgacgacatcgccggagtgcagcagcagcaagcggagatgctgttctggttcgacgaggccgtgttcgaggacactgctctgcttggtggcgaaggaaaggatcagctcatgtacgacgctgccaccacaccacctacacctacacctgcacgttgcttgcaggtggagagcacctttcccatggtggaatccacccgacgaatctcgccgcaccatcgccagtgcagcttcagccatgaggagcccaaggccgccgccgccgccgccgccgccactgcgtcgagccagaaggatatcattccggccgccgtgccatcaccggagaacgttcccgtcgaaggtataaccattaattccactaacctctattacttcttgttaaccatgcatttcatcctggttctgacactcgtcgtacgtggttgcagccggggaagaggacggccatggcgaacacggagaagaagacgatgaggaggagaagaggtttaggggagatgacgtgaagctgttcgtgaacagccgggcgctcgccgacacgaagaagctgcttctggagggcgccatggccgggaaaggaggagtgcagcgcgagcgcgaggaggagagcaggttgggcgcgtcgacgctgacgagcgagtcgacgtcgaagagctcggtggagtggcggagctcgacggtgaccaaggactcggagacggagtaccccttctcgtcgtcgtctcgccggagctcgtcgcggtgggagtcgtacgctctcttccgcaagtacgacgaggacatggtctacttccatcgcgtcggcgcccagaagctcaccgagacaggtacatactaattattcttccaaaatcaagtcatcattaccactcattacccaagctagattaattaaacctttctcgagaaacataaacctcaatcaaacgacgcaattccagctccctgcaactctttctctacacacaatggggctcacacaacaaaaaatatttacagaaagtttactgatcagttgcgtttgctggaacggttaatttgcagagtcgtacaggtcgataaagtatcagccgcgatcggtgtcggagcggatcgtgcagaagctgacgccgaagccgcggccggcgatcgggctgagggacccgtacccggagctggagcgggtgtacgtggcgcagatctgcctcacctgggaggcgctcaactggaactacgccagcttccgccgccacgccggcgacatcgcggcgaggtgctgcccggcgcgcgtcgcgcaggagttccagcaattccaagttcttcttcaccggttcatcgagaacgagccctacgagtacggactccgcccggaggtgtacgcccggatgaagaactcatcccccaagcttctcctcgtcccagagttcagaggtaactaactaatttctctgatggaattgaccaaactttattgttttgttagctgatttagagtagctgagaattgagtagtgcgttgttaatttttgaaaatattgcagatgaggaggacgagaaggacgatctgatatcggcggtgcagttcttgtacatactggaggagtcgatcagaacgttcatggcgttcctgcgtgcagacaagaggagccactaccaaatgttcagagaaatggtgaagaggaggaccagctccatggatcagactctggtcatcaccctcaagaaggccaacaagaaagtgagccacataaataaacatcacacacaatgctgatcagattttctttcatcatcatcattaattccactttcttctcattgcctgaaaatgaaatcttcagaagaagagccggctcaaggacctgacgaggccaagacggtgtctgaggaggacgaagctgagggaagaagaggagatgtcaatactgctgggcttaatcgacctcaagatcgtggccagagtgctgcgaatgccggagatcaccgatcagcagctgcactggtgcgaggagaagatgaacagggtcaaagtcgacccggctcagggcaagatgcagagggacccgtctcctcttttcttccctgcacattgacagcagcatcagcagctgtaactagctagtccctgcttgtaatctactacttttttcttgcccatctcctcttcaaatcttcctttgttgatatagtgagaaaaagataaagttgcatagacgacatgagaatatgcatggcacgcagctagcctgatctagttctgtaaaaagagagtcagagatcgatgaagagatcgtgtaaaggcaatatatgtgtacttatgtatttatacatagtagataaataagagacccacatcaatcttgtagttgggtgcatgtgatgtggtgggggtgagatactataaatttgatcgttgcatgcatgatggattttggaatctagacgcttcatgtcattatgtatataaatccgtgtgagtgtatgtgacacaatctgtgtgtgcatggaatggaaagcaaaagaggtgaggtggtgaggatggagacaagcacagctttgacaatgctttatctttttcatgtgttcttctctctctgctttataggctctcctccttggatcacaagatgatgatagcaacaaatgtcacactagatttgcctcaacattttaggataaccacatcatcctccttttcctttttattttatcttttgttttttttcctttgtggatgttggcactcttatgttatgtcatcagggaaagcagcctctcctctgcataacaaaaggaaacagaagattaaagaggtgttctacaagttcctgacttctctgtatccaactaaataaaatcatccatgagctttgtgttgtgctgacctgcatttagatatgtttggtgctgcataaacaaaccaaagattacgccgaagtgatcatttatatcccttttttacattggataagctcttgacgtcgattgctacgtgcagagtcgagtacagagatggtccatggtgctcttgcttttggcaaagaaaagattagcagagtcagaaagtggctggccactgtaaacaggtcaaaaagagtgggggaaaagatttcccactgacaaaatttggttaccaagaacaaagtgaacaacctcaacaaaatcaaaacgaacacgttgatgatgcagttttattttggtttgggctgagttgtttcaaaataggcggggcctcttggctaatgtaagataatatatatagaagttgttggcctttggcaatcaaagcccacaaatttcacaagccagtaccgcaggccgaaataagttcacttcaactcccttaactgggggccaaatctaattcgtacctctgaaccacaataccagatatctcgatccccaacaattaaaaaaaattcaatttgactccctcaacaattttggagagcggttttgctagtgtaaccctttgacttggtcaactttgtgctgatgtggcaacctagtcacacaatacaagtgaggcccacttgtaagtgactaggaaaaaaattaaaaacatggggaccacttgtcaacccctttctcccctctatttctccgaacactccacgctcggcgatgtgctgcggcgttggcgcgacttctccccatccctcgcagcggcgagcggtagggaaatgtaacgctccgctttttgcgtgacgttaaaaactaattcggcaaaatcctatatgcaaaaatttcgttctttgagtgagagtctaagtcgtgccatggatctcaattcaatctccatcgttgttccctctcatcaccatcaaaatcctccacctcaagtttccaatcccgattcaagtttccgaaatcaaatcctgaaattcaatcgcctcctttgaatcctcgccaaatacttgtcccgattccacaaatatccgagtccaccttgaatccattccttgactcctccctgtttccctgagtccaagtaatcaaattcgaaattcaattccaaatccaaatcccttccaaatcatctctctgcaaaagtctattttgcctcccccttggtcgttgggccgattcttccttccttggccgatctcctccctcagcctcgcacgtgcgttgcacgcgccgagccgagccgagagagagctctctcgctctctcgttctctctctctctcgatgctttctctctctcacgcgccgacgtcgatttcccgccggcatcgctcaaacctccaccgccttcgctcgttcccgcgcgcgctcccgccgtggtggccgaccgccctcggtcaccgtccgccctggcccgcctgcgccgcgcagccgcccgtgcccactctgccgctgcccccacctctgcgccgcagcgcgcgtgtgtccaagacgcggaggcagcgcctctctctcccacgcgctctctcctccctcagctcgcccaaaatcggcaaggagccgagctcctttctccctccccctttttgctttttccccgaccggcgccaccgtcacctcctttgccacccgtgaccgcctctgtcacagcttgaccgcgaatccgccaccgcctctccttgatcgcccgtgctcggttccttcccctcgaagctccacatcccgcgcctataaaaccacagccgagcccctcccctccatctctctcgttttcgccccccaccgcgccattgcagccgaacaaccgtcgccgccctgttgccgctcgactcgatctcgtcgtcgccgtccgccgccgagcaccggaggaaccggtgcgtgcgtgggcgcgtgacgaggagctacgggcgccacctctcctctattcctccccggccgcgcccactcggtgccgcgccgtcccaccgtcgcgaccacctcgccacgactctctccgatccaccgacgccgcttcctcttgtcggtgagctccccgccgaaccctttcctcttaccgctcgctatgccgcgcccgccgctgcacgccatagcctgccgcacgatgcgccgcgcgcctcgccgttgctctgtttccgccgctgcgcgcagtcgcgcgccgtcgtcgggccccagctcgtcgaccaccctcgccaacaccgtccttgagctccctaggacctccccaaaccattccctagcaccgccgtcgcccggcatggcctcaccgccattaccgtccgctcccggaggccgctgctcgtcgccggccctcctcagtgcttctccgccccatccgacaccggaaacagattccttgaaccccggagatgctcccacccctttgaatcgaatcctcgtcgtctcgttggggttttcccctttttggctcgccggtgattgccgccgccgcaatcgaccgccgtcggcacctctcgcgccgattcctctcgccgccacgctcccggagatccccttgagctccccctgactgtccntaggccgccggccttctcctttgcctccgcgccgtgtcgccccttccgccgccgcataacgccaccgcgcgtgcgtcgccggtgaccatcaggtcccgcgtcaccgcgtgcgcgtcgcaaccccataccggttcggctaagcccgagcccgcgtgcccttcgctcttctcgcgtgcggccacgtcggcgtgccggcgagattggccgccgccgccggccgtcgtcgcgcgtcgtcttcccgatctgagccgtggaatgagttccccttctcctcctcctgccgccagtgctagccgcccctctggcttgccgccgttcgccggatcccgccgtgagccgtccgatgagccgcccggcctcctctcccttccccatccgacgtgacgtccacgttggcgccacctcagccgtcggccccgcttgaccaagtcagccgacgcccagtcagcagccgccccctctctcttgctcttgggcttggcccagtagccaccctcctcctcggcctgataagtaagacaaacaaagtccatatacactcccttcgtccaagcccagtgtccatcacccaagagctaaaagtccacaattactccctccaattgctcctctctctctctcaccttcttgttggccccacgtgtcaatgagtcaaagatattcttgggaatatctttttcaatactccacacatatttctcttttctagaaattcaataaatcatttcctatattccaaattccataaacccatcctcttaatccggagattccaataattcgtcccctcgagcctgtatgtcagtggatgtcaataatattcttgagaatattatttctataaattccataaaccatttctcgtattccagaaaattccgacaaatcgtctccttgtccagaaaaattcatttaaacttccaaaattcatatccctcgatccgttcgtccgattgcctccgttccacttccagtaattccattgaattgtgatctatctaatggcactattaattagcctaaataggacattttatttggtctttgcttaggtttttgattgtttgcgcctagttgcggttatcggatatttttcttcaagcggatttctcgaagatttgtgaagcttcgtgaagaccctgagcaaggcaagccacctttgaacatattgagcctatatttgaacttaattatattgcttgcaaaatattatgcattgataggattgcacttaatctgtttgccccgtctgcaaggcagaccggtgggcctacctaacttgttgcatctgatccttctattgttaattgttatatcatgttcccttgtaaccatctagttgcgcctcgataattcgtgcactctatgcgagtatcgacggtcgccttcaaacttaaaatttgagtaacttcttgggtaacacttggtttacaaaatctttggaaaacccgacgcctgggtcggtgccttgtgaaagaaaatgagttttaaaaatgaaactcgcgacacaaggccattcctgggtggaatacttgtgcggtcgcatttaaggaccgattccttcggaattacatccgagaatacaacagtgcgaccacatgggtgtaatgggacgcccctggctgagtaattagctaattaggggaaccatgatgccaagagacatgtggattcaacggggtggtgtcggggagaaccctcgggcttcctggcacagtatggtctgggacctaacctgttgttggtctgggacccctctcattggcatatggcaaccctgtgtcggctttggaaacaccttatcgtgaaagcctcaaagtcgccagacgtggctgttctgcacgggctaggtgacccaggttagtaatgtcgtgtgggtaaagtgtaccccctctgcagaggttattaaactattcgaacagccgtgcccacggtcatgggcggatgtgaggtgattccttagcgtagtttttgttttaccctgttttatgaaaaggtgttaaggtttgggaaacctaatgcttgggaagcatttagctgtccgggggacagtgggaccgggagtccctggaagtgattggtcgtttggggaccactattatcgggaagtttggaaaattggtttggtttgggaaaactagatttgaagccaactcttggagttgtgcaaatcttgataaataaatttgttacttctcaccccgaccgagctgagactttgtctcgctctggttgtggaaagcacacacttagattgttgaaaaccttgaaaacaaaactgattgctaaataaacagccttcccttgaagcttgcattaaccacctaagttcccctggcttgctgagtacgtaagtactcacccttgctctctatataaatatagttctgccagctccgaagatgaagttgaagtgaagtgaagattagggtttcgtcctagttccttgccgttgcttgtggcgttgggtgttagtccgttggttggttcctctgctgctgctgttgttggtgtttgcctcgtccgtgtcgccagttgcattctcgggctgtctgagctgcaacctaagttaaggtaaataagtcctctattaattataaggatttgcaatgattcatgtttgtcaccgtgggtaccagcgctatgtcctgggactggtactgagatcgcggtttcgtaggacgcagttcatgccgttttcctacgacacgctcctgtcaggtgccgttgtacggcggtgccagattggggtgtgacaggaaaagaggccgcaggaaaggagagtggggagtaggggcggcatcctccttgcctaccactccgccccacttcgatcgatgggagaggagccggaggcggcggcaagggcaaacaatgacatcagtggagatttaggtggcggtggagcaatagggctgtccaaagtgaagctttggcaataaaacatggcccaaagtgcaactcactctaaactaattctggctatatatgaaactagatctagtatatatgtttagattcatagctagaaattacagtactactatatggggataaggagatttaccatgtatctacacacatactaagtgggctcgcattggggtgctcttgtactcttatgcatgccttgagcggggcggttatttgggctttggactgacatcaattaacatgtagatgagactatagatggccatatggcccgaggcccatggcccggcccaaagcccgcaattttggcccggcccaagcatggcacggcccgactggggtcgtgcccgtgctggcccgacaaccgggccgtgcctgggttgcacccttgtcacggtgggccggcccggcacggtccgagtagtattgggccgtgtatgccgcccgtgggctggcacggcatggctcggtgcgtcggtcgggccataccggcccgacaagcctcggcccaggcacggccggccgggcttgggccgtgccgtgccgggtggcccagatggccatctatagatgggacatgaagcttggcccaataattgaggctctcatagcggcaagctaccgtagtttagaactcatgtcctgatcagtaattgtgccttatggatctaacagggagggaggatcccaaaaatataaccttctccaacaatggtccaagttaacctatacgcatagttaaaatcgacaagtattcaggaaaaggagagagtacttgaaaaccgaagtcgatcgaccagcaagaaaacaaacgaacggacgttgcctaataggaaattatcctgagaaattcctaggttccaaccatccatagcatgaccattctctccgtgagtccgtggtcgatcaagtgtccatatttgagaactgtagcataggagtactagctatgctatagtcgagtaaattatggaggatagtgtactggtactaatgaacaacgacactggctagctgtgctggctaaagcgctagctagctcttggttgtatactactagtcgatcgtactagtctacactactcatacgcatactacgtacgtgtgtatagttgtaggttttcaccgtgcatagtcggctactatacctgactcagtacagcactccacaagtgctacggtctgatcgttttctgctgctgtactgcattgcattgcatggagatggacagcaactgcagcatggtatagtatttttctttcaagaccgagctcaagctggaccattcatctactccgatcctacatgagatgtgcccagaggtatctatcagaagctcatcagaatcaaatggggatcgatgggacccagtacatactctcagctagctgcatgtctctctctcaagagaagccatgccaaagggtcccactggcttaccaaagtaaataaatctcagctagttttgttgtttatcaattgcgcgacaaggccactagcgcagcttcggagagctatagcgacacagaaaagctaggttcgacttgtcatgagattatagcttagagtagaatctatcatttgctgtaatgtacaatattgtctttcattcacacgtacctactcttactccctctgttactaaatgtaaacatttgtaggttatttactataaagattaaggataagagaaaatattctctttcagggtgtgtttagggggtgtttgggagagcccctctctcaaaaacataagtccctcccctagggacttattgttttgtgagagtttagcccctctctcccaacacccccttagtttatgccaaaattggaagtttggttgaaattagaacgatatgatggaaaagttgaaagtttgtgtgtgtaggaaagttttgatgtgatggaaaagttggaagtttgcagatgtttttacaatatgatccttataaaagaaatatttcaaacatgaactgtgccagtacttattttaaaatgaaccacgaactcaacgtcaagcccgatgacactatgatccaacgtctcagcaccagtcacgctagtgttaaccccctgctatcatggcaccgagttcaagctggatgatcaacgtggcaagtggtcaactctaagtgctctggcattgaacttccaacctcaacgccaataagcatgacgctgaggtaggaggctaagcttgtgctctggatctcaacgagctcgtagtggtgctagagtcgacgagactcgacaaggacaatggcgatgtggaagagcaagaaatcggtagcagcaccggagtcaattggtgttggaacatcaatcgaagcaatgacaccactgcatgatcgatctagaggtcaccaccgccattgagctcctggccacattcccctaccacggtgctatgtccattggcactgaggttccatggttagcaccatagcacttggaactcggtctgccatctcggacccagtgtcatagagacaattaggttgctgagatgttggactttagtgtcacaattcaattttgaaataagtttttagcagggtttattctcaaaataagcttttcaagagggttagttttttttccgtaatttcattggtcaaactttaaattgcttgcattctctcctaagcaactgattggttgaaaatgcttgccttcctgtgcatttgaaatgtgccagaaatgcttatattttgtataaaatttgaattatagaaacacttacacttggaaatggagagagtatgaacttgtcattgatattgtttatgttttcctgaatctttttttcttcgaaatagcatatttcctaataacttctattattaggaggaatcaaaatgttatttcagagtttagcacataagtctagcacctagcattacgttcaagtatctacgtacattgtttgctgcctctcacttaatccttgatttcttctctttcccttttctctcgatcggccaggcatatggccatgtcctgcaagtgcgatcctgaagatttatttccatgcccttggattgttcctcttgttaatttgtgtgccaaatgggggcgcagatacaggcatacagcagctaaagatcataaagaagaaagcggtgcgtgtacgtatagaagacagcagagagaggagaagctatgcatatgagcagagcttagggttgtgcttgtgcagcagggctacctattagcttcaagctgcagctatagcacccatccactctcttctctgattctctcttgtgttgcagtacaaattgtagctgcggttgtgcatgcatgcatcatatgtcctgtgctgtgctgcttcgccataaacacattgcaaaccgcctagtttctcgtctctgttataataattctcctga

SEQ ID NO: 56039 - DNA, 4781 bp, Oryza sativa
atccatccaaaatcccttatatctggggacggagggagtactaagatcatatctcaaaacttttatctgataactaaattcctggtttgacaaatttaatctggctaaaatacattaaagattaattcaatacataaaattcttaatttcttgctttagttttcatgtgtttctattttgtattaattgttcaattagtatatgcatgcgtggggtgcacatgaataaacattcagtgtgataccaatagtaggtgcatgactgatcaaatctatccacaattgtttaaatcttggtgctcatatcatttatgtgtttaatttcagtaggatattcgttatgttaactgatttattcctaactccgtttattgtacatttgttaattaaggactgtatttagggcatgtacaatggtctttattagcggtctctctttattgtcatgcaagcatttttggtgatgtgaaagagagaggaagaagaaaatagaaagatggttgctacgcatgacaactgcatagagtcgactcgtagcatttattagaaatttttttgttgcattgagtctgataaaggaaaagtgactagtaaaaaagtattttggtatattaatggttagagactgtattgtcttaactattataacatgataacctttaattaacgtagagaccatacctttgtattttgtgggatacgtgtgtaccgtgatatgtgtgttatgtatgtcctccatgcatgtaatcagggaaaaaaaataggtgcaggcctagttgtcatggtgcagagtgacgacacatatatggcatgcgcacttgcatgataagccatgtctatccacagtgtctggcctaacatacaaatatgaggggccaaatccaagttgcattcgaaatttccgaatgtaatttgatttgatttcaaagagataggcaaacaacaatctgttgataaccggatagtgcacaattaatgaccagaggagaagcgatgctgcgattgccaggttcaaatcgtattgattggaagacacaaatcgtgtgtgtcaaagtatccgtcgaatcgagagttattaatacctatcagaagattgagagctagttcctttttttttttgaggtacgagagctagttcctcatcaacaaccagctagaactctaatttgtagagatggatactaattaaattcattatatctactgtccaaatccatgataatggagaagtactatatacactggttgagttaaatacaacttatgctgtcagatgtcaaccatggtactatacccaaccccccaggagtagcacagtacaattagaattaatacactggtacacatacgccagctatgtaagactttcctgactacctgtaacagtagtgtgtgtattgtggtgtgtgggggatattgtacgtcttaaactcttaattatagtagcatttttcattgaaatgtatacaggtgatcaggtcgataagtatacttgttacttatattaatgggcatatgatttttattaagcatgcatttggggttcttttggaacataggatttccaatatgcggaaaaagaaaaaaaaacataggaacagagattgtcaatgttaagcaatgtatacaagatttcaaaacatagaaacactaaaggtaatgtcttcggatggttttttttttcgcgaacacgtctttggatggcatttttggagaaaatcacgtacacgagagagagagagagagagagaggagaagagattgtggattggacttaattagcaatggggaaaaaaggtgtaagctcgagttaaaattcctatgcaatagtgggtatagaaaagcaattaatccatacaaatttttactacaatcatattgttctgaagggtgttactagtataatataggaaaaaatcctataaatttcctccatccaaagaagccataatcatcagcatcattgtttgccttttgacttaattatcacctgcaactaataattaaattttgaaactaaattttagagttgattttgatgggtttttattgtattttattttcaacattagcttttatatcactaagaatgcatagataaaaggtttattttttttcagctataggccaaacgattaaactgtatatgtagtgtttttttttttgaaaattgtatacgtagtaaagggaaattgattgacaaaccggggcttatacatccgatggatttcgctgttgggctttttattatactggtcattttagaaatgatagtgcgggccaaatcagaaataaggcctggtttagtttcccaaatttttttctcaaaaacatcacatcgaatctttggacacatgtatggagcattaaatatagattaaaaaactaattgcgcagttagggaggaaatcgagagacgaatcatttgagcctaattagtccatgattatccataagtgctacagtaacccacatgtactaataacggattaattaggctcaaaagattcgtctcgcggtttctatacgagttatgaaattagttttttttattcgtgtccgaaaatcacttccgatatccggtcaaacatctgatgtgacaccctaaaagttttttttcgtgaattaaacaggccctaagcccagcagcaaccaagaaaaaagtttgctgttccatcaagaacattggtcaaagctagtggcactgcattcaaaatcctgatcaggatctatagctaggagtagcttccccgagagtcagcactcacctgcaggcacttgttcatatcgatcaccttttaaacacttgaatgagctataattatgccatcgttagcctgggttgacttgcggcgcctatgtcaaatcaagttcaatgtgatgtgatgtgtgttctgatgagttcgtgtattgactgctcgtattttatttgtactagtacggcacctatagggaaggccagagagtgaagagagcacaaaactgcagaataattcagtacccacagtaccatgtagatagatgtagctcaaattaaacggctgcgtttagttccatccaaagtttagattttagttgaaattagagatgatgtgattgaaaagttgtgtgtgtatgacaggttgatgtaatggaattttgcaaactttggatccaaagtttggatctaaacacaaccgtagagtagttttaatgagactttcacattggttcaaaatatactctaccagtacatatttaacccatttaacttttgtaagtactccagtttgtactactagtaatatatatgttcataaaatcataagaaaaacacctggtcatcagccttatacattttaaagaatcatatgcgttcaaaaacatcaatgcatctctccactactacacagttgattaaattaattccatatctgaactaaaaacacccccaaaaactcacacaccaaaaaatcaacattaccatacatgaatccaataagtgcagacatgtacctcacttagcagtagattttaaaggtaaaactgaacatcatgaacaactacccatcgatctcgatctctcttgccccccaaattaacacatcgcctatcgatcacgaacacttctaatttcttggctcttagtaatttacatgaacaataacttaactgcaatcacatcaaacgcagtaaatactacgcgtcagctcaggaggcggcgttcacgttcctgttgctgtggccgcacccgaagctgcagttgcagttgccgttgtcgggctgcacgttcgccggcggcgcggcgagcggcgccccgaagcaggagaagctggcgcggtgcggcggcggcggcggggccaccagcgcgtcgccggcggagacggcgtggccgatgacgtagtcgccgaccgccgccggctgctggtggcgcggcggggccgggtacgtcgccgggtagctcatcgggtgcaaggcggacggcggcgccgtcgtcgtgtagaggtagtggtggtacggcggcggctgcggcggcgacagccgtggctgcaccggccggagcgggatgcacgggtcgccgccgacaccgcctccccggaagcctcctcctcccatctgcatcgtcggtggaggagcagcggcgccgcctcctcccatgttcacatccctgaaactgtagcaagaaagctttcataagaaaccctagtcgatgatgagaaaggaaggatcgggcgagacgacacaacttgcaaattaatggagatttaattcacgcttagatcgatcgatgtgatatgcatacttgagctgtgcgccgacggcggcgaggctgtcgttgccgaagacgagctgcctggcgcggttgagggtttcggtctccctctctgaaagatcaaatcccaatatcccacaagttagaggcaaagggaatgcgagattagatgcatggaagatcaaaaaattgaatctttttcttaaggatataaatggttactgttggattagaatatattagatgcgtggaagataaaaaaaacgaacttcttcatatatttgtgatcgatcaaattggttctttgataaaaaaaatatcgattatatagctaggtaggttgttgtgtgatattgccttggcggtggcgattcatgtggccacccagcgcttgagatttgcagaacttgagggagcagaacctacactcgtacaccttgccagcttcatccttccctccattactcttcttcttagtaacccctgtaaacaattagctaatcattcagttatcccattctgaagctatg

SEQ ID NO: 56040 - DNA, 10833 bp, Oryza sativa
ttagtacgtatatatacaacttgttgaagatacagattcacagatggatcaacaagttcctgtttgcacaatgatgagcacacaggaactcaagagcgaggtagcccaacaagatgccgatagaacacaagtagtagtgcactgtgccgacaacaagaatgaatctatgcatagtagttttatatagtactagaatgacatagtagaaaacaagctgttcatggagatccatagtaggctagatagttgtgataagtaacaggagctagtagtaaaaatgcaggtatatatgatgtatgcatagaaaagattacaggtaatatcggatttacacacacaaacagacacatccaagagtgactgtttggaaaaaaaaattgctgaaaaaacaagacaagatatgtgcacatataaacaagacacacaaagacagcagtgtttcagagggaagatgtacataacatggagatgaacaatagaagaagacacaaaaaagtcatgaggggtagttgtgcttgtaggctccttcttacatggtggagcagagagcagcagggagagaaacagctgaacactatgatgcaaatgaggcttttggaaggagaggccggaagaaaaagaaaagaggggatcgagatatatatcggatgctgtgtgtgtggggtttgagatcgacttgagacgcgttgagtagagctctcatcagctcagtgatgtgcctgactgtgtagagagaaaagagtacaagtattattgatttagtacatgacacaaaagcaaaaagacactgcagtttgggaacagcaaatgcattggggaacggctgtcttaaaagtgttggtttggggtgtagatagagtgagagaagcagtagtagagcttggtagctgggggagagagaagcctgaaagttctctatcagttcacctctgcacagccgtccctttctctctcctgtcacacattcacatacactggtacacctacgtacactactaccactactacccctctctctctctccatctgattaagagtgagagagtaagatgctgcctgtgcatatatgattcttggagtatgtgatggctgtaatccaagtgcgaggaatgcagtatttgttgcgttgttattattatctatccaaagagagatcgatcgatcgagatcgaggaggatcagagaagaggacgtatggtatggcgatgactgtatgtcaatatgtgtaggtgagtgtccacactattagctgtagggcagctgagctgagctgaaagaaagccccacagccacagcaccactactctcttaacactgcactgtagtatcactttgtaagcagcaatgcagcagcagatatgcatgctgctgagagtgagacctctcttctctcctgcatatattgaatcattaaatagagtaagctacgccctctttttctttagatcttgtgcaaagggatcaaacacacaaacatcacacatgcatgcgcacacacatctgtacccatatccatcatctagtgtaggttataggcctatgtgtgtcctttgtttgcatctttctccttcaacctgtggttgcattgtgtaggccatatgcatgcatgcattgcagagagctcttgagaagaagagagagagagagagagagagagatactagagggtaaggtaataaagacaagggcacctcttacaaagccctggttctgaatttagttgagaaagagtatgcacaagctaggggcccctataggcgcatgcatatggcttagcctttgaggtctagtaggatgcatgcatgctaggaagagctgttgtcaagtactgggagtttagggtagaggaggccagggaggatacatgggcagtaaaaagtgcctttggagggatgtgtgtatggaaaatgtgagacaccgagaccttcaccagtacaagtgataggccctgtgttggatagtgctaatgacataaacccacatggttttcatgtgagatctctctccctctccctctctctctctcccactctttctctctcacatacacagtcacacacactacaatgggttgcaacattcaagcaggtttgtagcactggcttggcctggccatgtaagcccagacaaattaatgtaggcattggtaggggatgagatatgatcaaacaagaaaacatggacaaagacaagactagggtttaccttttccttttgaaaatataaacctctcctcactagtttaccaaaaaactggtgaaaaccgacaacttaatttctgtaaatgtcgtacgaaaataagaaagaactagtcggttttgtgaaacctgctttaacattcatataaacaccggttgatttactcctagccaatcttcgatacgttccttccatgcttgggagacatataataccctaagagtaaggacaataagaaaataaaaaatatatataagcatttctgcctatgtatttaaacactggttagatacatagccagcaatgcttatattttaggatgaagggaaaatatcattaatatctaacccacctccgctcattctcttacaaaatttgttagagctcgtgctatagctaactatagattttttctcgatcccatgttgtattcgcttcctttcaagtaaaagaacaaaaatggttcctcactaaattaaggcccctagcaaaagttcacatgatctttaatttgtagaactttcagagtaattaggagtagttaaatttcagcatgaatatataatcgggcaaaatctcacatccacaacatactccaatttgtgttgagttgaagagaatggaggccctatacttactcgagggagcaaattaaagatgaaaaaccttttcaggcatatgcttaaatttgtcaaagattatttcatgtttaatgtgaaatggtatatatgtgtatggacaactgatcattttccatttggatcttccatcagttggatgctagctgatgtacctggcctactatatgtcttttttttagataatggaatataacatactggcttttgctcaaagagctatagccaattattataatctcacacttaaaataaatgaagttcaaagaaacttaaaagatgaaaccaaccatcaagaagaaacaacctaaaaactgccaacccaagataaagagtacacaattactatatgtcttttaaaaggataattttgacattcttaagaaggtaccagaaggtatcatttttttttaaaaaaaaatagtacctccaaatactatatatgtatctcgaggtactaaaatttttagtgcaaaatttacctcgagatattttctcaagaaacgtaaaatttctccttttaaaaacatgtgtatatgttttctaaaatatgtgtgacactgtactaagataactaacagaggcagtatatattcaaggatgtgggtcctaaaagcatgcatatatcaggactcaggttgaagtgtgtgtccctagctagacgatatgcatgcatgggtcacatattcatgttatgcttgctaaaagccacccatcgaatcttggttaacaatacacatatatatgggtgaatagctaatttagtccctcaagtctcatcgaaggctcaatttgatccttcaggtttcgttttgtccacataggtcctctaaatatttgttttggcttaaactcatccttttacccacttaatatgttatatggctatttctagttaacatttctattagaaaatgtcccttttgcccttaatttgtaacaactatataatagaaaagagaaaaccaagatgaataaacaatgttgcatatgtaattcccattctttcaacatgtgcacatgaaacttaacctaatggctatcgtatacacttgcaagtacataatttattttcgttgtacataacttactatgcattatctataaaaaaaattcattgcatgcaattttttctcttatataagtgtatgatggggtataagtgtcatttatcgagagagttgttggttatgtttagccatgtggcttttaagtgggttcaaggataagtttgaactaaaattaaaacttgaagtactaatatggacaaattgacacattaaggactaaactaagcctcagatgaaacttggaggaccactttggctattcaccccatatatatcattcaaacgatacataaatcgacttgttgtaattgtgcacaactaactaacatttgaccaaattaattaaggggatgtaactcaagttagagccaggagatggatgcatatagaggagcaggcatggatggcagggcaagaggacagaaagaaaggacagggagaggaggagtagtgaaagatttgcacagtgggcagcagggcaggcaggcaggccaggtttgcagctctcaggggtcgtcgtcgtctctctcatctcatgtgagggaggccagaggtagaagacaacaagcaggagcctcctgatcgatagagatacctctagtgttgcattgcattggcgcccccctggccctgcatactcctgccatttcatgcagcattagctacacagatatatacactgctactgccactgcatgcacctctctcgctggctgcctcttgctgcagctagctgcatgccattgccatgcccttttaatttctttctttctctctttctcatcgatccatcgatcacctgtatgaatgccgtgcataatgcatcgatctgatgatgtgtgggggtgtcactggcatctgcatctgcattgccaaagtttttatatatatattcagagaactgatagatcgatctcctgggccccgtatacgcgcgtctccctcaccatgatccaagtatccaaccctctcgatctatcgctttatgcatcgtgtgtgtatatgtatgtatgatcgatcttgatcggaccacaaactaaactatagcatgcatagcagctgatagctgcagtcatctgcagcagggcaacgatgcaaaaagctcatgtgcatctcgatcatatggtcaatcagtacgcatgcatatgcaattatggtgtgtatgaatgcatgcataaccgagtgaaaaaaacaagtcaatgctcaccgttaagttgatcatatcaactgcattcaaaaacttgaaaaacgtgtgtctctcacatgtaacgaacgcgtatagacgttatagtcgaatgatacatatataaacgatgttcttgattcgtgcatggatatatacaagaacttaacatcgtgtgtcttctttatattgcattcatttatgttaatttgtaattcttatgctattatgtgaaacccgatgttagtattgatatataatctaaacttatggtgatatttttttcgttcttctgttgaaatttgtgcccataataatatacctgctatctatgattctaccagcttgctatttgctatttattaccttggttaatgggttaatacaatgagaccaattttcctcacttagggcaaaatcttcatcagcaaccttataaactaatattcctcagtgctaagtgctataaggttgtctgtgattctttgttatgtgttgtgattctttatactacgtgtgtgtgtatatatgcacttgttttcctggtgatgctaaccgaataggacttggtataattcaaaccaagtcctattcggcccaaaaggatatggccagcggttctatttttttccttggaaacagacgggagtttgtttctttttttaaaatcgaaaagattcgtttttttcgcccttttttttaccgcgtcgacggaatcggatttaattttttttaccgtgtcacattttttttaccatgtcgcatataatcggattcgattttttccgctcttttttcatgaacggacgacggaaacacttctaatttcttagtagagattatccggctagctgcctaaatccgaaaaaaaaacaaaactagttaaagtagctatagttggatcatcaaaatccgaactcgatcgtgtcaatattggttaatcgacacatcaataaacaagttttattatgcaagtatacctcataaatgtagtcgtcggcggcaaagaactaaaaaaagaaacactaaaagatcttagggatggaagacctacatgagtaaaacgaaagataggttcccttctccctcatcgttgtcatgagatgataatgtgtttgttggtactctgaccttagatgaatagatgagataacatgataattcattaagggtatgtatagtgtggcttgtgtaagctcttttagtgaaagctctgctgatattatgtagtttcaatgtaacttttaaccaattggaactataattgcatacaagctagttttagaattacattgttgttgttcacctcctcggaggcttcgccttagggttttgctcttcccgcggccttctgcggttcgtaatcttttttgcctcaggctttctgtgtcttttgtgtaaggtttttgccggtttcactttagcaaaccgtgcagttgtatggtttttgggcccgttccttataaacagggtcaactctatcattctaatatattcggcaatactcttgccgcttccacttaaaaaaaagaattacattcaactcagaaatggaggtgctcatatttggactaattaatttcacattagtttgtgccttttgatctggcaaccaatatttataattagatttaagtgcgagggtaccggaggacgtaagtagggagtaccggcgtcccttagagacactgtatatctctgtgatctgtccaaactatatatacatggggcttgcaatatctttgtgcaaaaaaacaacactacctcaaaaagcaaattaacgtacccctgccaatcagtggtcctcaatcataggctagctgaacacctacttcttacacatctgatcatcttaagtgtcaagcacatacactagtactagcactgctagctttgtaagaggtgtcccttgtcctcatgcagcactagctagcaagcaaagtcattcttgctatacccaaacccaacccaagctagggatgagatgagagggcttcactgactcaagcttgtcaaaaaggacggcgttcattctcaaaatgtcaacccacaggcctctcccattcattgacatcaatcttcatacatagtactatcatagtaaaatgatgtatatgtatatatatgtgtagtttacaaacgaggtaataaatagcttttgtagcggtcattataacgatagtggatttttacactggagtatatagcaacctctattgcaaccactacaagtagcacaacaaatatagcattttagaacttaatggccgttattgctcttaacgaccattattggctttgttgggctatattacacttaaacaatgttcttcacatatggataggagaaacttgaaagacaaagaacagctatagagggggggggtgaatatagcaattcaaatcttgcccccgaaaatactcatcaagccggatttctcaaaatccttactagaaccgcggctattagagaagccggatctagaaaagaagagagcaaaagaagagagaaggaattcccgaaactagaggaggaagagaaaaggaattcccgaaactagaagagaggtgaggaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaagcatacaccttcagaggaacattaacacaaacttaaaatctctcagacaaacacactccaaactaatcctaatacaaaagcctctcgggcaaacacactccaaactcacaccgaaactctctcaccgagcatctcaaaaggattgccaaaggagcaacatccacccttgcatccatctctctatttataggctaagacccctaagacattgtctcaaatacccctagggcgaaaccctaactcagaatggatctggtccacccattcttccttagaaccgaaggaagcctcctggatgcttgccacgtcgttgatccaaactctccacgccgcactgatccgcgtgctccctctccaaaccagtgacgagccgccacgtcacgcctcagcacgcgagagcgcgcgctccaccgcgtggatcccacgctcacctgcgcgcatccagtccaaagcctccacgtgtcccgccgagctgctcccacgcatgctcgcgaaatcgcgcgtgggtcccagtacaactcccgcctccgagccacttgaaacagcgtggaccccacgcccgcacgcgccgaattccttgccgccgcgtgtccactgcgcgcgcgtgcctcgcgcgatctcccgcgcttgcccgcgcatggtgccaatgccgtgggccgtcgtcttgtcttgggcctgctcggcctggcctccctgcctgctgatccatccatcatcttgagccatgaggaagggctggattggcttggcctccctgccaaccaatcacagctcacatgcacccatgggctagcaagctcctcatgcacacatgcatgtcttgcgcccgtgcatgacattcggccatgtgcacgcatgcacaaccgaagcaccactgtccatgcttgcatatgcacatgccagtgcatgtatacaagctcctcttccattctccattctgttcgcgaacccggcacttgcacttgaccttgcgaagtccgttgcgaagacctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccggtacttgtcaatttcccatcacaaaagaactataaccacacatggtttcacaatctcccccttgatgggaacattgacaatcccaagcaaaaattttgaaaatttgatttttgattcacaaagcaaaccattttgcaaacgtcgaactttggtcattttgaaatcgcgaaaaatcaagaccaagtgaagtgacaagaagaaaagggatgcgaatgcaaatgcaagaatgctccccctatgtgccaaactccccctttcaccaagatctaaagcaagttttttaattttcaataagtgcaaatttctctccccctttgtcaatgatgccatcaagatcaaaagagacaaaaatgcaagataaaaatgagatgaaacttacaaattttagtgttttgagagctttgagagttatctaaaggcatcaaaaggtagacatggatcacacagatacaagcatgtgctcaagcctagctaagcatgtgcataagaagtatgaaacaggtcatggatatcaagttagtatcgccagcaagcaaaaagttttcaagtgaattagtgatttagtgtgcaaagctatttctagaagaagcttaaaaggaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatttttaagattgttttttaatttctttaaagacaatagcacaatcacgacggtccacctgatcttatcagtcagcaagtgatggttgtgccaaacactgccgtctgacctcaatcaagtgttccagctagagttcccattacaggctgtctcagtgctatcttcggcactactcatgcgtaaacgcactcagtagcccggacaaaaacagagataaagcttgtaaagcatgattgatacaaagtatggacgcataagcatgagcattcataagcatgtactgacagttattgcaaaaagaatgtaaacatggcatgagtatgagagggatacttcaatttaaacaaacttctagagcaagcattgcacattgattaagttcaaatgaatagtcaatttaagcaggtttcaacaagcttgaacagcataacatgatcacacaagctacttaagcaaatgaaagctagacaagagatcaaactagcaaaagagtgatacatgcatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacatgcactagcagcagctacgtactcagcctcagctgttgattgagcaacagaagactgcttacgagaggaccaagagaccaaagacgtgccaagaaaatgacaagtgccagaagtacttttgcgatcaatcttacaccca

SEQ ID NO: 56041 - DNA, 2520 bp, Oryza sativa
gcatctagtactacgaatctacacagatagtgcatcctagtactacgaatctgggcaggctcatgtctagattcttagtactaggatgcatcacatcccttcaaaatctactccttatattatggaacggagggattagtccaatgtcagcccactatttgctatttaattattactaggagtactttgtttacaaggttaatatatatatgcaatgtggattgattgatcttaagcaattttagagatataagatgaaaactaatcttcctatcctatcataataactttggggctcgcaagaaaaagttgttgccttagcttattagcagcacccgtatcgagataggtcactaatgcgtgtttaattaagaattccgtagttttaggatgtgtcgtcccatccatctaagatcctttatattttgtgacggatggactacctatcataaacataaaatctagatttgttttatttttaaagaaacttttatatagtgattttttttaaaaaaaaacatttaacaatttagaaagtcctcacgataaaatagaaagtagccaagcgaatcccagatcagcctataaccatatatactttaacaaataaaataagtattccctatacatatatgtcatttagtgattattctaagctagttttgggctagagttcaccaaagttacaccacacttacacaccggctgagaataatcacaaaatgatctggtgccaaaggttgatgttcttttttccttcttgcaaggaaaataaactctataaccctccatatatatatggctgaactagtaccaatcatctcgaccaacagcagcagcattgcgctgtcgtcctcctacatctacggtggatcaatgccccagtacctaccactactgtcttctttattttctttgagaagaacttcacttcacctctagtggatggatggtgcaattaaatgatgctaatcaaacacccgtagctatagctagtaaatgcaaaaaacagttatccaccatgaaaaaaggctctcatcttctgtctcctgaagaagaaaaggaagaagacgaagatggaatcgatcgaattcacaccaaaattggaagtttgattgaaattggaataatgtgatggaaaagttagaaatttatgtgtgtaggaaagttttgatgtgatagaaaagttgaaagttggaagaaaaattttgtaaatcgaccaaatgtcaaaccaaggtctctgatgcctggctgctactccatcagttgactttgcaacgggtagccggccggtaagccatggcagtagctaagataggaggcggcagcaaagcaaagtcactgcaaaaaatgctttgatcggtgtgcatgtccactgcaaaaatgctttccaatttaggcgccacataaactggtagcctttcgccgtcctaggctctgcatggtccgtgcctttcatgtccagggacaccaacgcctgaaaatgtggattgcagtaataatggaggaaaagataggacggcaatgtactactccctcattgtaacgtttgaccatttgttttattcaattttttttgtaaatataaaaaacgaaaagttgtgcttaaagtattgtagataataaaataagtcacaaataaaataaataataatttcaaaaaaaattgaataagacgagtggtcaaacgttgcaagcaaaaactcaaaatcccttatattatgggacggagggagtatactattgcaggacattaaccatcaggcataaaccaaccacaagaaacatgtagtacattcatttgattaggaatttgtgattggagtatatctcttctcttctctcctgtccagttcttcagaatacatgcaggttggatgcaagaacacaaggatttcaggattcacctaaattgtctgtatgtattgatgtgtacatatatatagattatagagtaagttacatggactgattggtctttcagcactacaaaatatactgcactgagtcttgagtttgtggtttgcttgctgtgtatctacttacatggtaacatatctgcactatgctatattcaatgaaattggcacactctgtgccggttcgttcaaaaacatatctgcactagagtatagttctatgtaaataattcaggtctttgccaatgaatacaactgtgaaggctattctttgttcctgtgtattggttgttaactagtagggcatccttgccggaccagaggatgttctgacgatttcagaaccaagctcttgtattttacgcaacaaagccgctttctcccgctcaagctgctgtatgtacatgtcttgctcatcctggatgctttcaatctctgtcaaggccagtgacatggcctctgtgtcgccaccctcatcaactaaacctgtgaatttcttcaggctatctctcatctgttgaaaaaaaacacatgatgttcatcacaaaattgtcatgcataccaaagaggatactgagaggaatgtggcaatattgttatg

SEQ ID NO: 56042 - DNA, 1232 bp, Oryza sativa
tgcgatgatatcttgtgccctttgccaagggaagatgcatcagtctgaaagcttgttttcttctccaagtgtggtacttttcgcgtgatctttacatggacttctccgctttttactccttggagtggtatccattttacggcgggctgatttggaggaagcatgctgtattcgacagtgcattggcctatactagcagttggaaggactgcattatggtccttgacatgtaaaatcaggggttctcctgtttctggaaactcaaatgtctggttccaatctggagagagtgttttgtaaacaacctgcatggaatgagttactcagaatttctgatcaaatggattgttttttatagggtgattcatagtatctgtagaacagaatgaccatatataattctccagtctccaattagcgccaaaaaaggttttgttttttccttttataataacatactaaaactaacgagctattgctctataggtttcctctagtatgtgaggaggtaccacattttcaagagttaattcgtagcacctcgtagaggacctttgaaaagcccattttcctattgaagttcttatgttattctaaaccaagcacggactgctacaggctgaaagatttggactaatctgaattgatcatatgcacaccatctgaagatgccaagtgctgtactgtgtcagcatatttgttcatttctattacttcaaaacgccaacaaattcacatttcgcatgtcagaaaagcaatgcatgctgcatttcctaataaaggcatagtaaataactaaatacagaaaggttcaccaccaaaccttagttcgcttcttcttgctcccataatgcaccctgacataaggatcactagtgcctctgagatcagcagcaataagatccctagcttcaattatcactagctcaatccaggtagcttcaactctaccacttgaagtctgcttaagaagaacaatacagaatccagagaaacatcagtagacaaaatggtacaacagagcaaacggtataaaactaatgtttggtacagaatcaaggatatagaacatgttgctggaggtttcatgtgtagaaaaatagttgtactcaacatcccaaatttaaaatttttactgcgcatcctcttaagaaaaaatgtttctgacgctgatttcgcaaatgtatatatttttctgaattaagaatcctcgcaatattaaaattcaatgc

SEQ ID NO: 56043 - DNA, 8741 bp, Oryza sativa
agagtgacagttaactgcaagggaaagagtttggaacagtattacacaactatccagaccaaataaactagaaaaggagaaatggcacagttaaccagttcgcagttgaataggtaggtgaaaaatgggcacattattgttggaaccttcatgaatgtcacggtagaaatgataaaaggaagttctccactaaaattgttaacttgggaacagaaacatcataattcatcatcaaaaccccacatttctggtcactctatcagtagtctatcctttatgtattatatctccagagctctcaagcccaactgaatgaaaccattgttacttccacaggttgtttctaaaaaaaaagggctgaacattttcctgatcctctctcttccgatcttgattccaaaagcgctaccaattcaacaggtcgaacttactcttttgtaatttataaaacaacccaactgtaaataaagttcaacagaaaatcaaatgtaggactatgggtcattagaactttaggctatacaagtagctgaggacctgaggtcctaaactcctaaaatctgttacttcacagtttgtatcgagtatatcaaatatggcataatttcaaacctgataggctagtgaaaatttgcttcggtggcttgataaaactaattagcacttcaatcaattgggaatccatttttctaaatgttacagcatatccaaaacaggttttggatgcaagagaaacagtgacaacacatcagtagttactatagagatgtacctcgcccctgatgtcctcaaatggaacaaccattccaacttcttgtccacaaagctcagtacgttttgcaacagcaccagaattatgtcctatagcccaaaatattgttgaatcatctagaacatacttgacctgtttacattactttcatcagcatcctttagatgtgttggaagaaccacaactgcatcatgtgcaatggaaactgactaaaataataagtttaactgtcatacctttatctggcagcttgtcaagtaggtgaccttaacaccaccagagtccaattcatacagattgaacttgacaacacctgtctctccatgcaataccaggttaaatgtgctattccatgcagggtttggacccttgcttgtacttgtttttctcactaaactaccaacttctacctcaataaatgtctgtgataccttgttatcagcaattccagatgtagaacctccacttgagctttggcggatccctatttcattagttgtgtttctcccaacgttactagctgaaacaactgtgactgaaagaacacctccaactgctcgtttccttaaatctactggtggcaaagaaaaacacaatctgcgaggctcaaccattgtcttcactatggtttcggtcaaaagcttaacctgcatggctcatgaagcatcacatttagcattcaaatttcaatacgcaatggccgtaattgcactaaaagaattgcaaagataccaaggactaactaaatggcacacacaaacccaccagccatgttgagacaccgggtagctccataccaggaactgcttggcttccaccacttccaaatgccactcctatcctgacttctggagtggattcaaaagaataaagaatagcttcaccatcaaggatgggtaacagtagaagctgcaaagatatagtttaaatcgaagaaaataagagcttaatctgatgagccaactagaaaatgcgcttagacaagaaaataatcgtcaaatacagatataatactcaggacaagaaagcaaataaaagattttaacgtaagtggtgatccaagttcttatccacacaaaatttattgtgtttcaacaaaacgctaaagtgaaatagctcaaaataaggttgccactttatcctatgtgagaggcaggttaactacatcataatatcctatgtcaaccattaaggacaggaatgactccgaaaagccaaaaccatttttgttcatcatgattgttcattatcagctttgcgatctcagtgagcaaagctggcgacaattcttgcttaccaattcaaaagaagtctctctcaaatcaagataaatgagaaataacaataacaataacaataacaatgtaacagaatcaattgaaagagcaaaggacatacatctcccttgatgtgaatgctgtttataacaattcgagcagcgccaatcagtggttttgctaattttgccaaaaacattacactcatctcattgctgtcccaatcaaaacccaagcgcatgactttctgcatgttcaaaaaacgagagttgaagtgtgcaactgtacaaccaacagaagtatttcatctgcctctcctacttacaacataatattgttcaagatggaacaactaatgactaaggctatgcaggatcaggaagagctgcagaacatgttatatattcctaacagataatggaagaacacatgggttagttacagataatggaagaacacatgggttagttatacagatgcatagttataatcagaaaaggtgaataaaccattgatgacactgcattcgttagtgttttcaatgatgtaaggataagttaaccaaactagtacccaaaacagcacaactcggaatttatgaagcagagcaaataagctaaatcaccgctgttataattctgtagaactaaaaacagcataagcagttctttcaataatgatcagtgcctgaggcaatgatttcctccctctctaagtttaccacaggtgagtatcccatacacagtacagaatattaatatctgacctggtcacctgaagtcatccagcgcatcccatgctcccccaaggtaggtggacaacaaccaagtgagaattcctgtaactctattttatcctggagagatataaaagcaaatcattagtactacagtcagaatagcagcaggagaggataaacaactttaagagaacttactattagttttggttttcgatgctttaaacgtttctgcaaattcagagaacactcactggtcagctggttataaaaaaagcagaatagaagccagtgtgcaccatatcttgcaatgcatattgactatttgactacaacaaataaataggagcaatggagctgagaaaaaaaaatggccaggccggcagcgaagaagtgccccagccaattttattaagattggagaaggttaaaacaattgggcaacaaacatggttgttgttttacaacaagctgagaaattttctaatgaattttattttgagataatcatcaccaaagaaactcaaaaggtatatttccaaaagcttttaaaaccaataattattacatccaagcaaaaactattagacgtaatagaaactttcacaaatgatagcaccttcattttctagcatcctagtgctcaaaagattcataaaattatctagcaaatgtgcagaagctgacctcaacagtagattgaaacttctttgacagttttggttccatataattgggccaaacttctaccaaaagtttgttcaaccactcgcaaggctctattggcgtcgtaggctacaagagatacaaaaggggtattgctaaaagttcatgtataaagagcaaaacaaaaaaaaataagtgaaggaatatactgttgtattcagtataagatgcttccatcgtttgttcaaatcttctatggctgacctccttttaaacctcccatactgcattcatcattaaaataaaaatagtaagaagacaaaataaactctagaaagtggggcgaggtgtttctctgtgttattcttttcagaattatgaacactctgcaactcaaaagaatagatcagcacttccaaaccaagcaacaagcaatacttgcagtaaattagtactatctcaacacctagaaaaggactatttgtctgacaattcagcaggacatcaaagaagccaagccaaattcatcaaagaacaactttatccatatgaataccatgggaaggaaaaactacctgaattgttgcccatacagcagccaacaggggaacccagtttgagaatggcacaacccatcgttcaacaaaccatgcaaacaagacaagagggaccaggaaggggagcaagggctgctccaccatgacctggttgaaaaattctagtgcatccttggcatgcaatttcttcagcttcttcttcgccatctctcctccctgctgctctgtgaattcagcaaagctctcttctctgataaccacacagagcttgatgcagataccttttgttgttttttttggcctttgtttccactgcttcccgagttcctgtcactggccccttttgcactgtgggtattggatacctgtccacctacaattttggttccaattaatggccacagcaagatagacacctaagataaagcatgtatgattgcgacctattgctcccagacttgcgagatatttcaccacttctagaatggaacaatgaagagaaaacctccaaatttttcattctttcaggcagcgtgttctattagcacgaataaacaagaaattgacccaattgatggccctaacaaagtcaacagctggattataccactaagattcgttctagttctggaccacataaacgagagagagagagaagtccaagccgcagaaccattacagtgtgcgtacacatctggccaagaaattcttgtgaaaacaaccaagcagcataggagccaccaaagcctgaaacgtcacattcgaacaggaaaaaaacacatccatgttcttgacaacccaaatgctaacctccatgaaacccaaatagatcccctgtaaactgtaaaaaaaaatccgctaaaaaatctgcaatttaacactgactgacgtgtacccagcgagtagaataaactgcatgctccaatccaacccagtcaagaagaactcctcacccgtcgagtcgccaacgctatggccaggtccctgcacccatggagattgattcgcgcagagacaccgtgaggccaagcagacaggagatcgagaggagcagagaaggagagtcgcgaaggctaaccggaggcggagaaggcgaggtggctccactccacgcacgcaatagggaggagttgaaaaaactgcagctttcccccttcagagttgctacgaattccacgaactgcttccaagatgcctcctttccgatccaatccgccgcaaccgcatccggcgaaatcaccagccttccccgccggcgactgttcttccccgcctcctccaagaggggaagttggcagaggtcaaactttgcaagtttggaatgattctataaactccaagaaccaagaaccagggtgggacaaaggggggaaattttattttttgtgagttgaggggggctctgatttgttggaactggaagcgattgggcggcagaatcaagtagtagtggatttcagtgtgctgggacaggagggaacgaacgcgtcaaaatcgggctcgtgcgtgttcgtcaatcgtcagcggcgcagcgctcttctgtgccacgctggctctcattggtttgtactcctactccgtagtaccttggaatgcgactgatttttttgatcgatctcttgtttgtttctttgggttaattggaaccatgccattacaacttcagctatttggaaatatgccattacaattagcaaaaccggctgggtgccatcgcaatttcttccaaattggaaccatgccattatatacgtctgaattgccatccatgccatttgtcctcgcacgtatttccgtatggacgcttgtgcccctggctgagacgatacaagccaaccatcccggtccggctcaaccatctctgttccccattccctattccccattgtctgcaaaccctagctcgccgacggcgatctcgacggcgatcggtgcagcgccggcgacgacgacgggggctagggatacggcgccggcgacgacgacgggggctagggatacggcggcggctttaccgatagcttctcccggcgtagacggatcaacgcggcaacgagtttggaggcgagctataccagtggcagtggtcgctctgcaatttcgagaaggtgcagagtcccatcggtggctccttcaatcccagagctgaaatgtgcttgtgggcatgccgctgcggtgcagacatcgaacacaccaaggaatccaaggcggcggtggctgcagtgtcctggggaggtgagaatccagtcctacttgtgcatatttgtgtgtgattttctttctgaatccaatctggtttccttcttgtagaattgtagatgtgccttgtggatttgggaagatctcaacgaatacgttgaggagatggtcgcttactgtcatgctgacgagtacgactatcttagagagacatgcgacagtttgcgccagtttatagcagatcaaagacatgcatatctctcagttgtcagcctaggctgaggcaaaagagttgcagttgcaagccaattacgaagctttgaatcagtccaagttggggtgtgcagacttaaagaagaaattggagtgcgagaaggcttggactcgcacaattgtgtccatgatgatcttgttctatgtgttgttagttgctgtaatgataaggcaggtttaggagatgttctgtgtgatgtctggtgtgtgaaatattgtgatgtaccttaggtgtgtgaaatctggtgtgtgtatttatgtttgtgcaagttggggaatgcaatgcaagggctatattttggaatctggtgcaaataatctgctgcctaacatagaagctgtttatgtgcaatggtgactgaaataaatttgctgacataaatgacataaacttactgacataaatgacataacttgctcacataactgacataaacttgttcagaagtgtagcaactgacataacttgttcaggagtgtagcatagaccaacatgcagcacacaaaagacagaacatttcaggtttggagcccattaccatggccaatatctaacaagtccaaatggccatctacaagcagcaaaataaacaagtttgggtttttacatcacagaccaacctagtctgataattttctaactactctagcgggtggagcagtagaagcaacaagattcttcctcttctggggagttttcttcttcttaggagtatttttcttcttgacaggtgcagatgaacttgcttcagctgcagctccaggcactcctttcttcttaggagggtttttcttcttgactggtgcagcttcggcctgacctgcagcttcagccacttgtctcttcctgcacacagatagtaccattagggaagttttgaggtagtcaatttgtggactaaatagaaagaagtccaaattacctttttttggttgttggctggattgtttgctcatcttgatgaactggctcagcaagtttgcatatcttttcaaagtgaccaaaaccctgacatctcttgcatgtaactctcttcctgccaggttgttctaaacaatctcttattctttgcactctaggtcttccagcacctctcttctacctaggtgggtataccttgaagccaagatctacatgtggccactgagacctatcagtcattgttgccactctagctgcataagctgctctaaaggtctgaacactatagtagggactgacaaaatcttggattcgacctctgttagtgcaaatccaggccaatgcatgtttgcatggctttcaacttgccataccctacatgagcagttttggttctgtaaatcaactgtgtgccttctagtgttgttgtcagactcaacaagtgtcacttctgcgaaaccttcatcgcttctaacaacctttaccaccctgagacagacagttgcatcattcaattctttcattacatttggcaggatgccatccacaagctttttaccaacttctctcctgagggccatcttctccatgatcatctccctgatcccatccacaagttcatgcaacaacagacctttaagcttcttgatctggttattgaaactttcagaaacattgtttgtgaggtagtcacacttgctagactcagaaaagccacatctgtaccaaatccttgagtgatgcttctcaagatactctattgcatcagacctcacttggtatatttgttgcatgtaccacctaaatccatcctcagtataacttcttgcagttggatacaggtgatcagtgaaggcaggaccttgaaacttcttcatgaagttagcatagagatgcctcatgcattctctgtgctcaactttttcaaatgcagcatcaacagctttttccaaacccttacaagcatctgttgatataactaggccctctggattatctatggccttattgaggtgtctcatgaaccataaccaattttcatcagtttcagagtcaaaaattgaataggatacatagaacaaccaattatgtccatctacactagtggcagcagctagttgaccagtatatttacctgtcaatcttgttgaatcaacaccaacatagggcctgcagccattgaggaagccatctatgcaaggcttcagaacaacaaacatcctcttgaagcacattttcttccctatcttctgtacatcaatctctacaatagaccctggggacttcctctccatctcagatttccaattaaaaagaaattggaagctctcttcat

SEQ ID NO: 56044 - DNA, 3870 bp, Oryza sativa
aaacacaaaaccttttttaactgcatagtgcctttattgcttttctgaaagcaattatatcaggaaataatgcatctttctctatttttggattctcagggtcacgtatgacattaaagacctatggatcttcatcagtaacctactcctcaggagctctcacccctgcaacaggaggctgagaagactgaccagtgccagtgtttccatcgggttcagcaaactgtggaggctttttaggttgtgagggaacatacaaatgctcatcatcgacacccacatattcttcctcattgtcaaatatgtctggttctctaacaggttcttcctctattgcaggcttttcaacaccttcaacattgggagcgggctgttcagaaccaatgatgggagcagagttgtcaggaggcacaacacatatgggttctacttcattctcgacaagggtggataaaggctcagatgtaccatccatcttattgtcaagcactgaaacaataagattgaattggctctctgttttgtacatttcgaataggtcaggtagctgactattgtccacaagtctaacatcctcaccaatcgccttgtgcaaaaaccagattgaaggagattgatttgttccccaggtgaactcaacacttaaagtattcatcagaaattccatggaaaagctatctgaatccacaacccaatgccgagtagctcctttcgtgtaagatttcctaccatctgtttctatcatgacataagctccaaccctaacctctactgaaaaccagtgcctaccatgaaaggagagaacatcaactgaaaatctacatgtaaatacgatgaaatacccaatgcacttctacatcagctatccaaggagtatattcgagttcaagttactcacggtatcgaggaaataggaggaatcgagcctcccagatccatcccctccatcggcaatttcgctgcgcacgatgatgtcgcaggtgaacttgcgatcttcaggggaacttctacatcgtgggtcgtcgtcgccggcgccgtatccatagcccccgttgtcgtcgccggcgctgcaacgattgccgtcgagatcgccgtcggcgagctagggttttgcagacaatggggaatggggaatggggaacagagatggttgagccggaccaggggggcctcgcccagcgcctctcagagatgaccggggccctcgagcgactccccgaggagctcgaggagacgatcaagtcatcctcgagggacctcgcccggggggcggtggagctcgtactggcaagctaccaggccagggaccctgacttctccccgtgggcagcgctggaagagttccctcccgggaccgaggacggcgcgcgcgcgaaggtccgggacgccaccgaccatatcgtccacagcttcgagggtacggcccctcggctcgcgttcgcgctcgacttcgatgaggagggcagtgacgacggtgcggacgacagcgacgacgaggccgacgtcccgggcgcgtcggagtgagcccccaggcccccgccaatcttaataacttttgcttcttcttccgaggccttcgggcccccttcttgtatagactgatttaatctgtaatcaaataaagaggaaatttctgcgtcagctctgcttgttgtgtgtatgagacgaggatggtctgtgccgcggtccttctttgtcttggcttgaacaagggctcgtgcccaggtcccagcctcaaacggcgcgggtcggggctagtgcctggggagatccacgtgtcgagactggccaggccgggagcgcggtgaccaagggttatggatgacccgattgtgggcctttgccgattcccccccgaagttcaccacgccccggggcacggctcggttctgggccccgtttggcgattttagctggcccgggccgccgagggcaaggtcgagcacgagcgtgctaattcaagccaagattcttcaaaaggaaaacgatggcacagacacagtcctcaagaaatcgaaaatgcttttattgaaatacggaagagaaaaaaggtaagtatatgcatgtggtagcccccggccaactctgcacgcccggggggtgcggggttggcccgagcccgagacatgatacccgacccccactaggggtagaagcgacgaaggtgctcgatgttccacgggttaggcagctctgtgccgtcgcccgtggcgagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggatctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttggggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggccttgccatccgaggtgcgtgaggcggagtgggctccgcactcgccttcatggacatcggcgagaaactcgacgccttgttcccgaggaatgcacttcaggaggactccgttagccgcacgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcggatcccgaggcctggactccgacgggcctcgggggccgttcaggcgcgtccgtctcccctagggggtcgggtcgcgccgacggctgggcgagcctttcttcaaaggcgcccggtggggtctgggctcgcgaggaagcgagccttgagagttcgtcggcgaccgcgttatcccgtctgggcacgtgccgaagttctatcccgtcgaagtggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactcagccatattgttggtcgcccgaaagtcaaggcggaccaggtatctgaggacgtctccgctcggggaggtcaacatga

SEQ ID NO: 56045 - DNA, 7842 bp, Oryza sativa
tctgaggacgtctccgctcggcgaggtcaacatgacccccgcaccggcgccctgaagagacagggagccgtcgaactgcatcaccaagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatttcaccacccgtccagtaccctctcggttatgcaagatttggccgagggggtaagacgtgaccaccgtgacccgatgcgcctggaaataatggcgcaacttcctcgaagccatcagaatagcgtaaagcatcttctaggcctgagggtatcgggtcttggcgtcccggagggcctcactaacgaagtagacgggccgctgcacctttcggcggggccgatcctcttcgccaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggcctcgggccgccgttcggctcgggggcctctcctgcctgctctctcccgggtcgagtcgacgcagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgagggcccgctcagcctcctccgtccaggtaaacggcccggagcatttgaggagcttaaataggggcagtgccttctctcccagcctcgatatgaaccgacttagggcggccatgcagccggtgacgcactgcacatccctaagcttgctggggggggcgcatccgctctatagctcgtatcttctcggggttggcctcgatgcctcgggcagagaccaagaacccgagaagcttgcccgcaggcacgccgaacacgcacttattggggttcagctttatgcgggcggagcggagactttcgaaagtttccgctagatctgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagtttctatgggggtaatgaatgcagttttttcctcatcctccctagccatgcgaatctgatgataaccagagtatgcatctagaaaacacaaaaggtcgcaccccgcagtggagtcgacaatctgatctatgcgtggcagggggtaagggtccttaggacgtgccttgttaaggtcggtgtagtcgatgcacatccgaagcttgccgttcgccttgggaacgacgaccgggttcgccagccactccggatggatgacctcacggatgaatccggcctccagaagtcgcgccacctcctcacggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctccttgaccggaacctcgtcgcacgtgaccatccgctgccttggggcggccgggacggaggtggtgagcctctcgtcgccacccgcgggcttggacgccgcggcgaggtggtccgcgcgctgctccatacaagcaagcgcgactttgaggtcgccatggacggtgatggggccaccggggccgggcatcttcatctggagatatgcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgttgatgtcctcggcggtggccttctgcttggcctcacctcgccggttgccggcgggagccgccggggtcttgccctcacggcgctcctgcctcttctcctcctcccacttcctcgtccgctcagccaagcttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccacgaagcgccctcgacggcgaggacatgaccctcgtcgtcggaacgggccggccccttcttcctcctcctgttccgccgctctgaccgagtggcggacccgggggcggccggagctgtcacaccagagccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacaaaaccgctgaatgtacgagcgaagagactcatcgtcccttcgctgtaccgcatgcaagtccgcttcttcacctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcgcccccggcggcctcgatcccggtcgtgtagatctggagaaactcggcggggttgacgcttccgtcgtatttttcggtgacggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccattgcgtgggcggcgtgacgagcgtcgcgccggcgctcgatatcgaggcgggcatccggccccccacgcatatctccttgggtcggaggcgtcgacgagggaatggcggacgaacggcgggtaacggccgccgctcgccgcgccctccgcctcgacgacgtggagccggcggcgggagcgccagaggtctcggtggcggaggaccgcccgccggcgcctaggcgctgctgcgccgtcatgaccaagtcggccacatcatccagccaacgccgagctggagtctctggatcggggacgacgggcgggtgacgcaggagcgcgcccgcagcctggagcgcaccctggggcgtgccgccattgccgtagacgaggcggcgacgcgccccgtctcgccgtcctcccccgtcgcccgcgggcggcgaagtcgcggatcctccggcctccccgagcgcctccccccgcccaagatttcggcgagagggggacggtggggtgcgagcccgacggcgcgggttctgctccccgtcgtcaccgctagcgttcggagagaggctgtgcgcccctgcccgttcggccattgggctgagcgggagaagcttggcgcacacgaaagaggacgagggcttagaaagacacgcgcgccccctacctggcgcgccagatgacggagcgtggggctcctcaccgggagactacgcaggcccccctttgccggttcggccgggggcgctaagtgaggttcttcgccctcgatctgaggaacgtcagcgagagaagaaatgcgcaagacacgggcgacgtagacaggttcgggccgctgagaagcgtaacaccctactcctgtgttctggtggatctgtgtgtgaaggaatccagagactcgagagcgagagagagagttcaggttctagccaacattcgccagagtcccaactcccctttcgtcctcccttttttttaggcctgggcctcctttttatctggtcaggggtcaccacatgggcctctagctacctaagaaaggaaacatgcttttacaatgagggctagtctacagccggaagtgacctctgacaagccgagcgcacgtctcttgctccgctcgcccctcttccggtggacgcccatttcaaccttcatttaatggccagcgacttccttgtcatacttgcgctgaagcctggaatgaatctgaccgggactgacatacccactcctggagttggcacgccggctccggctagggacgagagctaggaagatctcatcattccgacgggacggggcgaggcgtgtggcaggccgcctgttgccacctaacccgcgatctgaccggtctgtgaccggtcactcaccgcgatcggtcacggaccgaataagcgtgcgctgcgccgcattaaatgcggcgtggcgcgctcgtccaacctgctataaatgcggttaggtgagcccgctgtgctcacctaacccacacacgtggcgccaaaaccacagggggtcggggcaccccagccctcggggccgaaacgggagcggcccgacccctcggggagacagagggaggggtggccacgtcaccttcgggcccgactcccccgagggggtcaggccacgtgggtgaccgcggctacccaggcctctagtcacgatacccccggccccatgtcaccgacacggtccttaattgaccggggacggtactagccttttccagataccacccaaatcctctgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaataaaacaatttcgcaattgggatcaacatgttcaaggaatagtgatgacttgccttgctcaggatagtccttattcttgatataattcttgatcaaccttcacctcctggaagttgctgacgttgcctcacgactaaccgatacataaattctataacacgcaagaaaaaccaatattcaaataacaaccaaatatgcacaacaaaatatactattcatgtcttctaatggattccaatcacgctaggggctaaggtttcttaatctttctattgtcaacgtggcctatttaggagttaaccaacatagcatttataggatacatatatatttggctaatcggtggtttagtctatcaaatggctatggaaggattatggctaagcatgcatctatctacataggacggttatttactagaggttctgttgttagatggatttaggatcaatcaaataattacagtgaatcatttgtattatttattttattgatggaagctttactttaattatgaacatattttacttgtcacaataaattataaaaggttaataattatccatgctttgtatgttagagttgtttaggttaatcatattatggttacagattatcccatcacataattttacaatgaataatcctaatttacagttgaactataattataattatatgaggtcaagatttataactagtatttatctaatatacatgtttgtcatacactccctcttaatttaatatatgcaacacgcaaattaatactataccgtaccactataatgggatgtatagtatatgtgtaagcaacaatatcttattattggatcatatatttgagtagttgctttttactgtaagctatacaatacatgttgattttaagatggctctgtttggttaactaatggatatcaaccgactatatacatatattctacttcacatgacattgtatcgacaaatttttaagtggtccaaatacaactagctctatgattactctcctaaacaagttaaagattcatctatgtgtgtttatattttagttacaaaatatgaggctaaactttatgtaaacaatttataagtcatggatttagttatatttggacatagaccagtaaatagcactaatattttcctatacacccattaatttgaaggattgattataactaatttatttagttgctacagtgacaagacatgttaaagataattatgctactgtacaatatccatttttattcattggcacactatttaggttaactattatctaatcatttgatattaattaatttataattataaatatattttgttaaatactgaattatatatcattggaaagcttatgaatttagatgaatttaggttcaagtttcactcaaatccaagttaaaatgaataagttatgctagtgtaaagattcaaatttgaattaatccgagaaattgcgaaaagctactgttcataaatgatttatttttaatccaagacatatccacagccttgtaccaactgacaagtgggaccccgggtttatttctttttcctaccgaattattttctaaagggaaataggaagagctaatgacaagtggggcccacatgtcatagactcgagaccataaaacttctataattagatttttaaccacccggacctacatgtaatagacactactaataaagattaagaagggggttactattcaccaattacgtggggcccactctaatctctcctctccttcctctctctttcttcttttatctctttctctccctcccggcttcttctccctcctctctccctcggctctctggcgacggcgaccgagcaaggggaggaggcggcggcttactgacggcggcggcggcgacggcggcgcaaggcggcgacgcacggcgcggcggcttcgaggcgacggcgcggcggcacgaaggcggcggcgcggtggagagaaagggggaaagaaaggaggggaaggagggggggtgatgtgggatggaagggcgaccggaggggatttatagggcgcgggggaggggcggccggctccatggcgatgcgaccgcgcgcgg

SEQ ID NO: 56046 - DNA, 2471 bp, Oryza sativa
gggcttggcgcgcggcgatggcggcacgacggcgacgggcgacgcgatagtgacggggcgtgacgcgcggaggggtggggctcgaggcgatgcgaccggagacggcgacggcgcgcggcacgacgagacgcgagggggcgcggcagtggcgcgcgcggcagcggcgaagtgacggcgcgcggcggctcgaggcgcgaggcgcgcgcgggaggggagatgggacgggcgcgcggcggggcaggggcgcggggcacgaggcgacgacgtgacgacgacgacgatggcgcgcggggctcaaggcggtgatggcgacggcgcggtggcgacggcgacggctcgacggcgacggcgatggcgcgcggcagcggcgcgggcgacgacgatggcgacacgagcggcatcgggcaggagaaggaggaggggtaggacggctaggaactaaatcgaacacctagggggctaatgaacagtgctagccggctatttaaccctattttagcctattcctatataaattttattctataaatcctaatttttacacaaatgaagtttactcaatatttgtgttattctaaccaatggattcaccctagattaatattacccatatttatttatttatcgcacaaatgaattctttttagattaatttgagttattggccctaaggtgaacttatatatttttgaagactttggggtactattaaatttaatataacgacttgtcatgattaatacattagcagattggtcaagtttagttgtatagcaatatattttacacggataggttcaatctatttattctataaatagtaaattgagactcggcacaatattaatctaattgtttaattaaaacctcacaaaattttataaagcttaatttaattatatgaccattatttcatgtgaattggtttacctttatatatatagaccattagagtttagtaatatcccattaattactcctagtgaaactatgttatagatagagttccattataaatggtcatcatttcatgtgtatttagacgtcatggcacgcaacacatggttcacgtatttagtatttaatccataatttaaattagtaattaaccttccgtttgtctggctttgttttcttgtgcgtaattatttgtagggttaacaatattatattctcgtaaatttatctattacttaaattttagatccttactttactttctttgtgatcatttacggtttggcaagcaatagcaatcataacaaccagcatgatgtaaaagttttaaaaagttcaaaattttagtgatttttattgtcttgaattttcaggatgttacaagtctcttccaaggagttctggtgctggccgcgtgaaggaagtggctcctcgatggcttggctgatgtccattgttatatgtcagagctgcttttcgctttggcgactttcgtgtcttcagtgtcgctgcagttgtgaagtcggcgctgctgggtcgcttgggcggatagctcggcaatgataacacctcttctacgatgtgggagttgttatgtcgcttttgtgtttagcttggcggtgacatcctgcttttgggctccgccgtcgttgttagttgtgtagcggtgggtttcagccggttttactataattaaccgtgtaattgtgtggttttcaggcccggttttccttataaactgggtcaattctcttcttctaaatataaaagtggaacaaagttccgccttaggtttcaaaaaaaaaaacactctgtagaatctaaccaaactaagaccctgtatagtttcaaaaatatcacatcgaatctttagacacatgcatagagtattaaatatagataaattaaaaaaactaattgcacagttaggggggaaatcacgagacgaatcttttgagcctaattagtccataattagccataagtgctacaataacccacatgtgctaatggtggattaattaggcttaggctcaaaagattcgtctcgtggtttccaggcaaactatgaaattagttttttcattcgtgtccgaaaacctcttccgagggtcaaacgtccgacgtgacacccaaaaattttcttttcgcgaactaaacaggttctaagtgtcacattttagtttaaaatacttatattttgggattgtccatattcataatcctatgaagcgttccatcctatgaagagagtactacttttgtgttctttttcctgataattctttaacgaaattttgaccatctctctgggtttttcttccccatggtgtaaacggtaaacaggtttaccgtctggaattcatattgtgagacgcacatggtagaaaagcatgtacagcatggttcgaacaaagaaaaactaggaagttttttatttttttaaacctaaggtggaactttgtttcactgttatatttagaagaaaagaattgactgtcgaaactaggaag

SEQ ID NO: 56047 - DNA, 1949 bp, Oryza sativa
acacagcacggactctcgacgcaacatttgaatgtacatcgtataaccgctacggcattcatttaatgagctttgatgcacgtttcataacaactcgctggctgcaagcctgtaaccgtgttggctggctgctacaacagctatatccaacactttcaaacaaccccaaaatatgtgcagaagcatgccaccaaacaaaaaaaaacccataaacacatcctattattgccgtgaaaaaacaaaatagcctaaggacagaaattgtgttaagcagctgaaaatcatcatgagttgaggatgatccgcttggttaagtttttgaacagatccgtatgtttatagtggattatctaagtgattataaatataaaaaatatatatattggtaaataagcttgacaaagagctttgaagaaggcatctaaaaaatagaagtaaattctttttttaaggtattcttagcaagtaatccgcagaaaagtgccatgttagttttaagcccacatgataggagtattttttaaagccgaaaccaaatctgtttttgtccaatccaggtacccaaatggtcctttctctgtactgatggagcatcgaagtttcgttgctgcggaacagaaacaaaactgctgataagactttgttatcctcttccagaaaaaaaaaagaacgaaaaacgagcatgtcaatgttgacgttggccttttctttcagattttttcgtcgaaacaaaaaaggcgtcctgtgcttgctggagcagcacatggacggacagacttccatagcgtccttgacacttcttctgtcagtgatggagatggttcatggagaatcagaatactgttactggttggttggttagttggttgcctaataaattcgcaatgtcctcctcggcccaactctcattcggcccaacaaagtcgttacgttgaaatgggcctatctgaccagtcgagagtgatgggccttgatccaattctgagatggcccaacacatttgcacacgtggactggtggtctctgcagagagaggcagagtagtaggtgcggtccgtggatgatgtcattgcatttgcagctgccctttctgatcttatctgaccatgatgcgtcatatccatccgcaaagctaaaaaagaaaatctgacaaatcaactttattctaataaattaattttgtgtgatatggaaatatctgtcccttgataatatcatgtggacaatttaggtagatcataagtataccagtactacatatatagtataaatcaatacactatgataaggtgggataagatcaaagtgctattgatcacatggaaattttatgttgcgttgtgtatttgtgccaagattaaaaaggtaaactcgtggaacttatcaaagacgaatatgcaaaaatgtatacatctattgtgtcatttatgatttttatcgttgatatgatcattctcattatgtctatctatatcttcgaagtacaacaggattgaaatagagctactccacataacaatatcagaatttaataagaagtcagggacaactacaacattgaaaaaaggaaaaaaaaacagtggagaaccctcgttatgagataaaggtggcacaatgtgctatttataagtaaaaatgtatatcaagtacaattgtacttatatcataacattgcgtagagaactctgttagctatacatgaaggaataactcttttcaacattaccatttattaataataaataatcaacaaacacacacgacgtattgtaaaattggacaaatcaatattgctataggaaagtgaggcatgccaactactatgacacatcacagtaggtcaacatcatctctctcatctctagtagtactaatagacttccaacaacttccacctatatattaatgataggtaatttgacattcaaccatatgttcacatatcgctt

SEQ ID NO: 56048 - DNA, 9507 bp, Oryza sativa
atctcacctgaataaaaaaggagcagcagcaaaaaaaaaaagtgagaaaaaaataatccaacaagaactcggggaagaagattacattacatcggaaaaggagaaaaaaaagagagagagaagagcccgaaacaaacgtgacaccaaagtgggtagtagacacagaggtggcgcaggcagcacacagaaaaccagcgagattttacacacgcctcgccctcgcgttcgcgtcgacgggaataaaatcccccgcgtctcctcttctcctcgcgcaactcgctcatctcatcgctctcgcctcgactcgcctccacgaagcccacctcgactcgccatggccatggacgacctcgccggctcatcctcctcctcctccgcgatggacgccgtggtcgccgacccctcgcacgggtggcagaaggtcacctaccccaagcgccaccgcaagcagggggcggcggcgctgccctccgcggctgctcccgatctggggttcctgcccaacggcggcggcaaggtcaacgtgttcgaggccgtcgacaggaacgccgagaagcgccaccgcgcgctcctggccgccagggacgcggccgaccccgacgccgcgcggatcgccgccgccacggcctccgcgtactctgacgacgacgacgactccgacgaggcgcaggcgactcgccccgagggggaggtgaagaagcccaaggtgaagaagctgaagaagcccaaggtgacggtcgccgaggcggccgctctgatcgacgccgagaacctcgcggcgcatctcgtgcagatctcggtaatacccgtcctgtttcgctgaattcctcttcggaaatcgtcagatctcgacttgtttggactggatcatatttttgtctttttgttaaggatcggatctgatgagggtttagtgctggatcgttcgggttttttcaaaattccgacaaaatgttgggtgtctactagttttcgattaagatggaggaaaattctggtcgtaccagaaagttgggatctccttgatgtaaaaacacgggatcttgggatcttggaaagcatgggggttttggtgcaactattagatcttttaacgtgtcatagctcttttctgttttgttccgtagattctaaccctctgttctgtgtgcaggaatcttacgagaaccagcaggatattcagctcatgcggttcgccgactactttggcaggtcatttgcaagcgtgagcgccgcccagttcccctgggcgaagatgttcaaggaatcactagtgtccaagatggttgatgtgagttactagagttgccctaactcttttacgcatagagatattgcatttggaccagatataaaaaggcaattgcagtttatagggtgattcacttgcatcacatatgaaatgttactgcggtttatctgattgttaagttcttatgatctttttcttgtatctacttacaaattttacgaaaattaatggttgtgcatgaacattgatactgattcatgcatcgtcatcattgagttgtgaaatgctaatgctgcttttggtaactgccagtaatattattcgaattatttgcagacttgacgtcgctgtaaacgtgcttgtcaagtatgctagttttaaggatggttatgctatttctgctcaccctgtggatgcattatcaattaaaacaaattatttccgaacacgattattcatgtataacaggatacagctggataagttcaatgcaattactgcaacaacttgagtttacatttaacggtttacctgaaatccgcattgtccaaaaatctttctgtatttgtgacatggtattgtgttcagttccttccattttccgctctgaaagggggaggcgtggaggcaagttaatttggaaggtggggggttggtgcggattgtagtatgaggagtaaatgggtgtatcagggtacacattaattggattagcatggaatttcttagcctctaataaatcggaagcgattgcttgataaatatgcaatatgtttcattccagaaaagaaacgacacatactcgtgcaattaataattcagtgtattaatggattctagtacttctgttttgattttataagcatgaaaatgtccctttatttccgtgtctctctatttttagatttgcatctaactagttaatatattgtgcagattcccttgtgccatattcctgaaccagttcgcaacacagcgagtgactggatcaatcagagatctcctgatgccctgggagactttgtcatgtggtgcatagacagcatcatgtctgaactgtcaggtcaagcagtaggcgctaagggttcaaagaaggccgcacagcaaactccaagggcccaggtagtccttgttcgatcacgacttaactctcactatacaagcctctgcatggtatcatggacttgtgatgtaaagcagcataaaaatgctctacaagatggaaatagcatgcgttttatatttgcgatatgtcctatattgtattcacatcaactgagcctagcgctaatgctgtcatctaatgaagcaacaaccttgcaatgagaaaaaaaaatgtaggctttgcaattgaaatattatatgaacaatttgctcacatcctgcattgctggaagcttgtgcttgtcaataccatttactttagatagatgtgaatgtttctgattgtgtaattcaattagtttagccttttctcattgcttttaacacttcctcacaagaagtaagataataagcagattcgattcgattcgatcatttgtattagtttattactccgatctatggatcaccacgattgctaaaaagtttatataaattctaagaagaactgcattttgatgacagaatattcaagtcctactttatgtaaggtgttcatgaaggagattaaacttttttttttctgttttagggccctgaagattgcatggtggtagatatgataaaacctaaaatgctgatctaataatctgactgccataattcacacttgcttatcggacctgtgattgtaattatggatggttctatcttgttttcaagttggtttatagtttttaaatgactattgctctgttcaggttgcaatatttgttgtgcttgccttgactgtaagaaggaaaccagaggtactaacaaacgtcctgccaaaaataatgggaaacaataagtatcttgggcaggaaaagcttccaatcattgtttgggttattgctcaggtatattttccctgctgtgctcttacttgttctgaatggtgctaattattttcagtgctccatactatcattttatattttcttaaaaaatatctcttgcgtgatgtatcataggcatctcaaggtgacctagtgactggaatgttttgttgggctcatttcctgtttcccacactgtgtgctaagccaagtgggaatccccagacgagagatttagttctgcagttgctcgaaaggtatggctcaacttaaacctgattaagaatctagagccgtttttctgttttctgatatatatcagaagtatttatatgcataatcttttttgatatttcacgtgcagaattttgtctgcccccaaagctcgaggcatcttactgaatggtgctgttagaaagggggaacgcctgattccccctgttacatttgatctgttcatgagagctgcatttcctgtttccagcgctcgtgtaaaggtttgttcttaattcttccttcctgtttgctgaaattttgatatgcgatgatgttctgacttctggtcatcatatggaactctttaggctacagagaggtttgaagcagcctacccaacaatcaaggagttggcccttgctggtcctcctggctcaaaaaccgtgaaacaagcagcacagcagcttttgccattgtgtgtgaaagcaatgcaagaaagtgagctgtcatcctttttcaccctaacttctctttctatatagagcttgttacctttgttttgcaactctgagttgttgcattattgcacattatgttcagataacgcagacctcaccggggagtctgctggtgtattcatttggtgcctgactcaaaatgcagagtcctacaagctgtgggtgagtaatctttgtctgtctgcctttataacaccaagtgagaatgttgcaactgaagttttcttaattctgatttgcaggaaagacttcatcctgaaaatgttgaagccagtgttgtagtccttagcactatagtcacaaaatggagcgagctgtctcataagctcagtgctgaatctcttaaggtgactctgaagaacttaaggactaaggtatgatatgtccctgttgcattacttgttttgtttgactgtttatgatgtttgtttcattcttatgtatatgcaatgtgatgctatcctttgcatagtagtaaaattctgtatgactagtgaattctgattcatgacaaaaagagagcttcttgatagcacaattagtttgggataaatggcgttacctcctttttttttttgataaaatggaaatcaaggtgccacaactcttaaggacatgcaaaagcaagtaaacttgtttgacaccaccacctttagctgttcacataccccctaggtatttgtactccgtagtaatatgtgcaattggttgcaattgcagaatgaggcggccctagaagcagcaacggactctggaaagcaggcatctatcaaggccgcggacaagtattccaaggagatccttggaaggttgagccgcggcggagcctgcctgaagggcagcctgctggttatcacgcttgctgttgccgcaggctttgtgctatctcctaacctggagatcccatccgactgggacaagctccaggccatggtggcgtctcacctgtcgttctagaagtatatttgtccagcagttgataaaagcttatacagagaatccaaaggagatgaagtgaagattctaggagtgaatgaagaaggctaataagaagggatagatcctagaaaagaatacagttacctttttcgcatcttttcccaagcccgtagttggggggagatgcaagcaactttgcagagatagagagttaaaaagttttaatcgggttagactgatcggtcagaagaagaaaggttgggccaaatggttcggcctgaggactaacaccacctttgctctatctcgtttttctgcatctgcagcatctcagatgatgagaaacatttttgcttcttttgtttttcctttttcttctgaatcttgtttgcttttaccaacatgccatgtgtgatattattgctgaatcatctgtacttgttggtgttgatgatatcatatcctgctatgttgtggtgtaccaatcatcctatacttgttggttatgatgttggatgggtgtaccaatcattcctaaaggagtgtgaagtgttttactctgtggttgcaagtggtgaaagtgaggaagccgtgtgagtgacgtgtcgacgcagcggcggccggtgacggagacggatcgagggcaggaggaggagatcgccggcaaagtgagggcggcggcacatggcacatggcacatggccgcgggccagcctgtctctgtacgctctcattccttcgtaccaaggccagttgactcgggcgcgaccgaagcagcacgatctctcttcttgctttgttggtgatcaataacgtggacactggtcggtggtggcgaccacgcgtcgacggccaacctcgaccgtggcgggccccggccgccgtccaccacccgggccgaccatgggaaggcaacaacagctactacacctacaccagtgagagtggtggccggagcggcgccacagcaacagctaggacctactagtacaaagggtgagccagccactggtaatggcctcttcccctcctccgcctccccgctgctcctgctcgcttcctgccctgcaatggcggctctcctcctcctctcctccgccgctcgggtacgtagccggtaacacatgactcagtcaatcttggcacttgcggagttgcggtagcttcagttcttgatttgctgctgcaggttggcgtggctgcgccactggcgctgaggcagcagcgcccggtggtgctgcccggtggccagctccgcacgggaagcggcgccggcgcagcgtcggcgtgggcggcgcgccctctccggccggagctcgccgcggtctcccgccccgccgtccccgcccgcggcagggcgcctctgttccggcctcgcgcatgtaacgcctctgcggccccattcaattctagctctaccacaactgattggtgtaggactgactgacgaatttcgccatggatttggttgtgaggagcagggatggcgtcgtctcagattgccagctccgccttcacctggggcaccatcgccgtcctccctttctacactctcatggtcgtcgcccccaacgccgacgtcgtaagaattcctcaatcctccaacccacacacacacaatcgaattgctctcacttgctcctctaatctttctctgtgctggcgcagaccaagcgtgccgtggatagcagcgcgccgtacgtcgccctcggcatcctctacgcctacctgctctacctatcctggactcccgacaccctacgcgccatgttcgccagcaagtactggctccccgaggtcagtcaatcaatcagtgacaccactctgcactccatgatcactagcattctctcaacctttctcttctcctgcgcagttgacggggatcgtcaggatgttcgccagcgagatgaccgtcgcctccgcctggatccacctcctagccgtcgacctcttcgccgcaaggtgagcaaattcttgattcatgtgtgtagtagtgtacctatggatgatggttgtatgtgttgcaagcgtgaggaggttgttaaaatggcttgagttttgggatcacaatgcaggcaggtgtaccatgacggcatcaagaacaacatagagaccaggcattcggtttctctgtgcctgctcttctgcccaattgggatcgcgactcacgttctgactaaggtactggcgggttcaattggtcgctcacattgatcgattgtatgtaggttcatattgcttagatggtgtatttttatgtgattcatatatgaataaaatttattcaattaactatgtgttacatcgagttcaatgtgattcttgtttttccccacgtattgaatcgatttggcagctgaacatccctataccggtttagcgtactctactttctcagtagctaatgaagaaaagtgcaattgacaatatgatcagagataagcgacaactcttaaatgtttgcaaataaagaaatgagatgattagagggaaatgaatcgatttgaaacacacttattcaagtggtacactgttcaaacatagaggaattacaacaattacatttatgaatgctatactaggcttatgtgtttcttgtcacagactactttcaattgtacatgaatgacagcatttacagttttgaatgctgtactaggcctatgtgcttcttacaaataaatgtgctttccaataagcaattacaacaattacatttttgaattctatactataggtatgtgtgctttttataaaatatgtgcacaaccactaattagagtggcagcaacaaataacatttctcctgaatatttctggtgatcataacccttactgaacttgtaatggtatgacattaccatctggtttatcctcaccaaatatccggttcagtatcaacgccaatctgatgccggcctgtgctagcctcttctccacgattgggtaccgagagtagaaatagtcatctgtattccaggatgcagaatttgccaattattattgccctaagcccaaaatgacttcttgtactagttttagtcacaaccactgtgatataaagaagtatactcacctcctagagtaatgtcttgctcaacatctttgtaggcataattgcaggacagatgtatgctctcaattgcatagctgcatgacattgagttaaacaatgcatgtcaatttctctttaaaaatgtactagacaggtggaagtgtttgagcaggatatatcattactcatttgcacaggtttcctttttgttgccacaattttcccagtgactgatatcttcagaccatccatcctacaatttacacaaacatcagaaactggaaaagcatttctgaactgataaatcattttacatgtctgtgctctcactgtgaggttcatcttgagagcctccaccatggtatccaagcttctgttatagaagtccttcatggccgtctctatgatgctgttgtcccacacctgtaaaagcagcacatgaacacagaaatcttgtgagtgaaaaatggcagtttgtgctgatctgaataattcagttgacatgacatgagagaagcagtacagacatggtgaaggttttccttcctccggtaccagtgcactttgatggtgttgcccccttcgtcttcctcgaagccgacgtgcagcggctggtgcacgtcgccgacgaagtgggccaggaacatcaggctctccgtcaggttgtctggtttatcaatcagtgcatgtgtatggatgttcagagatcatcggatcagtgtcctgcctgctgaatcagagcactatttggcactgtgttttgcagataagcttacatgaactctttgaatcgccatagctgtagagctgatcggtgtagttgttgatagccccgacaacgcacatcccttgctggtgacgagaattatggcagtcccctggataattgagagccacaagcagattactccatgatgaaagtaaagctcatgtttcagaaatcagagaaatgtttgtgccttagctctactcatctctgctatcatctaatcagagtggcagatttcaccatggaatgctgaattattaatgtatacctcagttaaggtcagctgctccaattagcaaactttatcattccattgaagaccacaaacaacatatccagtggttaggattatctctgaactatactagtaataattaacaacaggtctgtgtgggcacatgtgtgactgtctctgtcagactgtcagcggcacattcctggtcccataagaacgtgctaacaaagtttggaagatatttctcgagatattaagaacgagaagaagcagagaacacgcaattattataatcaagtcgtcagattcctgttgttagtatgtccttttttttcttccttggagtctaaacattcattttacatgcacaattacgacagatgtctggtttttatggtgaaagctactgattgaatgcaacatgaattcgttgtggtttggaacaaggaaattagtggatcgaatcattggtgatgccgtgagactctgaatctgtctgtgatgagagtttgagttgtgtatctttactcaacctctt

SEQ ID NO: 56049 - DNA, 2098 bp, Oryza sativa
agtattgctaacatttatatagatattagtaaatctatacatatatatatatatatatatatatatatatatatatatatatatatatatatatatatatatatatatacattaacatttatataaatatgagcaatgctagaaagtcttacattatgaaatggaggaagtgctaattaattgttttgaacagagaaaaaaagaataacgcaaagcgttctctcgctcagcctggtttgcaaccaatggcgcgcaattaagctcgctttgaacgatcaatttgtattctgtaaatgcagcgttcatttgcagctataattaagtcgttatcttaaaagaagaaaatttgaagctaagattgtggaggtgagtgaagacgtacgtgagtacttgaagttgcagacttggggggtgttggcgtagtggagaggacgagaccagtagtagtggaatcgcacctcgtcggcccacgggcacaccgtcgacagctccccgccggccgactccggcagcagctcctccaccgccgccgccgccttctccgacaggtacttctgcaagtacaacactccgtgttactctctagctgcagcctcttcaggtgctgtgcgaggagaggaggaaggggattagcaaagccatggtgtgcggagacctcggcgatcttgcagacgatgatgtggccctgcttgccccacgcctccgcacgccgaggcgccgcggtgagggagacgacggagacgaaggcggcgagaggcagcagccggaggcggagcagaggcgctgcgagtgccatctccggtggtggtcagctcagcctcgccggagtggttgggtcgtgggctatttattgggcggagaaagagcacgagaggagaaggtaacgtagcggtggcatgggctgggctagtgggccaagattatccggatgggccggatgcttgtgatgctgagggcaatttcggcccataaattttatacagatttttatcatgccgacaacagtctctggcgtttttatcggagaaaatttccagactacgacatgatacattgctactcctgccaaatttgttgctccattttttttctcatgaaatcaattggtgaggctgattttcatacaacgacaacactggctttgtttgagttcattgtacatgaagattaagtgtaaaacatgtaaaatgagaaaatcattagcttgattaagtttaaattattttgaacttaaaaaatggatttatctgatattttatagtaatttatatatatatttctttttttttgcaaaaaaatgtattgtttagcattttgaaaagtatactaatggaaaccacgagtaaaatatgtatcttaatagaaaaaaaaggggcaatacagctatgcagctagctgttgcattcatcctgcaggagaaaaacacacacactgaataacaaacactgctgtgaatgcacggacatggcaccaggagggtccagcagtagtcaggcgtgtgcatgggtatgaacatggcctcaattttcagcagcgtgtgaacgagattgccggccgtgcatgctccgtagttccgacagattcctcatcctctttccctttcttaaaataatggcgcgaaatgatacaatattccggaattcctattgggtgggtgatcgctcctccatccacccagcgatcactcccctgcctctctcctatactatatactcctccctcctctccccccttcctcctccccttcttctctttctactacagtacaccacacaaaactttttaaaaaacaaaagttagaaaaatttatgtatagaaatactatttataaaaaatttgaattcaaattcaaatttgaattgggcatgtaaacttttgacttataaactttggatctatacattttaggtgtataaactttagatgtatagaaataatatatatagaaaatatttgaattcaaatccaaattcaaatttgaatttgaatataattcaaattcaaatttgaatcgggtatataaactttaggtgtataaactttagatgtatagaaatactatatatgaaaaatatttgaatttaaattcaaatttgaa

SEQ ID NO: 56050 - DNA, 9233 bp, Oryza sativa
tctgatcgtctcgtctcgtgcagggccggctgagcgacgcggccgccgcggcggtgaggggcctgctgccgtcgtacgccgggggcaacctgagcagcctctgctcctgggccgacggcgtcaagctcaggtacccctggtcggcgccgctccactacatcgacaccccggaccacctctgcagctacacctacgacagtttgttgattttgtcctcaaattcgactgaaatttgcatggacatgctgtcacattgtagcagcatgcatcatgttggtttcttgtgttgcattgtcaggagactgcaaggacgaggatagcttcagggggaggtgcgtcgccggcgccatcaacaactacacctcccagctcctcacctatgatgcaacatccccttctactcaatgtaatactgctccatttaattcagttctgcaattttttttgccttgttagtctcaggctgatgataagtttctgatcttgagttcttcagataacctgacacaagcacttctgttccttgcacactttgtgggggacatccaccaggtacacccaaaaaaatgtgattagtacgctctgtaagtacttgtatagtagactagtgtagtaattagtgtttaatcatttggagatgacagccgcttcatgtggggtttacctccgataaaggaggaaacaccattgatgtgcactggtatacaaggaagactgttctccaccatgtaagtccaatgttcagactaagcatcccactgcaaaaagcattcagactagcatcccacttcccaaaagaaaaaaaaatcagataaagcatggatatgactgtgacaaaatcaattaggaatcctttgtctttggtattgtcgttcaggtttgggatgacaacatcatcaaaacggcagaaaacgactactatggggaaggcgtggctgaatttgtcgatgcactgatgcagaatataacggtatgaaaaatggttttctggtgtgcttgaggcaactagcagctcgatctacttactgcttgatgtttcagggagaatggtcacaacgagtgccaggatgggaagaatgcagcaagaaccagaccacatgcccagacacgtatgctttcacatccaaaagttcatttctgaatttccacttaacttgattgatttctggctgtaactgattacaactatatatgcaaggtatgcatctgagagcatcgctgcagcatgcgactgggcgtacaaggacgtgacagaagattcactcctggaaggtaatactaccattagcagtgccatttacgtttgatgcagagttaaacacttcagaaaatgtcctgaccacgggtttattgctcttgattgctgctgttgcagatgcatatttcgggagcagattgccggttgtgaatctcaggctagcgcaaggcggcgtcagattagctgccactctgaacagaatattcagttaaaggaagacgaactgcatacatcagacagttctctctcgaaggaagatttttattttctctgttttgctgtgtgccaaaatctcgagagatcaattttactatttccttgtcatgataaatcgaaatatattcttgagcatgtgtgaaatgggacttattccaaaatatgtgagtgtacatgcgcatcttccatagctctatattatcgggaaaaaagaagatgagcagaaacatacgcctacggcccaaagttcatgtgagctaagcccattagattcacgacgtagagtatacggcccaaacatctcaatacgtggttaaaaggccttttcattgcagccctgatggttatctgtgcaggccggcaaagcatccgaaacttcggactttgctctaaaataattgttggcagaaaaattgaaaccttggactcgaatgtttacacaagtagatatctgcgttaaacgacaagcagcacggtgaattaaaatatggtaatcattttttattaagctcgctagatatttatgcttgattaaactctctcattgaactctgttgtagccatgtacgtacagcggcgaaacaaacttcaagtgcagtggcacgttgagagcagcggccaattttctgcactctttggaagactatgtagaaaaacattaaagtgtgtgatgaatacgaatatatgtacaaatgtagctgtaaaataagatttggagttgttaaaaatagagtaggactctatatgtctctcttaaatagagagagacaccatctcttataactagtatatgacaattgtagaatagaataatcgctctaggtaggtcggccgggggacattaatatcttgatacattgtaattatactagtttaggggagagtgtacgtaaaaaatatctcgtaaaggtaaaggtttagcagatctaatctctcgtcaatcaatattgtggctccctgttatcattaagttttaatctcatatggtgtgatatcatgtttggcttcgttatatgtggtgggttcctttttctcttttgatacctcaaaatccatacgactaacataactctatttttttagaattatatgtttaaaactgtccaaatttattatacgaaaaatatatcattaaatttgccattggaaacgtttctgcaatattgtaatattttaattaaatattaattaaagatataaaaataatgttcaaagtctatctctcataccaatataccatgcatgaaagtcaaaaaggtaaaaaaaatggaggaggtgtcaacattgtgccagaagtactgttaaactacaataacttggaatgtacaatgaattatggtaggaagaatcgtagaaaaactctaggtgtactggtagttaataattaacataaacaagaagtttgcattagcttaccgcaggaactcaatattaattacaattgttttacagcaacttagacacatgatgttgctctatctcctattaattcctactagtagctagcttagcaactagtagacggttggtgccgtcagcttcatgtgcacacacatgatgacccaatgccatggaatggatggcaatatggcattatacttaaaacatatggcttagtctactcaccaaactatatatccgtaggagcattagttaatctttcttcgttgcaacaggtagtcgaattgtacagtttgatgtctcctccctccctacaaaactcgtaacttgcatgaacaatatgtactcatgcatgaacctggctggtttcagtcccaactagcaattaattaacctatttacacaataccatccagctcacacgtacaaacaaattagattaataatttgtcaagtctctggcatggattggaggttaattggaagagaattaatcatcaaaaccggccaggtgcgcccaagcctctgtatgttgtggggtgtcaaattaaacaactgattaatgtgcgtgcattccgttaaaatcagacgtaacacgtctgccttaattaattaactattaattaattaattagaatcgtctaagcatcatgtgtgctcgctagattgctttcctgtttcacacactaccagattctggaatacctcaagaacacggcgagataggcggagctattaattagcaactgatgatcgaattcattctgttgctagtgtatgcgattgatgatatattagtattctatactttatataaatcatgattgatccatcaagaaaccacttgttttccctctcatgggaggttgtcgtaagtgtgcaataatttagtatatatgtttaacccgtcgacgcatcgattggtaaattaatgcaaaagattagttgttttccttggtgatttacgtacgcaacaagttgctagccttgctagattaacaccactaataactatatataactaaacacgttgattaaaaattgttcggatgaaaggtcgacctaaggcatagctattacctagctagagtggtatattatgtgaaaggaatatgaatctcctaattataatagctggctagctagcactaggcagatgcatcatctcttagtttccagcatatgcacacaatatatgtacatactagtacgaagctagctaattctctcttaatttggtcctagttaagattatgtgctgtgaaaaagctctttatctctctgcacctattctagagctagctaacttggattaatcctaatcaaaagttcagtgtgaattaatatattctgatacgattctcacgggaataatgtggaaacgtgcagaattggaacgtgtatgtgtgtgtgtgtgtctctgagagagagatgggtatcgaagcaaagagctatagctagtcaagatcgatgtaaaggagatgggcatgattaaggccagatatatctaagctcacatccattgtcataattatcgacatatattcgatggccaactagatcgatcgatcgatatacgtacgtaacagtagtcaagattgctagctagatgagaataagcaaccaattcaagctgactgcaagagcagttaacgatcgataatcgaattaagtagcgtgttcaggtttgcgattcttggagttgtcatttcatccatattttttgcatgccacgatgtaaacaatataatcacatgccaaggcaagtgtgtgcatgatcgatatatgcatctagcttgatctctgcatcttcgccgtcgccgtcgtcgcggtcgtcgtcgtcggtggcggcgtcgtcgctggagaggcgcctaggtaacctaccctaaaacgagtaggcttagactctggcgatcgatagatgatgagatcaacaaaccaccacacacacacactgatcgactgagtgagtgagattaaaagcagccaggcaagttattaagtggagacgacgtgttgttttcacgcatcatttcgatcatcgatccgttgattaattaagggaagatgatcatattgatcaggggcgagttgtaggtaggagaaggaattaatggtcgatctcgatctcacctcctttccatcgatcgctagctagctaatggctttatcatgatcatgttgcatccaccactgaaaagagatagatcgagatcgatgtgattactaggtagctaagctaataagcttctgtgtggccaataatggcgatcgctttcggaggggattgatcgaagctgaaactttgacatgtgtcgaccgtagaacccaaccagctaagcatgtgttacagtagtggtaaaccgcttttgatctcctttaatttattggttgctgaggcttcgatcgtttggaaatacggaaaatttttattggagtcactgtatatgtttcatataaaattcagtgtttaattcagatggtttagctgagtggtcatactgttggttttactgtagtttggagcaaactatatcattgcaaactagcattgtgtaattatcgcgcatccacaattccacattaatgaatatattgaaatgtaatcctttttgtttgttcgcgaaaaagttccacactactaattaaaaaaaaataagtcatacttcaattatttttataataaaacaagtcacaaacaaaataaataaaaaaattatattgttttgaataagacgaataatcaaaagttacaaacaagaacttaaagcgacaagtattttaagatggaggtagtacatttcatgactactctgcattgtttctattaattatttccctagatcatttttcttgtacactgttcagcattgctatgcatgaggcgatcgatgttcagggcttgacttcccatgcatgctaacgacatgtgtgtatactgcgaaaaagatcgccatgcatgcatacatacatatggtaattaatttattgatgagagttgcattgcatgcgtacatgacgccgtgacatatctatacatacaacgcacaacaattgctttcttaataccaactgggatatactcaccaagttgtttgttggaggatacaattaagcaaccctttcatcttcagggcttcataatagtatagagcgccaaaggaatattcttaaggaatatataatagtctcactttacccctataacaattgagacatgaagggttctaaccattaacctagaaaataattcttcattactagtatttcctttttgtcatccgaatgcaatcgagtttccattttatagattgaggctaagagttattgcttagccattattaattatagcaacgatattttatctctcctctttctctttcttcaatataagcaacatttctaattagcaaggctaagaactttctacaactctatcagtggccattgtacatgccctgctatacctaactgctcttaactacgactatggattttctcttccccattttctttcccaatatatatatgctcttgagtgaatcatattaaggggacgcccaaatttttctcataaaccagacctactgtccctccccccaccttcacttactcaatcctattaagcacaagctagggtatccttaactatctgttctgtgtgacaatatttttaattttgaattcccatacaaagatatttgattgcgataatttcacctttcctcgcagttaattacttagtcaagctaccacttagtttgcatctccggtttgccgataattgattagtcaatttacataatcgcccatatgactacatgtaaaccccgtgcgttgcaacattaggttaaagctgcatcacaatggtaaacatgaggtggtgcgagataaatttgctttatagttaaatagtatgacatcacatgttttttataatttgcacatttgactagtcactacaagaaaataagtttggtgagagaagagaaaaaaatgtcattagtgaggagcaattagttaagttatagagggtacatatatgtatacatctaatcaactttttcctacaacactaattatagatacaaacactttaaatttgtctagcaacaacattgacctgttttttttccctaagaaacagtttgagtttagtagctgataaactcccattaggacctacaaaattagaagtaaatatgcacagactagttaacaatacaaggtgattggaccatgcaaattaagacttatgtctatacgatcattcttatgatttgttaaaacctcacgaatattacacacgctagtaaactttacatagaaattagtgttgctagggatataccattggtcttcatctatttgagcgttgcttagggattgtggtgtgtgagtgtggtgtgagtgtggtgtgagtgcgtggtggtggcgacggtgtgtgtgcacgcacacatacatcacccgcgtaatcgcacacaaaacttgtcgaatttctttcacaattgcaaggactagttatagtaattgtagttccaaaatatactcacattattttagctagagaatttactttggaatttatatatatggaaatgagattgcaggttaatttatttcactcgctcttttactgtcatttgacatgcatggactctctcttttttttgaacaattttaatccaaaattaagattcctacaaatttgatgtgtactctttattaaatatagtgcatgcattatgtcgtatggacccacatcacagtcaactgtatatttttctttcccttactaaacatgcatggtaactagcttatgtcctagagagcataggcagagagtttctcttttaccttaacttaataattattataatatgatatgatgcaatataatatatatgataggataacagaaaactaattaaggactactatatatacacaaaactatatagagcatggctatactatgttcatagatcttgcacatgaattctgttgcaagttgggtacgtaattaatttaaccgcaagtgacgatgaatggttaggacttgtggactatttaaggaccatgagttagatgaaacttgcaagtacatgccaaaggaaaaaaaaacaaggacaaattcatcatgtggcgtacgtacggacatttatttttcttaatatggcatccaaaattttactgttccctttcttgccaatatttgaagcttggttttagaatgggaaggatgaaattaaaggatgagatatgaaggcgaaacaagaagggtgcataaaagttagctggtagtttcagatagattgagtatataaaattgtaaatgaaataattaatactatcatacaagagtaacatttggtttagcatatatatgaggaatttactatatatatgcactactgaaaaaaaaatgatctactttgatctgtctcaaatagaatttaggacatactagaaaatgttattcaaccctgcaaacttcgatgacaaatatctagagaaatgtttggattcatcacatataaaatatttaatagtttttatatcatataatgattagaaacaataatggaaaatacaagttttcttgactacatcgttctccaaaatgacaaggaagataaaacggtgtgctacatatgttgtttttctagaaaggctaatcatgccgttaactggctcatgcatgtgtaactaaatttacaataattttgttctttctagtagtttgtgagctaatgcaacgatcattatgtggtccatatggataatcacttgtttgccatggtattagtgcgtggtccataggaaaagcttaccagctggtacaatatttgcaagtgttaaaatttggaccaccaatgtaattttttctcttcttttgagcgtatcctcctagttgttgtttgttactttcaagtagaattatctcgagttcttgatcaatcagcaccctagatatataggttggtccatttataggcaataattaatcaagtttatgcatgagtaacacgactggacagatctaaaatcatatttatatacttttatatcctagctgatgagcatatatagccactgtcaatgacaaaaaggacccgaaatatctatgatgttacaacaatcatagacatcacaataaagattaattatatgtacagctgatgattaattaagcacgaatggtgaaaatatgtatttgaaaatattgtcaatgacaaaaaggacccgaaatatatatatgatgttacaacaatcatagacatcacaataaagataaattatactatatagaactgatggttaattaagcactaatggagaaaatatgtatttgaaa

SEQ ID NO: 56051 - DNA, 6679 bp, Oryza sativa
  unsure (1)..(6679): unsure at all n locations
tggttaggggtaacattaggtgaaacttaaatgagagggacggttgggtaagagaatagtattagaaacccatataattgctaacatatttcaaatactanngaatcctttatantttgtgtacatatgagtgatcgctaactcatggctagctaactcatggctagctagtggtgtactagtatagtttattgtacttgtgtaggtttctttcaaagttacatgtttatgaattattgttagctttatcgtgcttctgttgaaaaaaaggccgcaaataaaagagagaactcccttttttttttgagaactcccttttttttttgcaaggaagcatataaaagagaactttgtgagtaacgatatgatgatgtttaatggaccaaaggttataacttagcgtaaccaattgcagatacgctaaaactattatgcgagctagtgtatgttaatttcttcctcatttacaattattttctctaataattaactaacatatatgaaaaagagcaatgttcccgtgctctaaaagagaaattaccaaatgatcataatcgttcattattaagaataaattagtaatttaccaatacaatgattagaggtaactttgttatttatgttttttctagatctattatttggtcatccattccgctggcattgctcacacctatattccatcgaaaaagccaaaaaaaaagttgaaaaaaaggtctagtcgtcattgctaaatgttgattatatccctccacacttttttttataataatgcacctccacatttctaataccgctaactgaagtggtagtacaaataaatctaaacccttcaaccaaatgagaacaacggttcatattgctttttactaccaacagagagcaccgtagtatggctcatatgagaacttacacgtactagtgctagaattactcgatccgatcacaaatacgtattgatttagacattggtctggtctcacacaaacattatcggaccacttatttatatcttaatatatttacaaattccaataaaattgtatttttcatgaaaaatatgcatggcttaggctttattcgattttttttgtttgcaccattaatagcaagataacaagaatgcctacacttcatctatttcctatacatgttaaatatatcatgcaacaagtctattgtaaattattcacttgtcatctttttgacatgtgtgctcaaatcctatatacttatatagttcatccccactaagtatagttaatgctatttctctcttctctcattaagccacatcaccctaattatttctagcctttggctgatagatccatagttcaaattatctcttctttcttctctcataacaccatgcaatctcaatcatttttaggctcaaaattcataagtatcaatttgttttagttttaataattatattgcatcttatttatacatattatgtaacttaatttccggcagcaacacaacggggtattcatatagtataattcaatgacctttcaattgattatatgtttcaaggacatgcatgtttgaattgattcttttccaacttaacagtgactgtacttctgaaaattcggtcaagggaagccgcaaaactgacactttagatgcggcaaatattaagattaattgcaagtatttgactacacaccatggtatgcatgcaactgtgccaacatcacgcacaaactatttaagctaaacatttgaattgaacattttaaccggtcggcatgcagacagttaggtcaagaatcattaggtcctacgaatattttatatgattatcctaggaacttatacaggcattcctacctaatctttgcttacttaccagggtgctgtctccaaagtttagtgtttcattggcttttcgggagaaagaactacaaagctatttgctttgcaagcacaagtctcgctgattgattggcttaattntccttnttttggncnttntttggggaaaaaagggtttaagggnnaaaacccccccgggggtttttaaacccccttttattggaaataattctagttcaaactggtagtaaataattaattatgaaacagataattattctgattgaacgcatggttaagtgccataggcccataggcaggtagttgcatgcgtggagacacatttgcatttcactataccataaagtgtggtagctttcgaaaacataccaatgatttggtgtaatatcaataaataaaaacccatgcatgcatatgtatatgtacatgtctctatttgggatttgagcttatcacaaaaggataatatatattccaaaagaaacaaaaagaataacgttttgcattactgttttttttttgcagtgcaaaaggagatcgtggagaggtgtgtggttcaccaatgtgtgcatccaacaatttggtcatctctccatcccactctccctctctcgtctaatcctaacacagtgctgcaagagggatgacaaattgttcagtcaaacacgcttcatgtaggagagaatctaaagatcagtactgggcactatttcttctctcactctctctctctctctctcattccatagaaaaagatggaagctttgacagattgccctgaccttttggtgtgtaacaacgcacttggctttctcctctcctcttccttctcttctcccccaagaagctaattaacccaccaaattaaaatgtacccctcttcttcctacaagtagtagtacttttcagtcttgattaggggcagttgcatgcatgccccctcaaaaattcccttcatatgattgccacaagtcattataaaagggatatatatatatatatatatatatatatatatatatatatatatatatatattgatctcaagcagccaccaataataacttaatttagctctctctctctctctgcagctaggccatatgcatctctcctccctcttctcttgtacttacttgtgcttgctctcttccattcttttcttccctaattgatctcctagagagttgagagttgagagagtagttaaggggcaagctaattaagctagtgagagctagtggaggtacatggctatatatatggttgtatgagttgcaccctccaaggggatcatacatcgacctcatcatccaatccaccaactgaccaacaacatttatactactagtagtagaagaagaagctctagatagctatatatcccagctgctgcaaaggtagtagacagcaatgtcgcagaggagagttgcagggcccatgggagtgatgagcaagcagcagcaggaggccatggcagaggagatgatggagctgaggcgaggaccatggaccctcgaggaagacaacctcctcatgaactacattgcctgccatggcgaaggccgctggaatctcctcgcccgctgctccggtgagtcctccgtcactctgcaatcatcatcgatctaaccatggcatctaggtcaagtacaatcaatcttgaacaaatttgggttaattaatcgattagggttgaagaggacgggcaagagctgcaggctaagatggctcaactacctcaagcctgacataaagcgcgggaatctgacgccggaggagcagctgctcattcttgagctccattccaggtggggaaacaggtaggtatacatattgatttgatcaatctgcacatatatatcaatcaaaatcaattatctctgatcaagatcgattggttaatttgattgatcaggtggtcgaggatagcgcagcatctgccggggaggacggacaacgagatcaagaactactggaggacgagggtgcagaagcaggccaggcagctcaaggtcgacgccaacagcaccgtcttccgcgacgccgtccgctgctattggatgcctcgcctcctcgagaagatggccggagcagccaccgaccccactccgccgccgccaccgccactccaccaccacgccgccatggccaccgcctcctcctcgccgttcgacttcgacacccacctgcagcaagcagaagcagcaacggcgtgcgtcgtcccgaacaacgtgtaccaccaccacatcgacccgagcccgagcacgtcgacgtcggccggctcgacggcggccgcggcggcgttccagccgctgccctgcttctccgagctgagatgggaccagcagatgcagtcctccggcgagctcgacgacggcgccgccggcgtgttcgtcgactcggcgtcggcgctgggaagcctcagcctcgacgggctggaccttggtccggccgagtactactccgactcgacgctcctcgactacctcaactccagctgcaccggcagcgccatgatgacgatgatgaccgcctccggcaacgccggcagctacaactactgcggcggcgccatggacggcggcgacacgtggaggtccgacgaggtgtgccaagcggcggcgagaaagctcggcgagtggggaggaggaatctagctagctagctaggtagctacgtatccagctgagcttagctgtagctaaaggctaagtggatggatggatcatggatagatgagatggtaagttgcttcttgtgatgtctctccattaaagcgagatgagatgatgatcatgatgatgatgttgatgatgctgtcacattagctaatggatgagttgttccatcatatcgatcaagatagaagtactagtgatcgatcaagcaaaaatcaaaagtagaagatgatcaatagcgtgatgattccgatcgatggagagaatattattgagatgtgtttaaacatattagctagagctagctagcttcttgtagtggttgatcgatcgatggtgcatgtaactattgttagtagtagtactttgttaatgtaattgtgtacgtacgtatgtgtgttctctctttgtttgttcttgttaaaaggcgattcaattagctttgatttgttgggtttgtgaaagagatcttgttgttatatgcattgatcatcgaaggagaggtcgttgtctccaagtgatctcgtttatgttggtggggttgtgtgctgtaattgcatctggagatgggaacaatatgggtcagaatcaagctatagatgtgtgtgtgagagtgagatgcctctctctggcttgctagctttctcttgctagggaaagtcggcaatgacatgtcgctttgagatggctatctcgatctcgatctacatatatgtgtggttgccaataaaacttttttctgcaaacgcgcaaaagaattgcacgtcaatatattagaagaagagaagagggttaccaataaaactcaaattgagttgtgcaaatttgggaaatttaacaagtagagcacacaaacgcgtcgccacgctactttccagaagaactcaacaatgagctagagggttgttattgttatatatgtgtggtttgctatcacaagttgccacactagatagacattctgaagtatatatagctaggctagtgatacaatttcaggtacattttgtccatatatgttttttaaacaaatgaatatacatgagttcgatcagttattcccttcagtcatgaaaacatgtcattttacacatgaacatgcatggtgtcccacgtacaaatttgacctataaaccctgataaaattatcatgctatatatgtacatgtctacaaatatagttttcatacatctaactaaatatttttaaaatattgatgttcacattaagtttgacttgaaacatgtttttatgacatggaaggagtaaaacttgttttcttttgatgcgtacattattgagataatactaccatgttagataattaatgatttgacttagaatttaagtttgttgctctatataacctaggatgtagttattaaatatatcttttccaatcatgcttctttctgagaaaaattgccagtcgtactctagatggaaaacgacgatggatgtaacatatcgtcacatcaaatctaacgggccagagagggaacaattttacaatcatatggatatctcatccatttctcctaaatatatgttgtatatatttatatggatggagaaaggtggagaaagaaagtgctatagctagagatgattccaacttgaaatttttgctttgataagactcctggagctttcaagggcactgtgctagtagacttcctcttaaaggatgtgggacatggcatttgatagagaatggccggcgagaaaaaaaaattaaaagcgttttgatagaatgggaaaggaagagcgttgataggtgcatactaatttaagggagattcttttttcctctccaggacttgactacatgaatcagaacacgtgatatagaaattaagttaatctaattaattacgtggggatcagatagttttaaggaaatatttaataatatttcgttaaaactttgtaacaaatatatatatgtgatacagtcctaaacaatattgatgtatatttgactaacattaatatttcccatatcattaaaatacatttatatattaattgctgctgctgaaaacattactttttgttgaatttaaaccttgaaaactaacaacaataatcatatatacatcgaattaattaattatgtataatcttttctgagcttcacttcaga

SEQ ID NO: 56052 - DNA, 1305 bp, Oryza sativa
atgagtctttcaagcaatcatctcaagcaaggacaaagcttccatctggcattgaaatgagtgttcacgtgcttacaacagggtaggtaacatgtgccttgccatttttacatgtgtgctggtttactgagtagcatgttctgtttacacaacacttgtctaaacctaatactgatagataggcttcttagtccatgacatgtagctggaatatgggcaatggattatataactttataataggcgtttgctgagcatgttaacatgcaacttgatattttctatcataaatgtgcatttctgattaaatatgttgcattgcagctattggccaacatatccaccaatggatgtgaaactcccccatgaacttaatgtctatcaggtcaggccatgttctcaaaactatgtttgttggcagtaaatatttatattaactgcctggaaattaatttagttttctatttttctgataggatatatttaaagaattctatttgagcaagtatagtggaaggcgtttgatgtggcaaaactcattgggtcactgtgtattaaaagcagagttcccaaaaggtaaaaaggaacttgcggtgtcactatttcaggtagggttatttttcccaatttctttggtggtttattgtagctgtaactgtctgatcaataattagaaaatcactgatttattctgtttttcagagtgtggttttgatgttgttcaatgatgcacaaaaactaagcttcctcgatatcaaggaatcgactggtattgaggataaagaattgcgaagaacgctgcaatcacttgcatgcggtaaagttcgggttctccaaaaggtgtggctctttattttatccaaatgtctaactaattttcagtagcagcttgttcagttgtcacttttattttcagatgccaaaagggcgagacgtagaagataaggacgaatttgtatttaatgaagaatttagtgcccctctctatcgcataaaggtaatattcgtcatctaatttgtgtggggtggggtgggtacgtcgagtttgggtgtgtcatcaggcttaactaaggtaatgctgtgtgtttccaggtgaatgctattcagatgaaggagacggttgaagaaaacacaagcacaactgagagagtattccaggacagacagtatcaggtgcattaaccatctaaacttgcaaacaagaacatcctttgaggacttctagttacacttgtccccgtttagttatcctcgatttttggtataagatgttagctaaactagtatgctgtgcttatgcttcct

SEQ ID NO: 56053 - DNA, 2144 bp, Oryza sativa
atcaagaaaagaatagagagcctaatcgacagggagtacctggagagagacaggagtaacccccagatctacaattacctggcttgacagcgcttgccatcataacatgaaagctcgtcgtcttcatttcattgtcagagacattgtaaagtagtaattgaatatgtctacctcttgtttttccgacctttttctccttggaagctgtagcaatcgcaacatttctgtatacaagaaaaatgaattttcgataatatcagccatgcatcatgcatacatgtgttcctgatgagtgatgaacagccaatattttatgccagggtctgttttggggccctgccagaaaaaaaaacatcgttgaaacgaggaatttttcttgaaccctgtgaaagttgaatcgaatttcgggaaaatctgataaagtttatgtaaggacctgttcactttgatgttattttcaatcttaccaaattttggtaatgttgctaaaaaagtggctacatttagtttgttatcaaattttgatagctatataagaaatcttgccaaaatttggtaacaaagtgaacatgccttaaaattccaacaatttaaagctatatggctcggccttacgaattttccacccaatatacatgcccagatatagcccagcccatccccatgtttaagcctacccaaactaggcttaattgggcttcatactttgggcttcaagtttgcagcccattaaacgggcccacccaagcccagtctcccctccccctccacacagtcgagcagacgcagtcgagccagctacacggtacgcctctagtcgccgtctcctcccctgtctctgggcgccctcctcctcccagatcagatcaccaccggcgcccgcttccaccgccgcctcgccccgtcgccgggggacccctctccggcgacccccttcgccgcaggcaccggcgaaggtgggggaatacctctatacccgccctagatcgcgctcctgcgattacgcttcgcctgcgcgcgcgcctgccacaccggcttgggtttttggcgcgatggatccgctcaggagctacctcgggaggctcctcctcgaggagatcaccccggtggtgatggtgctcaccaccccgctcgccgaggccgcctgccgcaagagcggcctcagcgtcgtcgacatgctctcgccgttctccctcttcaaaaaaatcgacggtgattcacctccccgatgctctccgcttccgataattgtgtgtatgacgcttgtcgcatttcattcgattgggttctgtgacctcatggggaatcccctgtatgcagtgcccgtgcggacggcgagtgaccagccttacaggctgcagatgtttaagattcggatggtctacgcttccgacgtccggaagcaggactacgaggtgattctcgaactttctggaagcttctgggttgtgctgtgggcttgttcagtatggatgcctatggtttatgaatctcttgatggacattggctgttttggagcaggtggcggatcagaggatcaagccagtagtttctgaggccaatgagagtgctcttccagatctgctttcagacccaccacagctagaagatgtacttagcagtgagatcccttactgcttcattttgttatgttctcacctgtgggcatatttactttgagcaaaattatggagccgtagttggaattctatggatcacttaaagtagcgtaatccgatcaccttgacattagaagcaaactgtgacttactatgagcagcaataatcttctattcagattgtttaatttgcagaataattttaggttataattttgcgctggtagtggaagtatctttacaaagtgatcataccaaacgagcgtgtgcattatattttggatagctcaaagttcctgtaaatggtgtgaatatgcgatgtgtttctcagtggctgtgagtgtaaataacaagggatatttgggtggttacaaacatagtgtttctttgccttcgtcatgtcttagagttgatatgaaactcaaataatagtattattgtttgctgtttgttcggtgcatcatacatatggttcattctttgctcttgattccagagcctgaagctgaactgtgccctttgtg

SEQ ID NO: 56054 - DNA, 1208 bp, Oryza sativa
atggtgcagatgctgagaattcatggttaccttatgtaagtacagagaactacttcagattaaattgcattagtgtttacgtagtgcagccgatatgcaatctagttacagtattttcttgactaaactacagaaatctcatggtttgcacaaccaagacggagcttgttggcttaacacggatgatttgaatgaggtattgccccatttgatgaatatcatgtcatctgcttatccgtcttcttgggcatattgaatgtcatgaaaccattgtccaacattttgtagcacctaatgattcatctgttccctggtaggtattgttgggaagattagtagcctacttggtagtttttactcagtgtatgcaaggttttcatgggtatcgatgctaagaatacaaaatgaatatttctcgcagatgtatggtattagatcaatgaactttagttattcctctgtagtatccagtgtcacatgcaattattgatttctgagagccaacccatacaagatacttactagataagccgttttttttcagataaaggacttcatgcaagatttggcttctaatcatataattccctacatggagcaaaagatccgtgtcctcaatcagcaggtattttctttattccattactttttttttacctctctcaacaagattaaccattctgtttttgaaaataataataataataataataatattaagcatttttctaggtagccacaacaaggaagggctttaggaatcaaataaagaacttgtggtggagaaaaagagatgatgttccagaagctgcaaatggcccaatgcaagtggttacttacatcttgcccttttccctatataaaaattctgtagtttgctgtaacacttttttttttcttcaacaggtatacgttcacctccatagagtcacagattagagttctaggtgactatgctttcatgttacgggactatgagcttgctttgtccaattatagattactctcaacagattataagcttgacaaagcttggaagcgctttgctggtgtgcaggtgctttatacttgttttaacttcttgccttgatttacatatgacattacttatgtagtgttgttgagtttgaaataaagtagcaatcaaggtggcgattcttaaggaatatcctgggaccagctacgttaacagcctaacatacttttca

SEQ ID NO: 56055 - DNA, 789 bp, Oryza sativa
ttctttttctgatctggtgatgtgtgatgtgtgaatgaattgtagagatgattttgtgatttgtgaatgattgtgatgtatttggagatagaaaatgcagcttgatgtatttagggattttgtgaatgatctgtggtgttcgaatgatctgtggataatatgaatgatttgtggggctcaaaatcatgcgagcagcaggaaaagaaaaagaaaaaaaacattagtcccggttggtaactctaaccaggactagatctttagtcccggttagtaactccaaccgggactaaagatccttttttagttccagttatttcaacccggactaaaaatgcccatttttagtcccggatttgtagttctggttgtataaccgagactatagggggttgtgaaccgggactaaaaagggtttgtccaccattgtacgtagcaggaactgcccaatgaaattatggatgaatactgtagcttgcattgcaataaaaaacgcaagaattccaaagtatttcaaacattcacttcatcctttttttttactagctagcattggaataggatggaggataaatcatgtcttcaagataatcttgtgacccaaacatcatatcctacaaaaatttctctgttttttattccttggtttttcatgcgcaaccctgccttattcctttcacattccttttttttttctattatgtgtttttcaatctttatcctaaaggagaccacgattagtctaatgataactataacacatactaagcattgaagttttaaattttaaca

SEQ ID NO: 56056 - DNA, 859 bp, Oryza sativa
caactcacctcctccttgttgggctcgcaacatggtccaacccactagccgctacccacctaacctcaaactatgttgataataggttccgattaagtatatgaagtactacctcaatctaactatatggacaaaatctcttacatgagaggtagtattgcccaagccagttgctaccatgccattaggagtttagacactctcatgctgctgacgtctccttcttccttgacatccctcatcgctctcttctatctaaggtgttgattccctcgtccttcttcattttcatcctctttcaatctccctacaccaacacacagtcaagctatcattgtgttcaatttgagtgacatcaaagtcatcttcgattgtgttcaattcctggttacatggattgatattacacatatgaatatggtaggaataattcgattggttttacatcttcctagatatacatatgaatgtatatgattctcatggcatgatatatgtgctcacatacacgcacacacatacaccgttatacacactcccacgcctacacacatatgtacaaatactaactagatatactagctatagcaatagtagtaagtattttttttacataataatagtagtaagtaattactccatccgtcccaatatgtagcaatttaggatggaattagacccatcctagaactacaagtctaatcccatcctagctaggttgctacatattgagacggagggagtatatatattggttaattgttatacctactgtcccaattgtcccgcaaactatcgttttgtgtcattgtcacaatgtagccgtagttgtgtgtcactcgaaaatgcactacacttt

SEQ ID NO: 56057 - DNA, 760 bp, Oryza sativa
gtccatatggcacacagattaccacgtataccttactaatggtctcagtcagaagtctgactagtgtaaattcataaaaaaagtagttttgtggttctgaagaacgtgtagttttctgaaagccttctttgaaagtgtggtttgtggtagttggttcaaattgtgtagtaccattaaatttgctccaaaagttatgctcatttgagcaaacctcgttaaatcatttcaaattactgaaaaagaagggaagagagttgcaaaaatatatagtttggaccttcacagcatattctgactggttcctcagattcagcttgagtagccgtaaatctccagcaaacgcatttgttggcaagtgatcaatacaccccgtaagtttaggtaaaccctggaaataaattaaagttactcacttatctcagaacaaattatgtgaaagagagcactggacaagtccgaaccttgattacaatcagggtgttgctcaaagtacgacgaggtccctttttccctttcttagttttcctttttgtgtcaaattcaaagtattgatagccaactaataaatctgagagcgtccaccttatcccatgtaacttcagaataccttcaacttttggagtaacttcaagttgtacctaatagaattggaaaggaaactggttattataatgcctaccaaaacattatcagctaaattatgtataactacacattagtcaattaagtatcgcggcttgtcattacaggtattattata

SEQ ID NO: 56058 - DNA, 756 bp, Oryza sativa
taccttgttgctatgaacttttagcagacttgcatagttgcatgtgttctatcagaaaaaaaaaagaataagttatcatcatgcatgtagatgattgttattttagtaggaggaaagctatagctcaattcttttgacagtgctgttctttgggtgtagagcggtgcagggttcacaaggcaggagaaaatgggggagatcaccaatgtcatggagtaccaggccatcgcgaagcagaagcttccgaagatgatctacgactactacgcctctggagctgaggatgagtggactctcaaggagaacagggaggcattctccaggatcttgtaagccataattcttaattacttgattgcttgacatgttacaaattaattgcaccactactcctccctatgccatattgtgcatcaaaatatttcatctgtgtaaatgcctccctatgagtctaccatgtacaagttcaatctgatagctcatagttaagtaggatggatcgacaaaacattactagttgtccaatcctgaccactcggtctttttactaggtagactagtttagcatgagcacatcgtattcttttcaaaatagagttaagggcatttcattagttcagtaaaattgccaatcagtgaaactctcagctaatcataatcttattcccagacccagaatatctatcatacaacatctaacgttatcactttctcctacgaaagctttagcaaatgacttaaatttttcaatcacat

SEQ ID NO: 56059 - DNA, 714 bp, Oryza sativa
  unsure (1)..(714): unsure at all n locations
ataaacagggtcatgaatgaacctgattagctgggcaacgataaaactgccttccaacattctttcctgtctttgtggtgagaattaagcaagctccagcaccacaggggcaaagcatatgcgcaactgatgtatctgactgaaaaacagtattgccactgacatttgcaggacctggagatgggttatcacaccactcaaagtagttgcaacctccattgtcctaatggcaataaaaataacataaaagaaataaatcaaaaaaaataggaaaagcaaaaaagtaaaggagaaaaagtaactagacaactagttatctggcctaagaaataaaatgaccggtttagattaaccacatgtaattccaagcacactgtatcagccgacacgacataaatcctttattggctggcatattctaccaaaggttacacaaggcatcagccacatgaacaccagagtatgatcatgcagtgtaaggctttggaggtgcaacggtacatgcatacacatcagaaatattaaacaatgattacgtattaaggatacaaagtagttatgcatgaatgcatgtggagctgatgtgcatcccatgttccaactgaatagaagttcccccatcaagacagatgatcgagtaataatgtggtcaagtagtgattggtgaaacagaacttcatagcctctccaaatcaatactccctncgtactcat

SEQ ID NO: 56060 - DNA, 5193 bp, Oryza sativa
tttcaataaactacaatcaaactccactcagttgcacaggaaatttgtctagtcctagtacaattggttgaccggtctctctaattagattacactccacaaaacaacagtaccacgctgaactggccttaagacaacagaatgggaaattatactaaggcagagacacataccatgtttatggtttttttaatagttatcatgtttatggtttcatatcgcaaatatgtatcaccattctgattagaagtctgaggtgtgctaagatattttaaagtatgatttcaatcatatacagatgtgccacgataaataaagatcactagagtggggaacaccgaccaataagccagcaagcctcactaacggcaacggtataatcagtttatcactttgacaatttggcacaacatcatgaaaaactaaaccccctagaggtctcatatcccctctacataattgcaagtgtgtctaggctctatgtttttattaagtgggatccaatgtgttgcgaaccatcgttatcagaccacatagatttgaagcgatactacccaattacagtacagggtgatgggattcgtaatgctcacccgcatggggcacctgtagaacttgcggcccggattcctgggcgtgttggatgtgagcactaggcaactcccggcgccgcaggggcaagccttctcctccaccgccccacccgcgtccccatacccaccaccccctcctccgcttccaccaaaggccccgcctcctcctccgccgccagtagctggcacggattgcgggcattctcttgcccagtggcaagagtccccgcacttgaagcacgcgccgcccctcgcgacctgcgcgccgccgctgccgctgccgctacctggggtggctagggtttgggacccaccggaacgcttgcgcgcctggctcagcgtctcctgctgctgcttccaggcggagctgtggctttccttgagcgcggccaggtagggcccctcggggaccgcggcggggggaggagtggccgaagtcggtgacgaggaggtcgacgaggtcatggagaggcggcggcgcttggaggagtcggaggaggccagcgccgcttcctccgtggccgctacggcgaggaggaaggcctcgtcctcctcctcgtcggggaaggacatggtcgtcggagcgagcgcgccgcgtcgccggttggggtttcgtgaagcggaggcgtcggcgcggtttcgaatttttttggggagattttgccggggaaggcgaagcgaaatggtgccgcgtggcgtgcgacgcgcgttgccgccttgggaaatggagggataggcggtgttgcctttccattcttttttttttcttttctttcttttttccggtgtagtgggctgcaatacagatgggctatcggcccatctatgaaggcgtgcaaattctcctatcttttctgtagaattttgtgaagttggtcaaatgatttggtttaagatttcaaagtgaaaatgtcgagatagcttggaaatgtgtacattcagaatttacgatttcacatagatctgtgtcccatgattggaacgtatacaagattctgacaagttcacaagctaactcgataatccagttcaaagaagagaagcccgcgcttttgaaaatgtggatgaattactcgatgaaaaaaaaactacacattccaaagcttgcagcaattattctccaggaaagacggtaaagagtagacaccagtttgggaatagtgatatactaatctctgcaaaagcaagaaatgaagaaattattgttagctttaaatttagaaaatgtgaaggagaagatgtgatatcagaaaatctcacactgtaccttttgcaagcgagtggagagagtgctaatcagtagttggagaaaatttatacaagaaaatcaagttacagaaacattgacaacaacgaacactcttccctggttgacataactgaatgtggtcttgatctaattcagcaatcacaacaaacagaatagcacaaagagctaatgccctgactatggcatctgccaatcacaactatctaatttctcgcaattgatcgattgtcatactgcttactaccaagacagacagcaccaaaacaaactatgatctccctgccaaggaaaaaaaacaaaaacaaacaaacaaaaaagctaggattatctaaattagttaaggcgcaatataaacaactaatgttcatccgattgtgtagatgttaaaacaggacaagtacttcaacagagaaatttaagttaaataatccactggtgcatgcaaacgaaagcttgattctcattctggaaactgacaattgcacgcataatgttacacaaaaagtttccagcaatggaaatcatgttatctgttttgtaactctaccacattaaccaaacaaacaccataaaacatttgccagccaagaagtgaagacctcagcctaaggaaatgtagtgcatccagttatctccatgccataaaaagggagatactgagttacgacaactgtaaaagtgcaataccaaccatgaggcataagcatggacataaatacaggagccattgacaattaaaattcaaatcagcaacaagttgcagcatacttggtgaattttatatgtaaaaagtatggacaaaatcaaattcagcaatctatgcccttttaagaaaggtgattgagatttgcaatgatttgatgaaaagattgtgagtaagtggtggctaaatgatatagttggactttacaaaggcttgatgtaaatgtggctttgcagtgccgccagtgcgtactactgtgcacaaaccaaaatgacttgcagagatcagataaaatgataatgcaatttaatttcatcagtcaccaacctgtttgtacaccctcctgtctttctacacaaatattcctaacaagcagccatatacttccaagagtagaatcccccttggtattatcacgaaaatcatactgcatatgccctcattttttctgaccaggcaaagttctagctttctatgacaaaattggagcagaatttgcaccctcagaatcctcaatctgctcatgatctttatgcttcgacggaaaaggtttcccactccgccggcaccttatgatctcccgcgactcctccatcaaccctgcatacttcctccgcaccaccagcatgggatgttcttcaattgcagtgtctccccgagccaggtatgcctctttgaggacaacaaagcatgttttctccttcaacaacaagtagaaaacatgcggatgccgctcaaacacacggtgaaacttctgtggcagccccaggtgctgcctgaggcaaagtaaccgcctcctctcggcagagcatgtcacgaacagactaagaagctcatgaagcaccccgaccacccgcttctccgaaacatcgctgtcgcgataaatgccgctgaaatcctcatagggagagacataaggcagcttctgaaacccctccagccatgcctcgatcttctgcttcagccggagcccctttgactggaagagggggatcggcaccgtctccatggacccaaatctccttatggcatccatttggagcactgattttggcatttcttggtgttccccattatcaatgagcacaagctccctcccatcatcctcctcctcctcacggcaaacactgtctccaatggtgagaatccggaatccgtcttgcgcgatgtcatagtcccggcatctgaagtagtcctccgggaggccgaggtgccagagcatgccctgcgcggcgcggagcgggaggcggcggcgcggggccatgaggaggaggcggccgaggcgggaggtgatgtccgcgcgccgcgcggcgaagacctcccgctcctcctgcaggaggccggcggcggagcccgagaggcggaaccaggggtggttgtgctccggcccgacggactccacgaaggcggcggggaaccgccgcaggaaggagatgacgcggcggtcggggacctcgagcgggatgcgaagcttggagaccgcggagacgggggtcggcgacggcgagaggaggccggcgagggacacgagcgggcggaggtcccgcgcctgggacagcacggggacggcgtcgaaggaggcgtccttcttccatcgcatcttcacgtccacgtacgccatggaccggacgaggacggcgaggggtgggaggagccgcgcctcccgccgccgtatcgcgaggggcctcatgttggagaagaagaagagatggacagagacgcagcccgtctagagaaggctcgtacccgcgggagccggtgtccgccgaccaggtatctcgccggaatcgtcgccggcggcgggttgggaggccggcggtgggagtggagaagacagcgtggaagggttaggggttaacgggctgttcagaatgtgtttcctgttgggctattgggtctattgggccgtagtcaattctgacggctaaagagaaataagttcacttttggtcccctaatttgtcgcccagactaaaattcgtcttaaaccacagtagcatgtatagaccgtcccgaactcgcaaatccgtatcaactttcgtcccaaggcaatatagttcttgatttcgtcctacttggcgctttgactccaattagctatgctaagtcaacgtgggacccctgtgagccccacgtatcagcatccacctcttccctctcttcctcgtccttctcccctctcaacaacggtgctggtagcgacccccgctcgaggagagcccggaagggctgtcaaaaaagctcgaggctcgcgagcagctcgagcttggctcgtcctaggctcgattcgagctcggctcgagcttcaaacgagccgaacccgagcctgagcaaaagctcgcgagctttaccgagccgagctcgagcttttgccgagcctggccgagcttgactatttatagttcatattgcatgttcaccttattgatataataaactaataggtaaatatatatatatattagtatctatttacacaataaattagcatgtgttagcataatatatttattttaatcattttctactcttttattagtgtgattaactagaaaataattatacttatcaaaaaattatcattaaaatatatattatactacttatgaccgagctcggtagccgag

SEQ ID NO: 56061 - DNA, 1728 bp, Oryza sativa
ggctcgagctcgttcgagctcgagcttgggcagacgagctcgctcgagctcggctcgttgacagccctaagcccgagccccaaggcatccgtccgaggggtaggaggagcggagaggaacagctagagcgaggtgaccgcgcaggctagtagatacggcggtggtggtggtggcgattgccaggataggggcgcaggctgcccccactttagctcatttttcttctcactcttccaaaaaaaccctagaccacccaaaccttgtaggatcttttcccccatggtgttcctcgaagctctccgacgagccgtattatattgccactatcctcgatgacttcggtgacggtggggggttctcctccgaggcgccacacgtcatgcttctcctctctctctttgtccttgcatagctatttatcaagtaatagatttgatcgggcttcgcccattctccaccgccaccgccgccacctcgcgagcagcggccctggggactagccatctttagcaggctcacggagacttgcttcccaaaatcatcgccccgtgttcaagtcccgagggaataaggccaacctccgtcctaaaggtgtgccttttatatctctcctcctcctcttgtttactactagttgaaacgttgtgatccgagtgatccttctgatttattcccaaaaagtacgcgtctttgattgtgtgatgtatgtgtggggtgctggttatgctgattatagcattaggcaacatgtccgtgctattggggcgaagtgcaagctaggagagcctatcatagcaaaccagtcgaacaccagtcgtgtgcaagccagaaaggaaggtggagcaggggtggcgctctcgcagcccctctccacgtcgtccaccacgcgctctccacgccacttgctaggcggcgtcctgaagatggaaagagagaggaagataggtggcaagagaggaggaagaaagtgctgaccattgacatgtgggatgaattttagactaggcgataaacgaagggacctaaagtgaacttaattcatacaaaaagcccatagtgatcacggcacatcataattgggcccatcctgtctccttccttcctctctaccctataccctagttcgacgccgccgtcgcctcggcatagactcccctccccgtctcttcttcgcgagctcgccccgccttctgcgccgagcaccgcctatcttcgccggcgtcctcccgctgcatcagaggtctatctggtggtgagcatccgttctcacgctcctccttcctcatctatctctgcccacgccttatgctttacggtctgcgtctctcgttaggtcgcttgaatcgggaggtttttgttggattggattggattcggagagatggaggatgtggagaacaagctaaaggactatgagattgtgagggaaggcgaggcggagatcatcatcaacaagaaaatagcagcaaatgaagtgttctacaatcccgtgcaggtattgttgtgtatatgttctgtatgcgatttttttgggggttatttgatgctgtatgatggatttgtcggctcctctatcttcttagaatacgtgcatcattagtggttggtttgtttcgaattgatcgaatggtgtgagctgcgagcttcaccaatcgtgcataggtaggactataagtttgggttttggctatttgatttgtatgtgattgggtcgtttcaagtgagtgg

SEQ ID NO: 56062 - DNA, 1132 bp, Oryza sativa
tgttaatcatggcatgcaactgatggaaataaataatggcagaaaggaatacgactttttggtaatccatttctcactagaacatagatatgtaaagcacttcaacaggaaaattattgcccaaatgtgcagtaatttagttaaaccatgtacaagtaataaattagttggccatctagttctgcatttgtttgtcatggctcactcatttactcttgagaaattatttatagtttacgaactctttaaaattttctttaaacttcattttgttattattgtgatgcaggagttacatgacatcccattgttcttcagtctccacaacatatgtgctaatgttaaatgcacatctccatctgcagtattgttccgatctgcagtcctaaatgcgggttatcggatttctagcacacatgtgaatccacttggactaaaaactgatgccccttgggatgttatttgggacatcatgcgctgctgggtacattcatttattccttttgccataactttcctaacatattgtgtttgctagtataaattgtgggtagtttactagaaatgctgtttttttttagtattctgactaatattgtgacattcgcatacaggtgaagaatcatcctgtaaaggaacaaccacatgactctgtagggacagcgatcctttcaaaatcacccaagcttgaagtatgcatttcttgaacgtgcagcagtccttttatgcctttcagttagatggcattctaacttcctttgtgttttcataggcaaatttctctagagcggctgctgccctcagcagggctcaagcaaagaaggtcaagcggttccttccgaacccagaacgtcattggggtcccaaaatcagagctggtcggaagattacaagtaaacatgcttctctgttaggtccagacgttgtcaaccgtgttatcaacggtgctgccagcaccgaagatgaaaaggtggccgagccaaataatccaacgacagaaaccggaggagatgcaacgaatgaagaggatgaaccttcaacaaagcgccaaaaaaacggcgatgttggattggcaaccgaaccttaattgtcactgaacctgagcacgtttcgctttcaccggggtgcagga

SEQ ID NO: 56063 - DNA, 924 bp, Oryza sativa
tcagagatctgggttgaatggtcaactgtaaaaagtacccttatcagacttagtgcaatgtattgtatactccattacatatcaaagagtaatcagtttacttgagaaaagttttgtcattgcatttaccttgtgtgatgtagctggcgatcatagtgtatgtattgggtccattttaaattattaaaattgtggacttgaagggtcaatttattttatattcttctatgtaactgattattcattaaccatctcttccttatcaggcttggtgaagcaatagacaggacattacttagtcatcttctgaagatgtttactgctcttggaatgtattctgagagttttgaaaagccctttctggagtgtacatctgaattttatgctactgaaggtgttaaatatttgcagcagtctgatattccagactatctcaagcatgtggaggtattgataaacctcttgtatttccccttgcattttgttcacacaaaattcaggtatacttatgcaattggtggtatttcacatgaattattcagacaaggttgcaagaagaacatgaaaggtgtattctatatttggaagctaacactaggaagccgcttataacagctacagaaaagcaattattgcagcggcacacatctgcaattcttgagaaggtgattatctgctcttacaactgtaggatttgttatctggccagaataagaatgtgatggtgcattttctagttgacccattagatcaatatatagaaaagaggtgtttactttatcaatatattatatttgttggccactaatttagtttagccactgtctcattcatgacctggcatatgatgttttactgttcagggattcacaatgcttatggaagcaaatcgtgtaaaagacctctcgaggatgtacacactct

SEQ ID NO: 56064 - DNA, 763 bp, Oryza sativa
catgcaagcagataccgaattcaatcttgagattaaagtagataaaagatgacagaattgaaaccttgagcatcggaatgatgcgggtcaacttcttttgaaattgaattaaatgaatataaatatactgcgatctcacatgagtactgaattgtgaagagctagcaaataactgatcatcgaacacgtcagaaagcacacaggcgaaacccggaatatttctaaagaaatctcgatatagcgggatgatacaacagtacgaactacgaagtcactgcagagaatttaaccccgaaaaaaaaaacccaacccataaaaaggcaagccgacgaacccagttcccatcctcatgatcaagcataagaacaacaacaaaaattaaaaataaataaataagcacgaggcgcacgtatcagccgcgatcacatcacagcactcacaggagaggagaagagagagacggaatcgggccggatcgcttaccggcggctggacggcctccatggcgtccgacgactccggccgccgccgccacaacgctggcccagcaacttcccctcctccttcccgccactccctcctcccaactgacgagcctcgctattattagggcttgttggtgtacttacagctggtaacctccaactaatcactctcatggatgagagacacccaaaaaggccaagaaggggtcagtggaagagaagcggaggcggataaaacggacaagtcagtgctggcctgggcggagacgacggcgacc

SEQ ID NO: 56065 - DNA, 1363 bp, Oryza sativa
tcctgcagccctgactgacaatacgtaggccactgcgagagcatcagaacatgaccattaaattagcgttttcaacttccaaattctcacggagaaaagagagagggtacggaaattcagtttggctcttgtacataatttgtgatgaaaaatcttacatggtattccatccctccctaaaaaactaacatagtaatgaatgtgacgtattataaacaaatctggacgtacatttgtctaaatttatagtattaaaatgtgtcacatctagttttagatttactttttataggagtactatgatagtcatttatgatataaatatatatataaatgactaaaagaattatttaccatgctttctagttttgcgtaacactgttcttttagtttttttacggctcctttggaatgcaagaatttaacaggttttggatcaatttccgtgaaatctctgtaaattccattcacttgaaaagagaccttagtgctgtatagcgtcagatttcagatcttgttgggattgtgctgaggcacgttaacgtttgtggtggcgttaggtgattaaacagaaaaacagctcatgtaatctactagatacaagacaaagcatgtgggtgtcataaaatcgcaagggtagttcagagtttgtatattttgtatcaggaggatttagatttgcttcagcttgatctgaataacgtcattcaccaaacacaacgtggctggctgctgctggtgattttgatcaccaatggtcggaaactctgaatgggccaaagcatagctcagcaacaaatgcaggtatttcatgactctcagacatgttttgtctgaagatttagtgagatcagataagagtgccatttccttcattctaaaatatagcaagctagcacttgattagacaccatctaatactgcaaaaatctggatagacagctgaaattcaagtttgacaataaaaaggttgtgctttgaggacgaaatttgctatagaacacttgaaatgataaacataaacagctcacaagccacaagatggctactccagcctccaagagcacgttttagtgattttttcggcggattatattttaatgatttgaatcaacgatatcccatcacttttatatgcatagacaatgacagattgacaggtacctgaaaatcagcttcagacaaaacaccttacagtatggtagatagcaaaggtaccagctgcaatagtgacaggcaaaagttacatgcttcctttcgttcatcatgtgatgcagaagcttatgaattacatgggtgattttatgattcatattcagaaaaaaaatgatgattttacaccaccctacaagaatcatcagat

SEQ ID NO: 56066 - DNA, 1882 bp, Oryza sativa
  unsure (1)..(1882): unsure at all n locations
tgcaatatgcacgaatatacttaacaaaaacagctcatttatgtggtactctcaaagtcaaagctcaataattctatgatggcatcagttgacagaggcatctatgttcattatgtggcgctgtttcagccaagtatgcatgtagtactaataattaatacgaagagtcaagacagatgatgtctagcaacctgaaattgtctggatactgcttaaggtagcttgtgaactcttcatcatagagaaggctgtcagtgttagccacaccaaggaagagccaggccaagccaccaaatctgtactttgggacatcttccatgaacatacggcgtaggtagccacggaatggagcaacaccagtgccagtagctatcatgatgtgagttgcatttggatcttcctcaggcaggagcattattttgcctgacggacctggtgttcagaaggaaatcactgtgagatacttggcatccatcatgtgccacaaaggacatgatgactaacaaagaaaagggtaaactaagatgcgattgcaaactttagtaagaaaggaaaagagcaagataagataatcatattgtagaaggggcataatcatattagaggagaggctattggaacctttgttgcagagaaccgtttatttgttgttggtatgtatgaactcagaaataggttgtctaccaaaggtgggtttcaggaaaaacgcaactaaaacaactaattttgctccgcttggaattagaagttaaacaacctcataggaaactcacaaagcctttgcattcatctgaagctgaaagaaatcaactaacctgtcactttaaccttgtcccctggttttgaattacataggaagttactgcagacaccattttttgaggggtcctccttgccagtttcaggatcataataaacggcacggcgcacacataaactagtggtccnnttccatcgaatgggaatctccataccttgtagatgcaattgaataaagacgacattatgtggtgcaccaggcttcttcgggttctccccctaacaagcaaaaatgcacagggtttagagaacagtgaagagggtgatgcccatggagataccactggaactgtattaatagtgtgtgcacatactcaagtctcctatcaagagcaggttttctcacctaggtttacaattttaagccattgaatagaacattggaaacagtgtctacagaaataatcctaatatactaccgactatatctttgtaagttcttaattaatagtgtcaacgagacaatcgttcaatatccaatcagataaatagactatgaacgaaaccgacaaagcataagcataatgttctattttaaacaaggaaaatgattgaaagcaggaattacttactggaggaataatgccatagctttgcccctcccagtaaggcacattgccaccatgatcaataacaatgtggcatgtctctcctggagccttggggcctacgatcctctcaaccgagacaattgtggcggtgtaaggctcctttggtttgtatgtgttgagcggcggctcgttagcactctccaaatcaagaggcttgacagcaaccttgctttcgctcgcttgctgaactgacatgcagagcaccttgttcgcatgcctcggtcgcgtggccttgctctcccacgccaatgtggtgccaacccatgatttgttgctaaagctaatattgttgctaccctgaggaatcacacagaatgaaatccagcacatagtttagcaccaccattcaagaacgctgtgaattcaggataaacagcctactaaaccaaaaccctgaaccctgataattgatctgcacatcgaattaacaagcagcagcaatatctggcgtt

SEQ ID NO: 56067 - DNA, 734 bp, Oryza sativa
acctgggacgcaacggcggtcgccatggccgatcctgagggaaagcaagggtcttttgatctggagaagggagatgagatgagttgagatgagatgggaggggaggaggcggggtttatagacagaatcagagaagggggaggagtgaggtgagctcttgaggtgctggaaggggcgacttaagctattagctgcttaattgcgtgattaacccggccgctcttggggttgatttaagctttagctgcttagtaatttcgttttagagtttgggtttggggtttgataatttaaaaaaaaagattttgtttttttcgtttttgatgttgattagattagggggtttgggttaggtggaggtagcagcagagggttgggttgcctggctgcttgactagcagaaatggtggctgcagcttgagtgctccagatggctgctgataaaaatggctttgtggtggcatcaagggtcacctttggcctgaagagatgcatgtatcccatggagctagccagatgcacatacaacttgtatattattagctttttagttttttggaacagtacatgagttggcagcgtgtgcatgtagtgcacaagccggtgtgtatctgttggacattttactgccaaaatgtgtcaaatcttggcgaaaaaaaaaacttttttaaggatagagggggaaaaaaaactttgtgatcaaagggctagatgtttgcccttgcaccaatgag

SEQ ID NO: 56068 - DNA, 830 bp, Oryza sativa
agtagtattcaagaaagggtacagatacagtgggatgtgagctgaaaagaagaagggaaaaatcaagagaggaaacaggtcactcacaatagccaactggaagcataaagccacatacagatgaacattcctatgcgcaaaactaactagatgtgattagtattatctgaaattttcagcattgggactgccatagtccataagtaggtcatattgctcacagctgaaactaaatagatgcaatcagcattatctgttacatggttttttttaataaatacaataatagtgtgaacatagtatattgggcaagaggggaaatattcttgaacaatgagtatcatcatggaaatatttaatacttggaataaaaatggcagcacttattaccattcaagaaaggaatccttgtgtcactgtgtgaggcaacacactgcaataaaaatacaatgaagtttagaaagcaacatgttgtattaaatcagtttagggatcctaagctgatactacctccatcctcaaatataaggattttgcctatgtaattacataggcaaagtcccttatatttggggatagaggtagtagcattttatcaatcccccttttatgcattgcaacatgctgaaaaaatagccttctctcatcccatcatgaggcaccagtgtcataagtagagatttctcactgtcgtaaggtttctttctttctcatgtaaaggtgtacctgaagaagtgcaagtgcattgcagacacggtttgaagcccctggagataatgttgggggtgaaagtgatggatagatggacacaatctcctgcattatccaaa

SEQ ID NO: 56069 - DNA, 1661 bp, Oryza sativa
aatccccctcgccggagcccacagcgatcgatcgagagagaggaggataaaaaaaatgaaaattgaggaagaggagagaaacgcatagcttctcgcgacaaggggagaccttggagaggtcgaggagggcgttctcccgcagctcggggtcgcagaggtcgagcacgagctgctccgcggacgccatcttccggtccttggcggcccccggagccgccgccgccgccgccgacgacgacgaggaggcgccaggcgagggcggcgggggcgagggcgcggcgaaggaggcggcgccgatggagagcgacggcggcagattcgccatttcgcggaggcggcggcggcggtggagtggagaggggagacaggacaggaggaaccgagcaaggccgagagagtgtatatacgaggagacaaagccggcttttttactaactacaccctccactaaagtagttttgttgtttttagaggtacgttttagacaaaataatatggagtattttgtagtaaggattgtaaaaatattgttacactaagtgtttggcttagggtgtcaacaatggcatgatgttagggtatacgagtaggtgacacaagtaagaacttttacgtaaagggaagttttgttgtttagagggtacattttagacaaaataatatggagtattttgtagtaaggattgtaaaatattattactaagtgtttggcttagggcatcaataatggcatgatgttagggggtttgcgaacttttatgtagagggaagagcgagagagaaaaaagagtaccttcaaacagcctagtagatagcttaatactctctccatctacttttgatagtcatattttcaaatctggaaattttatttttgataggcatatttcaattcaacaatctatcatcttaatgactttctcggatttaatgcatgactctccattctttcacacatgattggctacatgggcattgagaaatgtaaatattaatgaatcgtttatttacaaagaatgactagtagcatgtttaaatggatgataagtagaattacttattcttggtctgtgtgccaagatgaaatatgactatcaaaagtagatggagatggagggagtaccatctatactcgtctataaaaataaggttattaattatttaattttatttgaaatagttcaattgattatttgtcgtctgagtcgtatgtagtcccttcatccgcgattggtcatcatattgctaaaaacaataaaaaaaagatccatgtttgatcgtcgcaagacgttgggagctggcagaaatcaagtggaagacgctaatgatgcttttgtatggtgtgttgcggaaatcaatttgggagtagttcgtatgcatggattttatgcgatcacaataaattggcgcgacgcgcgggcgaggccaatgcgccatgcagatcatgatggcgtgcatggatacgaaacgtcaacacacgttgatcaatactgattaagtgtcatggggggttgtattggtaccgggcacaaagcaaatatgacaaccaatcaaaaaatggaaggtgtatatgttttttatatataacgcacaatggtcatttaaaccatttatgctagttttttttttaagaaaaccgatcatactttttaaagcgacat

SEQ ID NO: 56070 - DNA, 2759 bp, Oryza sativa
ggtctccgtgaggcttgctaaagctgttttttcgaacggtcaagccattgccaacgttttatatacttcctccgtcccataaaaattacatttatagctaatttaggataaaacagtaggattggaaaatgatcacaatggccttatttaatgaacccattgcatgcacacattccatatatacaaatgattaaaaggaagtttgagagaattaaccatattattagcatgcttaattacatgcattagcagcccaaattacatgctttagcgccaaatggatttggcaccaaaaatttgctgcttgcattaggaatcttatctagatcaatcaatttgctggctctgaaagtgcattaatcctcctagtgggttttggtgattaatgacaaatgtggttaagggactaatgagctcattgagtagctttcaggtgcattagtccaaggtgtggaagatagatgcttggagaccccccaaaaagtacaaaatcaaagcggactggaactcgaaagtgcataggatagtttatcttttgaaatcgagtttttaggaaaaaccgtactattaagagggattccaagtgatgctctgagatatatcaagtgctcttagtgtgaaccaagtgtcaagtttccctaggagtcctttttttgcaaattctccatctgtccaaaattgcaagtccggaacttcctgtcttccaggtccagaagttccggtcttatgaaaaagattttcctaagtgtagtctggaagttccggtcttccaggtccggaacttcctatctagtttccagttcaaatttgtgagtaacgtctagatgacgtcacctagccgttatacatatacagctcgtttccagctcgttccttggccattccactttcacttttcgaacctagagctattgctagcctctcccaagtgtttcttgtcttttccactgaatctagagcctaattcttgtgtgaaagagagattgagagggagagaagaagatttggagaggtgtgaagactaggatcttgggtgagcatttggaatatcttgtgggctgtcatctcggtgcttattactcttggagatgatctcctagacggttaggtgtcacccacgagaatccgttgcatattgtggatgtcccgggtaagtttgtgaaggatttcctctcctccaaaagggaacgaggtaagttagtgaagttcttgtgctgagattctagaggctttccaagtagagcaacccacacttgtggtggatttctagaagtaggttgagttggatcttggtggtcactcaattctagaaatttgcctaggggtgtttggggttgaaggctgtggatttcctctggggtttttgcacaagtgaggcaaggagttaatcgagacccagctcttggagctcctcaacggagagtaggatcacaagatccgaacttcgggaaaaaatcgctcttgtgatgtttctgtggatgattctgtgatatatcctctgcttagaatacctgtgcaccatcttgtgaagattggcttagtctcttgtttcgaaatttaaatttcatctctgttctgttacccggaagtttctgtcttagaacaccggaagttccggagttccttaccaggaagttccgggtctgtttgaattttaccgccgcgatttgtttttaagttttcaggaacagcctattcacccccctccccgcctctagtcttcatcagcgctgttcaggctccacatggctacaaatacaatttttgtgggacaaaaccttggagctagaaatacgatttttttaggatggaggtagtaaaaaagaagacgttccattttaaggagaaaacaagaccaaccagttaataggcttgctaaagccacttggtcactgttcctagtacaagaactcttggcgaatgggctgggtttagtacctgcttctcttcttattcccaatattttaggtcctaaatatcagcatgagtgagaatttggttacatctacattagcaaagttctctgttgtgtcagttaatccagcgtgcatatcagtgtagtaatgtgtacatcttattgtaaaggtgcaatatcttgattctcaaaaatttccacttgctatatttgatgcagctttgcaaaattgattcatgtgtaaggctagagaggtggtcggctgctcatgtgtcgtcgtgaaggtaaagtatcgattccgttattgtacaaaggagaatctcattccgattatataaaatctaacattttcgttttgctttcctctaaccaggactatggtgaaggaatcagaatgctttaacatcggaatatgtcaagtcacactagggacagctctcaagtatctggagttttcaagatgctttttgtccctcatttaaatttgtatgaagtcttggaaatgattagattatgaaaaattttcatctctgaggatgccaactgaagatcttgtttctggtgttcttggcatcatggtctaattaccagaaatgaagatcaatataatttttctcggtgttatgcaagcataatccctttctaccggcaaaagttactacaacgaatcattaaaattgactttgcacgatcattaaaatttcatgcttgagcttgcatgatctattgtgctaaattgtgttctgatattgtgagcactacaatgttgacaaatccgtgttgatcactacaatgttaacaatatctgatgtactgatatctgatcactatgtgtgttttccca

SEQ ID NO: 56071 - DNA, 3212 bp, Oryza sativa
tgaggtaaacagatcttcaacgtagagaattactggtccagatgctctgatgaaagtctgcatttgaacctttgccgaattttctgcagggggcaaaacgaaacagaggagcaaaatctcccaaggtcagaataatgtcataacatggttagaaaaactaatatatcttgttaatttgataactcatctattacattttctactcttttctggcacttgattagttcatatacacagatacactggataccaatatgtgtatttacgtattactagctctcttgtagcaaacagttatgcaaaaataacaaactatgtactttctaagatatcccaaaaacgatgtgatgcaatcatgtcaaccaaaaaatatatatgagttgcttgctgtcagcatggaagtttagagaaatcagacccgtcactcaccatcttcattcaatttcttcaggagctgcgattttgagggaagggcgtacattccagcagcaacggctttccttatggcccacccatggtgaggagcaaaaacctgagcataagccttagatgctgcatcccttaaggagttgcccctgaaattagtatgcaaacgttttggtcacatttactgaacatgcatccaagagtaccaactttagaataactgagaaggaaccaacaccaaaattcagtttatgactttaacttactctgtaaccagtatttgctcaaacagaattttaaccatatcaatcccacgcttaaccctcagcatattcctagtatggctcccagcttgcctgacggtgcccttctgaatgtccaactcaaccatctcaggcaattttgagattgacttggatgcctccagcaaatcatcaacctgcactcaattgagaggaactaaatcagacaacacacaacaaaagctcagaaaagcaagttatagttaaacaggttactcaagggatgcctagtgggggaaccaaggcggcattatcatcaattttgcagaagtacaaggtcctgataaacagaaaaactggtttgctaaatagtaaacttacgagtaactgctatactggataggattctaacacaaactactaagcatccaccaagtcaaagtcatcgcaacacggattaggtgatctgatcctgatgcgtgcagacattcctacctgacacttgatctagccatctaggtgataatttcagatcatttcgacataatcacctagcattaagcagctcagattcaggtgatcccctcaatctagccacaaccatgcagactacttcctccgtttcatattataagactttctagcattgaccacattcatatatatatatatatatatatatatgtgtgtgtgtgtgtgtgtgtgtgtgtgtgtgttaatgaatcatacatgtgtgcctagattcaatctatatgaatgtgggcaatgctagaaagtcttataacctgaaacggaggtagtagcaaacaattaatagccgacctaactcctaagcagcaaaaaaaactcatgtcaatattcagaatttggattgagtcatgtcaattcagatatatctgagttgcttgctctcagcatggaactgtactagatatgattctaacaccaactactaagcatccactaagtcaaagtcatcacaatttgggaggtgatctgatcctgatgcgtgctcacattcctacccttacagttgatctagccacccatctaggtgagaatttcagatcattttgacacaatctcctagcattaaagcagctcaagttgagataatcaatcccctcgaggtctcaacctaaccaaatccacacagactagccaacaattaagccgaggtaagcagcaaaaagaggtcaatctagtcaagcaattccgacgaaacctcgaggacaagggagagcgaagactagagagcgggggtggcggcgggggcttgccttggcgacgtagtccatctcggcgaacttgaaggcgatgccgaggcagccgaagaggacggagacgttggagcaggcgcgggcgaaggagcccacctccatggccgggccgggggcctgctgcttggccaccgcctcgagctcctcgaacgacgccgcgatccgccgcagcggcttgtccccgtcgctcgaccccatccccacctcccgctcccgcttgctccgccgctgcggctcgtcggcggcggcgtcaagctctccgcctccgggatggttggggtgggtgggtctctctctcgtgtgctttgcttttggttgtggttttacgcgtagaggtgaaggggaggaatcgagttcgctctgcagtgggccggaggaatatttgtatcgtctcggcccatcgaatgagaccgacgtgtcggctcgtcgatcctttctattcctaaacctgaacttttgcctcctctagaagaagctgaattttgctttgtccagaagaagctgaaaaccccgtattttacttcctctgaatgaagaaaaaacgaatctttgctgcattggactgaaatacctcgtgtagatcagagcgagtctgaactccaaaaaaaaaaaaaagtagagatcaaggagtctgaaactcttcggtagaacatactaggggactgtagagtgtaaacatggggctgttttggattaaaaccaaaacataccctaccaaaattttagtaactcaaatagtaaacatgaattttggtaacttaaatagtaaacatgctagtttggattggacccaaataattgatattactcatgtttaatttggtcacattcaaaaatttctcaccatactaccataactagctgggtggcccgcgcaattgcacggttagcacccaaacaaaatcatatattttttagtatgattttacttaaaatttattaaatagctatctcattgtttttaagactttgaaagactaaaccttatcatcctcgtgttttcaattatatagtttttagaagtcacaccagctgccccttatgtcatctccttctttatttgcttgcttgcttgatctaccattattcctattcattcttcttcgaacctttaaaaattggattttacagttttagagcttattgtcacgttgggtttcatttttataatttctagatgtcccgttaaacgttgccattatactcctctacggcctgtccactgtctcttctctttattgtcattgagattttaaaaatcgaa

SEQ ID NO: 56072 - DNA, 7643 bp, Oryza sativa
tttttactttttagaagttccgaaactttaaatattggacttgtaatttcattttttataacttttaaaagtcatataaacgatgccactatgcccctctacagcccgtccgccgcttactctctatgtcattgtgattctaaaaatcgaacataactatcgttgaaattcattttttgtattctagaagtcccgtcaaccgtcggtggctctgcaactatactcttatacaccccgcccactgcttatcctttttattgtcattgagattttaaaaatcgaatagaagtcccggcaaccgccttactcgtttgcttcacaacctgcctgacgtctttccttttaattgtcattaggattctatttggtgtttcattaataatttttatatgtcgtatcaaccaccaccactctactcctttataggcatgttacttaatttatctcgtcatttgttttagatggtcttttctttcaataatatttatttttatcacaaattttagttatttataaattgtatttctaactgaaatcttatttttctttttctaatttcagattttttttaaaaaatagttaatacagtattgtgttcttttatttattttttattttttttaattttcaatttcagttgtttcaaaattatattcctacttgaactctcttttaatttttctaattttggatattattttatttttttaattctaaattttaattaatctcatattgggttattatatggattcttctttcagtattgcttatttttaattcctaattttaactaattttaaattgtattcctacttgaactcttcttttactttatttttctaattttggatttatttatttttattctgaattttaattaatctcatattgggttcttatatggactcttttttttaatattccttatttttaattcttaatttcagctattttaaaattgtatttctacttgaactctcctttcctttttaattttggatttattgggttcctatatagactcctctttccatattgcttttggactctcctttccttttctaattttggattttattttatttttattttgaattttgattaatgtcgtattggcttcctatatggactcctctttccatattgcttatttttaattctgaattttagctatttttagattgtacttatacttggactctccttttcttttttctttttctccgattaatgtgggaatttctagcccccacagcgaacgtgtacctcctttcaaagttgttttaataatataatagatttggcttcatattggtatcaaaccaaacattaattttgctctatcaaaaaaattggtagcgtcgaaatttatctaggttatggcactaccaatgaattggtagggtaaagagcactaccaataaattggtagggtaaagaaccaggcgcatcttgcaaatcataatcggttcatctcatcaaatctactagcgtagcgtagcagtttgactcttgaggaagctgcatcctttaggcctctcatagtgcaagctatggggcccgtacccccagcccaaaaaattggtcctaagacacccatcccacagtgcaagcacccatggcttaatcggatagaggcactggtaaagggtaccaagcccacagtgggcgtgaccctagcttccggaccggtggagcgaacgaaaatttatttcctccacctaccccttccaccccttcctctctcgcgtgagacttctcctctcctcgagtactactcttctcctctcacgccgggaggcgacggcgctagcagttgccgcctcgttgtcgtggtggcggcgccgccgccttgcctccttcccctccctctctatccctcgccgcacctccttctcctccctcaccgcgacgccgacgggaagccgcggcgaggaggcgtccccggcggcggcggctggcgcggtggcggaggctcgaccgggggacgcctccaccgcggcgacctcgccgagggagacctcgagcagccgccgttgccgcgaggaggagcgagtgggctgggccggcggcggatctggcggacgcggcgctcgtcggcgtgaggagcggcgagtgattcgagacagcggcgaggaggagtccccgagaaggcaccggcgcaacggttcccctccctaagaagaggcatggcggaagcggtgtggtagaagaggcggcgcggcctcctcctcccacgccgcggcggcacggcctcctccccgtcgaccgtgccgctgatcctgaccccaccggcgccgccgcggtcagctccgtcatcgatcgacgcggcggcggacggatccgcctttcccgacggcgggggcggcgagggcggcgggaacagacggcagcgagggcgaagcgggtacgggaacagtggactcttgtgtgattcctctctgtgttcttgtgtgattcctctcctctttgtgttcttgggtgattcatcttgtgtgatttctcttgtgttcttgtgtgattcctctcgtgttcttgtgtgattggcaacgaaatcggtggcgggaagaggagatttgggcgtgacttcttactgatttttcgagggcgaataggggatttcgtcaggggaatctcgcacaagagcatcgggcagcgagggaacaactcccacagcgcacgcgcctcacatcgattcctccgcgcgtcctcttttccaggcgaggttttgcgcccccagtttaggcacaagcgccctagctgagacgcgggtctaagcaatacggcagcaaaaatccgacatggcgcgactaaggcacagtccaggtcgacacactgtgaggccttacaacgtcgtcgccaatttcaccaccgacatgagcaagagcagaggcattcggttccagttccatgggaaatcttggtttcgttttgatcacatgatcccaccacaacgttaactcgtaaagctacacatttttacgtcttaatggattgatttccttgtgctatctcacgaattacagcactcttcctgtcccaatgttcctcacatttacgcgaattacagcattcttctttctagagtacagtcgatggaatcatggaaatttgatacaacaaattttcaaccggtcagggctcccagcgcattgagccacccacacaagcattcgcacgcatcaaacaaaaagcttgatgcataaaaagcgaataggtaaaacctctagtcaagatggaaagattcatagtttatctatgaagtatttttaggagaaagagtaagatttacatgtcaatcaacacacaccggattttggagttatacgagagagtcagatttacatgtcaatcaccacacatccgcgattacagcggatcataagactggggcgacaaatatcacatcatcatcctcaacatagaaccaatggaccaatccaatcagatgaaaaaagccacaacaaaacaacaaatcaagaactgcaaagcgaagaacatcgaagagcgcgaacgcattggctattgagtcagatctgataacatgtcaatcagcacaggcccggaatccggatcctaagactggggcgacaaatatcatatcatcacgctcctaataacgcatccgtgcatcagaaaattggaagtcgataagccaacaaaaagcagttgaaatatggaggaaatcttctgagaaaagaaggaaatgaagaggcgagaaagaatcaacagattcgcatcagagaagaacaacggcgtcggcaaagcacttcggcgaggagttggccgccgcggctgcatttatgggagggcaagagagagctagggtttcgttggatgggctgaaattttgtttgggcctcttgaccacgtaaggctggaactgggctttcgttagccttttagctagtacggagttgatgatagcttagtaaatataaatattcaccatccaaccaaaagacacacacatcaaactatccctataaaaattcggctaaattatttaagaaaaaaatatgtattttaatgtagggctataactttgtagacaaacggtacacgttatagggcttgttcgcttgagctacattgcacccagttaagactgtggctagcggtagtacaactttttctgtagatgttgtagttgtacagccacaactatgtccaccgaacacacccatagtgtttgatcggttgagttattgctataagccatataaaaattgaacaaagcgtctaatttgatttatggataataaattttatatatgtgttattagggatttaataggcaaggttggaaaatagaatacgatgaaaaataactcaaaataaacttcaaaatttagctgaaaaattcaaatttccgtttcggctaataagccaatcagatgatgagagctgattaatccatattgctagatggcaattgattcaataataatctctagcaatatcatctttgaatctttgatgatcattctgttttacacttcttggaacatactacagttgcagtcttgcggatcaccttgtttttcactagactctacttcatcttcattcacaagttcaacatacattgcaaaatcatatatacatttcatatacaactactttacaaattacaactaaattgacgaaagaagggggagaaaatggtaccatattttagtacgagtcaccaacggtgacaccaaataataatgtcaatagttatgtacaaatcatgcaactaatccagcttaattctaccatgatcaaatgcatgtacactcgccgctaattaaaactctggctaattaagctgcctgcttctgcagctcgatctccttgtcgagcatctccatgaactcttcgtcggtggccttgagcatgtccggcagcggcagcgagacgccggcgtcggcggcggcgcggtggcgcggcgcgatccgcttgtcgaggctgaaggtgaagtactgcgggaacgccttgatgtcgtggacgccgccgcccatctcggcgacgaggtactcgaacttgggcttgtagttgcgctcgatgctgaaggtgaagagcgccgggcagcggagcaccatggcgacggcgtcgtcgcggtgcatgccgagccccgcgaggaagtccagcttggggatcatggtgcgctcgacgctggagacgaggaggatggggtcctggaaggcgagggcgcgggcgtcgcggaagccgaggcggcggaggtagaggagcgccgggcggagctggtcgcggacgctgcaggcgaggacgcgggggcacttgacgacgacgcggcggtaggcggtgtccgggatgccgaggtcgtcggtgaggaaggcgaagaccgggcggaggtcggcgcggacgctggcggtgagcagcgacgggcacatgccgaacacgcggccgaggtccttgaagtggagcccccgcgactggaggaacgtcaccacggcgtggatggactccggcgccgcgtcgcggagcgccgggttcagcgccagcgcgcgcccgtagtccacccccatcagctcaaggctcaggatcttgtccttcacccgcgacggcagctcgggcaggtgcagcgacagcgccgccgccggcgccgacgccgacgccgccgtcggcgccggcgccggcgtggcggtgtagggcttggaggaggaggaggaggggagggagtggggcttggcgacggggagggaggtggaggcgtagaagctgcagagcggcattgctgcgcgggcgacctcgtcgtcgtcttccctccgattcgagcagagaagaagagagtgtgaagtggcatgtctcatccgcttctttatctggaggttggtgctgacgtggcactctgggcggcgctcattggatggtcggattcgggcaagaggaaaagatcacacaatgcatggaagcagaggccctcaggcccacaagccaggaaccgagcctgtttgcagtaataatcctgtaggaattcaaacatgttcatgcgttcaaattttacatacaagcaaaaaaaatagtaagaaataaaatcaatcgtaataaactttaatggattggtaagcttaacttgcacatgcgacatgttcatgtcaatctggggacaacttcattgaatcgactctttcagaataaatacagtactatgatattatcgtttggacaccacatcaaattgccggtttctgagcaacaactatataggtcacacggtgtaactaacatggattattaattagccggtttatcctgtctgatcatgggcagcgcaacatactggggatgatgtccaacccaacataattcagaaagaattacatgtaaatacgctcctcgatgtgccaaattggatctctggcgaatgttacttatgattgagaagctgtgtctttatttttttttctttttgattcggataagctgtgaaattactggtatagtattgctgcaaacttgggtgattagtaaaggctagcatgcgtggaagggcctcaaatcagcatttacccatggcttactgctcactgatgcccttctggcgagcttgtggttaggagttacatgatcatcctgcggtacacagatgatgagtttcgtcagtaaatttcagggccaaccaaatatggcatagacatgcatcaatataaactctaaattattattttgcgtcacaactcataagccagtatgactatctgtagccacaaacttccaaattttcatggtgaatttaaaagagggatgagcacgatcgaattttaccatatataacgaggctgcggaatcagatcgcatagcatgattttgagcttgaccaagagattggaatgtgtcaagtgcatcaactgttaattgccagccagaaagtggtgaactacttgagcttgattcagtgttgctacagcaagctgctgccacagttccatttacccatgggcagtaactgttgtgatgcttaacaggatcaaattctggaagtcctgattcaaaatcattttctccatttgttgctcctgagaaacaaataacaagattgagaagaatagaacctggatagaagaaaacagagatctaactaaagagaaaaagatcaatcgatgtagaatctcatccattccattggataaaaaaaaaattgtccagggagcaatcagtataaaagccatccatcctatttgaaacaaggacgcaatgcaaaactaccaatataacgaggatcaatacaactgtgctggaaatgaaatctagtcttcatcaagtatttgaatcttctgtgaaatgtataaaatatttgaatctggattacaaaaccagtcacgttgcaaaatccacagaacagaatatcacaagtcaagaataagtaccaacttcaaagaaagcatagctagcaagcagcaagtatctatgacaaatactgcattgtactagggaaaagaacatagcacgagacccacagaaaatggtgcaaaggacacattgcaaatatacacttagtttatatgtaacaaggaaaaaggttgatcataagtacctaatccattctgagggtcataatctaaccccattggcacatcaccagcgatcaatagtttgccagcctgtgtcacttcctctttagatacatccaa

SEQ ID NO: 56073 - DNA, 756 bp, Oryza sativa
gtggatcccccacctatgcttcggaagtatggatttcacctagtgttagctggaaatagttattacatatccgatcaggtgtactataattatatttactgctgtgatatttaattaatgctttagaagtatattatatctttgttgagtctgaaaattcaatctttgagtgcagaagcaacatgctgttcgggcatacagaaatgctctgtttgtttacaaacaacatccttggagttatatcaatgatcatgtacattttaatgttggaaggtagttgtgtgttttagctcctatccatatatttttcttgtctataaactattattaactctggtgactgtaaactaggtggtatggagtccttgggatatttgatgtagccataaagcacttgctggaggtcattgcttgcagccatcagtccctgacaacgcaaagcatgttcctcaatgattttttccattttgttcaggttcttgaccagctccatttgtgctctcattttggtgaaccaaacttctattgcaatgttcatcttgtgttttgtaccaacagagtatggggaagaaatttgatgtctacaagcttcaacttcctgttatcaacatgccatcactcagagttatatatgaagatcatcgtacttatgcatcagatgcagatgtaagtactttccactgctgtaggactatatctagtttatttaccattcagttttccagagtaatcagacattttattaccattgagttt

SEQ ID NO: 56074 - DNA, 723 bp, Oryza sativa
aggcgtcagcaccggacagccgtacgaggtaggctaccgaggatgatgatgatgatgccattgttgttgaatgtggtactcatcgtctgacaaatctcaatgtgaatcgaaatcgaatatgtgctttctgtactcttcgaagagaaaattgcctaaattttaaagattgggagggagagatttaaatatattacttaatagcctgaacatcatttagcaaagacaaaagagtctctttgatcttcatgtcttagcaaacaagggaaacacccagggtcttccggctaactccacaaggtggtgggctaaacgaactggattcgaagcctcacgcccacaccccttctaattatttgatattaggttcttctctaatattcgcgtgttttatgtcttagcaaaccagagtcagagttcttgatttccgaatggggcgacggcgaggaggagcaaatggttctcacatccgtgtcttgtgattgcaccggcttcccttggataatttatgaatgaaattaccgcttctaaatgacgtttataggctatttagtcccttttctcgatctttgggctttgggcgcaatgcgaggtcatcgggctttgggtgcacggatggcgcctgggccatggatcgtcgtgggaaggtattggtgaagataatccccgacgacaatgacagggacgctggtggcgaggcggaggggtgatatgagagcatggcga

SEQ ID NO: 56075 - DNA, 1726 bp, Oryza sativa
tctctctctgagctgttcatggactgatcgatcatcagctgcaccttctgcaagctagctgcctctctgcatatcgatatactgtagatatataagcagtgttgtgcttgttgcatctgcctggctgatagctggagtgtatctggtctcaggcccaaggcccgaacggattattatcgtggattatcaacatgatagtaatagggaaaagattaatttttgaaaaaaataaacataatgaatagtttaaaacaagctgcttaaacagtgcagcaaaagaacttttttttagaaaacatggtactagtaggattgagcaaataatatgtttcaataatccaattgataagtgaagtgagtgtagctcaacaactgattaggttccttttggtggaactagcctacccggatccaaatcctatatttgacatggtgctcgcatttacgcctaattattcttttagtggtaggtgacgtatatgttgacagcgaggcgcccgtgattattcatcggattagtagtgtggattatctattcgattataaagataaattaaacaatttaatatataaagtaaatataaatagcctaaaataagtggtccaaacaatgcaatagaagatttttttttttacaaaacatattatgttacatacgtggagcagataatctgtggcaatggtttggtgaagtaggttgtaggctatttacgtgcttctgacctacttatattgcatacccatttgttggtctgagttatttcattacaaaaatattacctccttctctaaaaaaaactttcatttaagtaatacaacgaacctgaatactgcatacgaacctagctaaaagaagtactccctccgtgccaaaaaaaaaaaagacaaaccctggtttccgtgtccaacgtttgaccgtccgtcttatttgaaaaaattatgaaaaaaaattaaaaagataagtcacgcataaagtattaatcatgttttatcatctaacaacaatagtaattataaaaaaaatcatataagatggacagtcaaatgttggcacgagaacccacggtttgtctttttctggacggagggagtagatgataaaatagccattgttgggctaacagcaacacatttgtatgtacatagtacgtttgtgctatgcagccacagagaatatgttggatggcaggttgacagtcaatgtctctaatactgtttgcaacaaagcccaacagagcactgacttttcctcacaaacaaacatgataatgtatgaaactgaacatacacatattgcaactacttaattatctatttatgtgcctgcacatatatagcaatacaacatgttgctatacatagcctggtcttttccaaaatccagggatgtactttgggcaaaaacaaaaggcctaaaaaaagcttttttttaagatgggactaaaactttaagtcgcccctatcacatcggatgtttggacactaattataaatattaaacgtaaactattaataaaacccatttataatcttggactaattcgcgagacgaatctattgagtctaattaatccataattagcctatgcgatgctatagtaaacattctctaattatcttaaaaaatttgtctcgcaaattagctttcatttatgtaattagttttataagtaatatattttaatactctaaattattagtgtctaaatatagagactaaagttaa

SEQ ID NO: 56076 - DNA, 765 bp, Oryza sativa
tgtgatccattaaagaaatcaatgatcaacataattttctggatatggggttcttaagataaaattttagatcagagaaaaaagaagtaccagcacttgaagcatccaaactggtggaaagctgacatattagagagatgcaagaaacaacaacaggaatttgtagaggattcctaagctcaatcctcacttttactgcttctgcaattgacaaaaaagcaataattgaaacactatataagagatgcatccatatttccctctattgtccgttgacgtttctattttgataaataaattattttccttaatcctttaaagtgacttggggcagatcgagtttgaactcatatttggctgcaatcacacaaacctccatttggactgttggatgtgatatggatggatcagattcttctgggtcatgagaaggtaggcctaatctttatactcttttaaaaggagaagctggatgatggcactctctacacctaccactcaactcaagatcatttggggctgcataaatgtagacataagtgttctttgcaatatccatttcttaggaaacattacattctttgcacatgtgcatatgtaattgattgtgccttatgaaatagtgtatctaatttttagttttaatcaatattattgcttgttttaactctacatcatatagcatatatatttgtatctctcgaaagtcgaaatgcatggcatggatgcctggaattaaaatttcaaccgacaaagggatacgag

SEQ ID NO: 56077 - DNA, 1922 bp, Oryza sativa
ctcgtctcgtcgccggcgaagctcaccgacgacgcgacgccaccccagccgccgccgcagccgcagcccggcgaccggcggcgccgcccccggctccctgacccgccgcggccgcacgggggtaaggcggttcccctgtcggggctctcgccgcaggtacgcgacgttgcctcttcttgttcgtttccccccgtgctccggcgatcttttcgccgttccagatccgcctccgctcccgtgctttgacctggcgttgcgcggtttaactttttgctatcttgattaagctattttgggtggtcatctgcctgtcccccgattgaacagcagggatcgattccttgttggggttgggcatttcggctttgatgggagacgccaaggaaggagaagaggagcggccgcgctgcgtcggctgtggccggcgtgtgaagacgctctacatgcagtactccccgggcaacatccgtttgatgaaatgcgtaagagagggactagtgttgttgattgggcatgtgtaaatcctttttgtcatgtgcgtgtaatctgtttaagtttggatgccctgttcttgtgcaggatacctgcaaggctgttgctgatccctacatcgagtgcgagttcatggtgcgttaatctagcagtgatgatatcgaatttctcgccatacttgtgtgatccgatgtttgcatcacatatgcagtttatttactgctgaactgatgcattgagttgagcatttaactattctttcttttttttcgtagataatcttgattgatctgattctacacaagacaagagcatatcgtcatcttctatttaataagttgaggatttattcatcacttgacaaggtgggaatcatatggtattcaaactcgttcacatgctacttttagttaaaatgaaaaaggaggtgggctcagctcttttgatgtttacttccgttttcttcaacaatgcttcttcctagttttacctgtactctgtcctgtctgtctgtcatgctgctcaagaattattagcttcatctgtcttagatctgcttgttagttagtatattcttggtgtctatgttctgtattacatgatatctttagccatttatgccttgtcagtccatctgacaatagtttaaaatagccaatcccatggaatacacagttttctattcattcaagttataactgcatagtttggtaacgtttttgtaataactttctgtcaccttatggtagttccattagccgttattccctgatattttgaatttgtttaatggggtatgtcaagactcaagagttacattttcctatgttcctgatttttgttcttttcagggagtactggtgttgtccattctgacgcatcttgttcttgatgcatgtatccattctatttataaatgttcatcttcaattttggttttttttatgtatatattcaacttaagcaccccttaactatgtaagtcagaatatctttttcaagaggcaacatagctgatggggattcttccataaacatattctcagcgattctcaattgcagcaaggtaattaaagttgactgcattgagaagttctatgtttctgctgctcattaccttagtaatgtatccggtgtctattattcttcaggttctgggcgatgcattgttagggaacatcgtatttatgaccatgttattcctggaagtgcaatttatcctaaaactatcttttgatattagaaggtacattgaatacctgtgatgtggaaatttcaattacatttgttggtagttcattacgcgcaaatgaattggtgtattctcaattggaattatgcaaccagtagggattctgtaatagtacacttctgttgtagaagatgaaaccatatcagaatttcacattaaatgtgtcatgggttaacag

SEQ ID NO: 56078 - DNA, 1737 bp, Oryza sativa
aattctggatagataacctaaatacaaacaggttcatcgttctgaagcattaatatatcgatgcacccttctctttctagaaaaaagtactgacagggatgttctttgatgaataggaacctaatacatagctcatactattgatgatcacaatgttcctgtttcttttgcagttgtgacggagttttcaaaggcccattgcttcggagtctgctttggagcgcacgcagcaagatacctgactgagcgatggcttctcggggcgccatgaacccaaccgccgtgcttcctgcatccatcaagctccctgtagctcgtggtgccccccaaattcatcaggattcaggaccacccgccatgcttcttgcgtccatcaagccccgtgtaggtagctgtactccccagtttatgcagcatctaggcatactgtgccgctttgatgagcttgctctgatgaaaccaaatgtgatcatttgcaatgcactcactgactatgatacacactgttcctgtgagttgcaactggagtgtctcttaggccttttgtacgagatgttgagcaatcctctcctagtttccccatctaactggggacagtacattactttatggctggtctattttcttgtacttatatgcccaacgcagtagctgctgctgctcctgttcagcgaagtacgcaatgaaagggcctgttcaccttctgatgattgtaacggtggcttctgaagaggtatgttccctttgttccatttgcaatataatgatacgaatacatacaacatacagaataaggttctgaatattactcttaacaagttaggctgcagcagagtttcagttcaagagtctgaatattactcttaacaagttaggcagcagcagggtctcagttcaagagttttgttcttcagtgctctgaaccttcttgaattgaacatgtccctcttttcctgtgctccttcccttccttttgctgcttcgccaccaccaaatgcttatctgcactaacaccaaacagctccaacaaatatgcaatctgcctcctaatccacagttttgttaatcacctgcactgaggcgagaactattataattcgttcaccctgctcatgatacatacaagatgatgtatcgagtagacggggcacaaagtttgcttaaacaaaattacacttttccccggaatttaaaaaactcacacttttgtacgtaatttgcgctaatctgcttgtgtaaagcatcgcattatcggttgggttgcgatcatcgcggccggcaccactgaaattaacaagtggagtacgtgcgcacttgtttagtgtgaatgtgtggtagctttggtcgtgtttgcttcagtcttctgtggagcctccactttaaacaagctcctctcacaccatcatttttaggattaggacaaataacacactaatttttaggataaggagcacactatctattgcgatgaaaactagaccaagtcaagaattaagacacgagaaatagatttcttgttttttttttttgctgaaatcgttgtacttttagtaatttttttattaatgtgtagttggaacaagaaagttcagaatttgtgtgcttgaggcaagcggccagcaaataagaagaaatagatgaagcatcatcaaggctttcttttagctgtttaatatttgttgaaatgatcactgtagttagtaaaagaagttgcaactaattaatctccgcaacttt

SEQ ID NO: 56079 - DNA, 5716 bp, Oryza sativa
cctggaccctgaactacactttaatatacaaccttaccttctgacaaggctaagtgaaacacccacaaaaagattgggaacagttgttctgtgggttggataaacttaatactatcacccactgtgccattcataggacccgtctattaaaggataggaacaaaggctgaccattcactcactgcgccaagtggggagaatgctattcactcaaggccacagaagctcacatggtcatgagctcgtgagggcaaggaatctcctctcccctggatattagttatcatcagtagtagcagcagcagcagcagtagtagtagacagccgtagtaatcatctttgcacaaggatgtggtcctggttgctggtgcccagccaattgaactgcaggatggttggtgccatgacatgtgcttattgtttgcccctgcaaggctttgaatagtcactggccaacactacctgccatcacaggtcggtttccctcagcgatcttggggtcccctatgcgtagatctgagatgcctccactaacctcgctgggagcttgatttgctgtttatttgtttgctgtctgttcggtcggtcttttgcagttgttactttgcactcagtgcttcgcctctaggctcaagggagggcctgatttagttactccatagtcaactagatagaaaattttaaacatctctctggtaatttatatatgcccctataacatactcagtgcttccgtatagtctggtaatttttgcttggtctttgactagaacatgaatccaacggtttatactagttgcctgcatccaacggtgcttgatttgtggcctacgtggctcaaccaagatccgagaaagattttattctttcactactttagatcagatagagttcctccaaggaaatctttcagagtcactagacaaagtgttgtcatgattcttgattagtccccatagcctgcacttagcggtagtgaacctcttgaaattctttatggccccttgggagcacatgaattagttcaattcctacgaacttcctcttccccccccccccaccccaaaaaaaaaatgcctatatcctgactgtaacagtcagttgttgctacaaatcctccccggtgtgactgtaacagttcgttgctgagttgcatggttgcatgcatgcatcaactcatgagtcagtcattacacgatgggaagcatttaggagtactttcgtggcacccagcaaaacatgacaagcagccgaggacgctgggcctgcctgttcgagctgccactgccgcctgcatcatcccaaggaggaccaccacccgggagaagtggaactggatcgattggcaagaacacgaggccgcgggggccacagccgtgaagcgcagcgagacaaatcccatggggcctctcctgcctctcccctctcttaaatgcccctttggcctcggcctccccggaccccggtggtggatttcgctaaggccttcttcggtcaatccctacgagatcttattcggttaatccctgtgaacaatcccctctaaaccgaacaaaagcgaacaaaaggcctaagtttgaaaaggagagaagagtagtacagtactgtagcaaagatgccggcgagcgacacgctcacccaccctcctctgcgccggcccccagcctacaggggcatatggctccagcacggcgtgtacaacaacgtagtgctcggggcatccactgtgcgtgccggcccgcccctccctgtccctgtggatgtggcctccagctgattgatgcctttgcttgttattattgctgctggtaggagaagtagtgcatcccgttattttcagccacttcactctattattgccgtggattttttttacctctatttttttttctattgcatagcttagccccctttcctaagctactccctccgtcccataataagttacattgggacgaagggaataattgtttactttatttcttaaaatagttaatttatccttacaattaagtagataatttgtatcaataatctagtaaaaaaatcaacaaaattttgagatgtggtctatgagtgatcagtcagtgagaatatgaagaagctagagttaactggctcctgaataccgatatgagtaagaatatggattatttggggataattggagattatagggataacttttgctgtcacaagttccccataacatgggtttagactttagagtagcatggtttggccatttagggtctcttgcctgctactccttcggtattattattgctgttgacttggtgcttctgctgttgccgactttgccatgagccatgatgattgtgctctcatacatggggtggccgggtgggcactcatcagggggaggaggcatccttccatcttgtcacgccaaatggggttaaccccggggaattttttccccttctctcatcactcacctctctgaagccgatccacatcggtgtgtatgtcacatctgccgatggtctcttcgctccctttctccccgtcacactttgcttctccctcactcactcacaacctcttcttcaaatgcctctgttctttttgcgacttctactactgttgcgtaataattgtagtactagtaattcaatggtcgattggccacagtaattcctctttaatttaatggactagacatctgttactatcatcagtgaactgtagtactccctttcagaatataaggattttttttcttgcgctgattctcatcatttcgatttttgcaaagccaattaaatatttggaaaggcaatctaaataattcaacaattgacaattgaaatgaaacattactgtttgctaagggcccctttgaattgcagggtagaaaaaacggaggaataggaaaaacataggattctgacaggaattgaagtgtaaaacagaggattgcaaaacacaggaaaaacacaggaatggtcgtttgattcgagtgcaggaaaaacgcaggaatcggatgagagagatagactcaaaggaaattttccaagaggttggagctcttgctaaatttcctccaaaatctacatgcaatgtgtcattccataggaattttataggatttggaaagcttcaatcctttaaatcaaagggccaaataggaaaatttcctataggatttgaatcctatgaaattcctacataaatcctttgatttaaaggggccctaaacaatgtagaaactcttatattttcgaacggaggggtttacgatttttttgagctccaatccagacagtgtgaggattggattggggcgtgatgaattatcaatcagcttgtggagcacagttgaaggaatggtacaaggagagatggcatggaccactactcctttcatcctttggccattgaaaggtgaagtgttgggagattgagagagatggggtaagctgtaataacaagtgagggaggccaagacaaaacaagccgagacgcgcacataaacaaaatttcctttcgctttgagttggaaacacgtcctttttggactgaaacttgatggatgtgtccctgttcgggacaaactcgtaaggtggacgtgacagcgcgacgtgcccatccagatctgccgagattttactactaccatcactcgtgagggagaaacaaacctttctccctattgcttcagatcatactaagggcccctttgatttgtaggaaaaatgtaggaattttggaggatttcaatcctatggaaaaaaaatcttatgaaggcctttgagacaaaggattgaatcctatccaatcctttaaaattcctatggaatgggtaatcctatgcatattttggaggaaagttagcaagaggtctaacctcttggaacatttcctctgagtctatctctctcatctgattcctgcgtttttcctgtggtccaatcaaacagctattcctgtgtttttcctgtgttttgcaatcctctgttttacaattgtattcctgtcagaatcctgtgtttttcctattcctctgttttttcattcctacgattcaaaggggccctaagattttactactaccatcactacaacaccaacctattgtactactactaatgaattccacttggagccaatagtattcctcccttctcctgcactttaggaggtaataatgagttgctaactaattaatccaaggcctccatggctccaactaactagtaataatcttttgcaagagtctttttttaatatatatatagcggataaaatttggtctttgcttcgtaatactccctcagttccaaaatataaattttttttgacctcaacgcagttttcttgatactactttgaacaataatatctataaaagtaatatattttaaataaaatgagtggcatatgttgatagtttgttgaatgataaatctactagtaacatcaaagttgcatgattgatgttttttatttttatatgatattaatagtcaaagttaaaaatgtttgatttgtcgctattctaaaaatccttacattttgggatggagaaagtacttattatggtctgtttggtacaactctagagatggagctgagtctatccaaatagtttcagcttcgtctaaaatggaagcagagctagggtttacaaaaccgcacggttaccatgcggttatcgcggttaccatgcacggtaacctttttagtttttgaaaccacggtatgtctcgcggttaccacgcggtaaccgcgcggttaccgtgggggtgcagcaaccacgccaaaaagagggttactgtgggggtgcagtaaccgcgccaaaaagggtaaggggaaccctgagtagagctaggtggagcgctctcataatgtgaaccggggtttaggctgctccacaattctattccagactcaactcctagagtaaatttaggagttgaagctctaccaaatagactcttataaagtacttagctccagacaagtataaaagattaaaagtatcttaactagttatcctctgtgtcttgagtgctaaaagagtttatactgcaagtagcgtttagattagcagtctcacgtggtggcctctctgaactctcacaccctagaggttctgctgccaaattgttttacttgcagctttctacaaagggtaactagcagatgttatgcgaccaggaaggacaggtcacatttggcatcttgcgagggatagttttgtgggtctgctttggggacccatctaggtatcccctgttaatgaccagcttagagaatcccttttggtgctgaattagttagctacttgttgtagatgctcctgttggaatatgtgtccagatctttatatgatgcatactccacgactagactaaagataaccagtaaaggcttttgtttggattgatgcccaaaagaaccttttataacaaaattaagaatactacaagcgttcaagtaaacccaatcatgcaaaatacgctagctatcctgctagtgttggtaatgattgtagaatttatccttagctaccagaaacttggtatggaaacaactttaatgtaaaaaaaaaaaatcagccctagcaactttcaaaattctgactttaatttgtcagcaaaattgttcaactttattaaccttttttggtaatggtcaacagatcaaatcaaacaacccataaaatctctcaaaattgggggctgcagga

SEQ ID NO: 56080 - DNA, 3438 bp, Oryza sativa
cagaacagctaagcgagctcctgtagctggataacacctctcgggccagttgccgcgaacgcatctccttttatctggtgaaataattaggtaatcagagtacaaataaatttgatgtgaatcgttttatccccttgcacttaacatcacttaggagcacatatagtagcttttttttttgttgtttctctctttaaaacgtgcattagtaatagcaaaaaaaaaaacgacttgcatgaaaggttaataaaactctgctgttactcgactctgttgggtgtgagtgtgacttttgtgttgaattcctttggtttttaaggcatttacgttcttggtaaacgagttttactttaatatatgttgcaaaagataatattattgtttagaaaataaaaataatcaggagaggcataacatttgaatacattctttttttgtataatcttagattgatatgtaaaacaagctatagcaattactcccttcgtcctataatataacaacatcctggatacatcctaaaacaaactatgaatcctcatagcccctgttcaaatcgatagcagtaggatatgttattttagatgttactgtctctccattttgtattataaaactacgaatctcgatagccctcctgttcagattgatactagtatgatatttcatccgattctagtttactccgtttagtattataagttgtttgacttttttcctaatcaaactaaatttatttaattttgactaaatttatataaaaaatataatattactttcaaaacaaaaccttccattttgtgaagttagtagaagaggatagatccagtaaattgtagtacatacgaatgtcaatcttaattattgtagattaatacactggtaagggtcgatcaggcaaataccaaagctgactcccgaacaaaacaaacatattatcaaactatattcaatggtaaatttaatgaaactaatttcatattttagatgttgagatttttctacaaacttgatcaaacttaacaaagtttgactagaaaaagtcaaacgatttatgatatgaatcggatggagtatattttgggacggagggattacaatcaaggcccccccccccccccacacgcacacacgcgcacacaaaagcatggtgcacgaaatcaattataaaatgagttcgtactcttgcacgtgttgtatgtacgacttcggtacagaatcaccaagtcgttacagtagaccaaattcatttcactatgcacacagctctcctgtgtgttcctgctaatgattcagatccacttaattctgttgcagcagttggctaggcaaaaaaggtagtgggcacctctcgtaccacatttaccaaaaatcacatgcaaatgcgggcaatgtatcaagtactaacattatatgggagatgccgatagttgcagcttcaagaatctctagcttacttaaacaattcagattttcatttaaattttgagaactgtagttattgaatttagaaaatgaattaaatttggttgtgtgtctaaaagtggaggccgaaatgtaaataattttcactatctaaaggagaaaataaactagaaacaaaaaattagaaaacttattttctagattttcatcagctagctacttggctgttttaccagattgttggttatgagtgagggaactccaactcgaataattatatgcttggtttatcaagcttgatttttttttctaaattagaactagcatagattaatcttgttggcacgctttttaaattgttaaatgcgttttttttaagtaagaggttgtagggttgagagtgtcctacctcgttttaggtgtgtctgaaaaagctaagccatcgtagtcaaactccatacaccattcttagaccaggttttaaatactgtattttagaccataaactcaatatataatgatgagctaaaaaagagtttgggcatgtcagtagaggacccaagcacaagctctgtttggcgtgcaagttggcaccagtcctacatactgtagtactccaacgtacacgcccacattgctgccatccactgcggcagtgctgcttctgctggtgggccccacctcgctccgctgtggggcccacttccggtgggggccagaaattattgcgcacaagacccgcaggcccaatggcgagccgccacgtgtacccgcgcctcccctccccggccaatcgggaggcctcgtccctctgggatccacctgtcggtggcacagagacctccccacacacgctcgtctcccactacacgcccccccgcatatattcccgtcgccaccacggcgcaactgcgcgaccggaccgaccgagaccgccttgtctcctccttttctttccctacttttttttctccactcgtgtgtagtgaaaaaaaaatcgcccactttaatcatattccctctgtctcaaaatatgactgacgattaattttagcaaggtctcaaaattaaagtgtagtatttttatcgacaaaatcatttttcatatattcaaatgttaaaaatctaatggtaggagtactaattaaattgacattaacctaattgccggtcaaattctgcaacagtagaatcgcaccttttttaaaaaaaatttagcacggaagaaactaatatgattaattaaattttgcatagtaccggtactgtgttggatagttgtacggaaaaggctatacgtactaactttttcttactaaattcttactaacactgatgtgtcatgctatgagtgcatctagatttttttttaacctccatctacttaaatcaaatggttgagatgattgttataaaagtttagtaagaaaaatttagtacatttagcattgctcagtactagtgttgtgactcgactccaataataaaataataatattactattccatctattcatgtccttgcgaagccaaatagcgctgaggctactgcttgcagcaacaattcttccttttctatttccatatatagaaacaccaacctcctcatttcccccctgaccccaaccccaaacccactctactctactgtgcctcacctcttgccactactatttctagtagtcgtgtatcatcatttcagatatcatatcgccacctctcgtttttttaataatatcagcggcgagcgagcgagatggactccccgtcgcctatggcggcgcaggcggccgacctgtcgctgacgctggcgccgtcgggagggggtggtgggggaggaggaggcggcggcggtggtgggtcgtcgtcggcgtgcatcgacggcaaggacgtgcggctgttcccgtgcttgttctgcaacaagaagttcttgaagtcgcaggcgctgggcgggcaccagaacgcgcacaagaaggagcggagcatcgggtggaatccctacttctacatgcc

SEQ ID NO: 56081 - DNA, 777 bp, Oryza sativa
atcttttgaccaataaaggtggcaacctgcaaaaatacgttgattggattagccaaaatgaagcaccaaatccatctaatacagtactacagcctattgctaccaggtacaagtgcatcattattcccgaacaaatatttgttttccctcttttaactcacacatatagcagcttagaaaattgtcaaaagaaactacgacttccttataagatcaaaccaaacaaaaaggaagcaaactacaaagccaactatgatgcataatctaagcggttcatgaccattgtaatattaggttccaacatgacttggttacataaagtgtaagataatctgacttaacagggatagagaaagaagagttttgctctatgtaaatttcagtctagaataattaaacataccaaagaacatgtgaagtgttgtcaagagctgaaaacagtggaagaactacaagagagaaaggaggcaggtagctacacaccgttttcgaaagttcactgcccatctccatagtacggagacacagaggaattatttcagtttgcagcagaaacccaatgacttcagaatcatcaacctgcatatattgcaaaacaaaaccgaattaacttattgagtatgctcattgacaaaatcaaagtctggtaaaagcaacttgatcattaataaatcatcgaattgtttggctcaaactctgtaaaactgttgatggttttaccatcttattttataaaattaactacagggcttaaacctggtagtatgcccataaaaa

SEQ ID NO: 56082 - DNA, 4013 bp, Oryza sativa
agagttttattgatgatgcgtaatgacattttacttcctttgttgacataatgttgggtgttaattcaagatatgacttagttgtaaagatgagattcatgcaacaaaagaaaagatgaatccttgttttccgctgtaaccccccaagttccttatgtcatctgaaacttgttattttcttttatgccaatagatcagattttctcaccctccctttggcactccagttacgtgagcaagccatttagagagcatggaaaagactagaatgcccttgatctcttctccctgtctgatgattggcttgagggcaaatcgacgaagaacgtagtgttgtcctttgaactccacaagatataccgacttctccacagtatggctcgacagcaaagaacccacaaaccagttttcccaccatgagctagtgctcagtgagtaacgctacttggggacacatccactaatatggagacacatacaaactgagatggggagaaattacgaccaaacaattcgtcaataaggagacatcaatttatcttgggacatgaacagatgcgtcaaataggagacactaatttacagagaatcacctcgtaataaagtaaatgcagccactgaatgcatgtaatcaaattacaatcaatgaaattatagcaagggtagtggcatggccaaggagagaaaatgctgcatcagccatgagctcagggccaagcagatcgacaacaaccacgtgaaaccaaagaagatgagatcgagatactcgagctgtactctacgctcttgaaatggacctgatgcacagcaggagacaagttgaaccatgtgcccaccttaatttgctaaccatacgcctcaagctcctcccctgctccccgctggaatagcaccaactggcgatccacatggagaagggccagcagagtgatgcgggttgaggcagcggtcagcggagaaaagcagaggaggaagaggaagaataataagagagaggaatagaagttgacacttgacaggtaggccaggggtagatcggggattttatcaaaatactgacaagccttccacccctaacagtagctttcgacctgaggtgacggcagtggcacatagaagatgtaaaattccataccatggcacataaaggaacagtcaaatttggtaggcaaataaggaagcccataaactatgaacggcaaataaataattctcaaaaaaaattcacaaaggcaatccgattttttatgaccatcacaattcacaagttttcaactattgttgattagttctgcacaaagaattttataatggtattatttgactacagtgaatggcattcacatcagcaaatgcacaaaccagaaagcataaatgtgttgctagtcacggcatggttaaggcattacatcataactaaaccatgtgaattgtaataagacatacaacttattttcagaagtttatgctctctaattaggtatgggcatttaaaataaaaatgttgtatgatttgttttccaccattaaaagatgccgaagcctgaagaaacttggtaaaccacacataatatcccccagaaacttttcaaactaacatattgtctacaaaagcttagttactgaaaacataccttcagctggagaccaggatgtcaatgtactgaatatgagatgtgcaccacatgactcgcattcaattttgtccatgtcaacgttaacccaacctctccgagcacaagccaaagaactagcagcctgcaatacatgtttttcttaaagtgtggtcaaatgagtatagaatattcctcaaaaataaatactgcagatggaaaccggaatttcttttgaacctaatatatacaataaaaaaaactgcatttccaacaagcacaagagacatgaaccagagtcaaatttcaatatatccaagagcctcaacgttccgcttatacttattataagcaaacagcttattagtgattaaaaaataatttatgggtaaaacttttatatgtgtaatcttagcgctttaaaagcagatgctggaaaataaactaagatgaaaaaaacccaatatgaactctaaaattatgttttaaaattcaaattttcgcttatgcttataagctgaagggctaaagatggggttgcaagcaacaaaattattattataaatgacacgaatgaagaaaagtctatgcatataagttgatttaccatgatcataatttcactataatacacaataacaaaaaaaaaagaaagcaaaaacatcaccctcaaagtatcggccatctgtgtcttcctaccattaacaacagaagtaagttatactaatagctctggtgagggaataaataaccttaggcctagaagcccaagttgtaggcttatatgttgccagtcgacgaagtaagtctccgcgttcccatggcctacatgacggtgcagaatccaaagcagttccagtggcatcgaaactatgagaaggctgatgggcatgcggagcaacatgtgatgaggaatcaactctggaagcttgtctgctacccgaccaatctatgctggcaacattagcttgcatagcaggtgacgagggtcctgcagaactgagaaacataacaaaaacatgagtttaagtgtgcccatgcaaggctcaagagctcccggagttgcagttctctagtcatccaatacccgcccaccatttccagttcataagttttccagctatatatttggaattagaattcaagcaactctgtcatcctactttccatgaatgagacagtgtgttaaatcaactcaccaaaaatcgcataaaaatatctcgtcggatagcaaaaccacgatataataaatcgcctgatctgcagctcgcttccgtcctagggtttaaccaaacatccacactctaccgcacctccttacgctcaccgtacacaagatcaaaattttccaactatacatttggaattggcattcaagcaactcctacttaccatgaatgagacagcgcgctaaatcaactcaccaaatatcgcccggtttccacctagagggatatatatctcgcccgagagcaaaaccgtgatggatgcaggccagtagctcgctcccgccctagggtttaaccaaacatctacactcaccgcctcactacgctcgccgtacacaagaccaaaatcccttcgagcaatcgccgccccagtaacaaatccaacgaacacctcgagaacccaaccacgacacaatcgatccaagcaccgagagcccgattcaccgaccacgcccaccgcgacccctgcgaatctaccgccaaaaatgagcgcccccccgcgatcgtaccttgcaaccggcgtaggaggcggctcggccgccgcccccgacgagctcctcacctcctcccgcatctcccctcccctctcctctcctcacctctccccctcgccgcgccgcgtcgccgcccctctcctcctcgccgcggcgtaattgggagagaaaaaaaaaattccccgaccgcgacgcgcagaggcagagttgggttccccggccgttacagccgttagccctcgccgtcaatcgcaaaccctcacacctcacgccgtcacttagatgggccgggctttaatcgagatcacatgggcccaaacgttgaggaggcccagattccgcggctcgcttcgtcgtctcgtctagctccgtctcctctcgcgaagtctcctcgggccattctctcgccggattcggatcccgcggcggcgagccgactcggcggggggatttgccggcgggatgatggaggaggcgagcacgtcggcgtccggtggtgggggggccgccgcgaacggcgggcagcggggcttcccgccggcgagatcgggaggtgagtccgtacacgtagcttagctctgacgacgggctcgcttcgatctggcgtcgttgaggtcataggctggaagtgttcatgatacttacatatgaattttggcgagcgtcatttagcatgg

SEQ ID NO: 56083 - DNA, 3952 bp, Oryza sativa
tgatgatcggagttacttttgttcctgttgggcttgtttgccttcatgcttcaaatcatgtaaattgtttttcatttctgtccggtggatgttgaactaccatcagttggtggatcatactaatacacactaagttctccatattctgcgtgtgcaggttgcagaaattgctcaccgttatgatattgattgtgtacctaatgcttacaaaagaaataggcaggcgtatattaaagatagctcgatttcaaagaactgcactcaagaagtgaaggtattcctgtgagatctaacatcccttttttccataatgatttttctctccagttttatttgtattataattatctagggtttttttggcgcacagattacatcatgttgctgtttcttcctgtccatatcatgtgtaattgggccagaaattcatagtgtgtatctttgcaggttaaataccttatgagagcaccaatttatgtgtattatgaactcgacaacttctaccagaatcatcgcaggtgatgaactgatgatacaactttattcaatttcctgtcattgtatcgatgtatctggctctctctttctgaaaaagaatctctgtgtattattaacgaacaatggaatttgttgatgctgacaggtatgtcaaaagtagaagtgataagcaactacgctatgggcagaagtacacacatagttcatgtgatcctattgaaaggaatgatggccttccaattgttccatgtggcttgattgcctggagcttgttcaatgacacttatggatttacctgtggatccacggaaataaaggtcaacaggaagaatatttcatggaaaagtgaccgggagcataagtttggcaaggatgtatatccttttaactttcagaatggatccttaattgggggaggaaaacttgaccctgctttaccagtgagtacttgtatatctcaattattgtttataacttaatcatgcacagatttttttttttggtttgtcattagcaaaacacttgtttctctgccagctgaaccagcaggaagatcttatagtgtggatgcgtacggctgctcttccccaatttcgaaagctctatggtgtcattgaagaggatctacaggctgatgaaatcattacgatgcacatagcaaacaattacaatacctacagttttggcggcaagaaaagcctaattcttacaacatcaacctggctaggtggcaagaatgactttcttggatacgcatatcttatcactggctccttgagccttttcttaaccattctctttgctctgattcacgtgaaaaatccaaggtaattattaaggtttactttttaagtttatcctgtatgaatttatggtgttaccatctttctttcggagccaggcaataaatattcctcttgatctttttttttatttttcattaataacttaacttcctctgcacatacgtctggagtgttctgtaatctgtacatgcgcacatcaataaacaaaaatctccaattgattgctgtataattctacgtgtgttgctgtaaactttagtttgtctattaactagacttggtcctcatgttttgaataatgtgcaggccacacggtgatgccaattacctatcatggaataggccaaacagcaatagctaagctgcctacataactgtacgatatgtaaggtaaacatttgacaaatacagtgtagttgtttccctgtaaaaccaagactattcttctttcatatgataacatagagttcagactgaatttcgtggcagtgcaaatagaacaaccaattttgtcattgccttttcttttaagaatgcacacaatttgtgcatttgaaaagaactggtataattggcagtttttagttcatccaaacatttggtatgttgggataataaagtgctgatgaggattgactggcttcttcatgcattttaattggctctctacatgctcatgaagaaaacaaactaacaagaattgtatgtgcgtgtgccatactatttgagtgaccatgtatagtataaatgcgtttgtcataaggtttctgccactactgcccatatcttatttccatcgtccagtctaaccattgtgaagataaaagctgacttggatttcaagagatggacaagttcaatttaacagttgtgcaggtccgagaatttcctcagttcatgagcttcactatgcaagaagaaaggtccatcttatcccaatctctctcatcaacttttctgtttttcttctgggagatgtgtgagctttctcacgtcatacttgcctgaactatggaagttggcgattctaccaaggtgaaggttacattttgcaggtgcataagcatcaatgggcgacaccaatgcctcgactggttcattcattgacgacatgatgtcatacttttgaactgacttgctgctcatatgacgagctgttataatctcctttgttcatatgacctttacgtgtgaacaaatatgctgtgctggtttatagctgatttgacagacaactttgctttagtataagtagaaacctctcatgctcgagcatcattttcaacaaagctatttcattgtcttcccttattcctaatggtctatgacttgtctatatttatagcatcgttttttttttcatcgaagaaaccatcaaattttccgctgctctttttttttaaatttttttccttatctttgcttcttgtttgtactataaaatcaccaggcttgtttcttaaccagctaaaaatgttgtgttttcacctaaaacattttttcattgaaaaaaccatcaaattttctgctgctcattttttattttttttccttatctttgcttcttgttttgtactataaaatcaccagtcttgtttcttaaccagctaaaatgttgtgttttcacctaaaacaaggtagaacatatttataatccattcaaggactataattgtttagaatctgttgcagtctgtcgatgtttcgacatatatacataggataaatttgctgttcgatcatgactattaggctgtgttcattcctcgtggttcccagttaatctgcagtgcacgtaaaatgaagctatccattagcacgtgattaattaagtactagtttttttaaaaaaatgaatcaatatggtttttttaaaaaaaaaaacaactttcgtatagaaaattttcgcaaaaagcacaccattcaccccggacctcccctgtgaaaccaagtgatcttgggattcgacgacaacatgttcggcgatcacattgacaccaaatcgttgatgtgtcacgtcaagctccgagcgcttgtcaccgacgcgccaaatctatccttcctcacgctgaagctgggaggaggagacgagaggatcaaggcgtcgtctccggcatcgccaccatggacaggaatttgatcgtgttctacctcaacttcaccaagaggatcgttggcgtcaacctcatctacgacaccatcgacgagtccctctccatgatcccgatgttatcgagccacaaagcgacgatccataccactcaaatgctcgtcacgcgccgccgtaccaccaccgccattgatgatgatgaaggggactacgctctaacgtatctgggcaaaatggcagtggaagaaaaacccgcggacaagccgggggacatgccggtgatcagctggccagatgttgtctaccaatggcggccattgtcgtcgctcccgtcgtggaagatgatcaagagggccaaaccttcccggcgagtggatggtcgataagtggttctacgttgacacggccttcatgtctgatgatggccacgccttctgggtggatctcatgtggggtatcctgtttgaggacttttacggaagtatatatttgtagtatatgaaagggtagatttggtattgtaaaaatctgaaagggg

SEQ ID NO: 56084 - DNA, 2538 bp, Oryza sativa
tgattcaggcttcatccgcttcaatgaaaatggatacacaagcaataattaaacctatctagctctatctaattagttcaactcgaagtaattaagttaacaagtctaattctctacaaacacttgtgaattggtttacttgtgaacttttatggtggtcaaggtcagacaagagtccttgtctagtagaactattaatttgtgatttgtgcattacttatagtctatcgccgccgccaggcttccctgccctgctgctgccgcaatgccgcatgccgccctgctgcttccacctaccaccgccccgctgcccttgctgctgcgagctatcgcagctgcgcgcctatggcacggtcccccagtggcggctttgactgggcgcctatcgatcagatctgactaagtgaggaaatacgaatttataaaattacccccacgcaaatagatgaaaagacaaatatactctatttaatttatactgcagaataattttgagaaagatcagattaatttacaccgttagatcaaatatactggtagtatatacttgcagtacaatataccgtaaaatttctcatcatgttttgccgctgcgacgacctcctctcctcctccaacgacgtcgaaccggtacacttggactccatagatctaccgccagagccaccaagtgtcatggcttgcgatttcacaagctatctccctcctactcttgccgctgtccctcacgccagttgattgctatataattctaggtgtgttattgtatttgtatatgttatagactttagtttgtctattaatatgcagaccgcgatttagagttaagaaagagggtttcgaggccgacaattttgtctttgccttttcatttttttttaaagaaaatgcacacagtttgtgcgtatgcaaagaactagtataagtagcagtgttgagttcatccaaacatttggtggaagtgctgatgaagattgactggcttcttcgtgcattctaacaagaattgtacatgtgcgagtgccatactattttagtgatcgcgtatgaatgtgtgttcttcattgcgaagatgatagttgacttggatttcaagagaaggacacgaacaatttgacaattgtgcgggtccgagaattcatgaacttcactggtcattactaagcgagaagaaagctccgtatatacttactacctccgtcccaaaatatttgacgccgttgaattttttaaaaatgtttgacagttcgtcttattcaaaaaatttaagtaattgttaattctttttctatcatttgatttattgttaaatatacttttatgtatacatatagttttacacatatcacaaaagtttttgaataaaacgaacggtcaaaaatgtttaaaaaagtcaacggtgtcaaacatttagggaaggagggagtatcctaacctttctcatcaagttattatctgttttctactcgtatttgaaaaagtgtgtgagcttgctcacttcaaactactaatacttgattggattgttgtataattccatgtgtggaagcgtgaagatcacatatcgcaggtgcagagtaagcatcaatcggtgacaccaacgcctcaactggttcattcaatattgtcgacatgatgctatgatgccatacttttgaactgacttgctgctcatatgacgagctcttacgatctcctttaattgttcaaatgaccttcacatgtgaacaataattatgttgtacaccctccgtactatgaaaaacaaatttctatctataaatctatatttatattcagattcataattagaatttttttagacgagagagtactgatttatagctgatttgacagacaaccttgctttagtcatgataagtagaaacctcttatgctcgagcatcccttacaattgttggagtatttagttgtcttctcttatttctaatggtatgtgacacatttttcattaaaaaaaactatcaaatcatccgccgttaaatatgtgatccgaattttaggcccacaatatattcggattagtttcctatcaggacttcgagtctttgtctattaggactcctagatttctcctatatatatatcccttgtaagccgcatgcatgaggagggtgggacagcccaatatatctcttgcgtttgtatccaactcctcaatagtgatcattgccaatcagcgtccgtggttttttccgcaagggtttttcacgtaaaattcgtctccattgtgtatctattttcatattatctgctgctttttattattattattttccccttttctgtgcttcttgttttgtataaaatcgctatatttgtttcttcaccaactaatatgtttgtgttttcacctcggacaaggtagtagtacaatttatttatactatccagccaaggagtctaattacctgatacaaaacggagttttgtttagagcctgttgcaacctctcgatgtttaggcatctacagtatgcacataggccaaacttgccactgtaacttcatcttactg

SEQ ID NO: 56085 - DNA, 1118 bp, Oryza sativa
tgaaaagctgtgattggttgtgaagagaatgtagatggaaaatttgttatattttatgataaattttacttcatccgtttcacaatgtaagactttatagcattgcccacattcatctagatgttaatgaatctagacatgcatatttgtttagattcattaacatatatatatatatatatatatatatatatatatatatatatatatatatatatatatatatatatatatatacacacacacacacacacacatatatatatacaaatttgaacttgttttttttagattttgattctaggtatatagcatccatacatataattagttaggtatgcaatcatggattgtgaaataaagttaattttgagttgttttgttgataggtataggtatgaatcgaattattataactaggtatatactcacaatttaaaaattatgaaaaatttaagtgattttatgcattagatatcatggtgccccatatgagtgtcatatatatatatgtgtgtgtgagcaatttaaaaaatcttatattatgaaacagatataataaaaaataaaagttattatattttaggacgtatgaagtaccatctataagcaaccagggttgtgttggttagccgcgaagtagtaggctcatagaaattgctcgaaaaagaaaagtccactctatcgtaaaaaaaggtcttaaaaaaaaggaaaaggtgcgcaataactgcaggcggcaggctctgtctaactgaattctgaaacgacatgtgcggtgtgcccttttcccagagattgtcagccgcgccgtcgtcaatgatggtgtcaattactagtcctactccgtctttttttttctttcttcattcagctcaagccacgccgttagttaaaaagcaccgaaaaggagaggttcgctactgatcgagcagctatttgacgtagcaggaacatgaaatgtcagggtcctagtggctcatggctttttttaattttttattttcaaataaattcttccaaaactcacatttaaggctgcgttcgtttgtgtgagataaggtgagaaaacacctcgttttccacatgcacgcttcccaaactactaaacggtgtgtttt

SEQ ID NO: 56086 - DNA, 3026 bp, Oryza sativa
tgcctatatacgccaaactatcaatacccaataaacgggggcaaattatttgtggacatctatacccctacaattttctcgcgacgctggcttggcccacaaattaacattgttgatttggaatttaataaatattttctggtagatttgaactgaattcgacttgataggctctaaaagggagggaggaaaagaaacaggagagtggggaatgcactcgaagagaaagagaaacatgcaaaggcttcaaaacatcttcgcaaaaacaaatcatttattttggactttgatgcgaggtttgtttgtatttctatctatagtgagctggtacgtttcaatttctaccagtcgtgagcttgcacgtttcgatttctatcggtagtgagcttgcatacgtttcgatatatatctctcctggctttagtcggcgagattcattctaacctggttaagctacagtgaagataaatcttgctagtcgttagatttcagtagcagtcaatctgtgcctatgtatgtcaaactatcgacgaccaagaaacaggagcaaaatacttatagacatctataccctacaattttctcgcaacacaagcttgctagagatcaagagataaccgactttaaaaccagtagaccaatgttactttagcaaatgcataatctttgtctaggtagttaagactaccattgatctccacatcatgactatatatggattattaatgtagtagcatggttgcccaacttgtgtcaaagtaaatgtgccccccccccacaacacacacacacacctcaaaaaaaagtgtgtgctccacattggagtaacaagcaactacaacaatacatgcaggaatatgagcatccactgtttgcccccctggtcccttccatgcagtaacagttgtcgcatcctcgatgcgccatggagagtggcaggattggcaacccaagccaccaccacctcccgttactcgccgctaacaccgtatcctcgcagcggcaccctccccaagcatgatggcgtcaaggaagaaggagacatcaacaacatgatggtgtctgaactcctaacgacatggttgcaactggcttgggcaatactacctctgtccccataatataagaaattttgcccatatagttagactgaggtggtacttcaagcacttaatcggagcctagtatcaacatagtttgaggctaggtgggtagcggctagtgggttgggccatgttgcggacccaaaaaggaggaggtgagttggggtttggcccaaaattgacattgttgatttggaatttaataaacaattttttgatagatttgaactgaattcgacttgtcgagttataaaagggagggaggaaaagagtaagagaataggggatgcactcagagggaaagagaaacatgcaacggctttaaagcattttcacaaaaaaaagataacttgtttgtttgtatttctatctgtagtgagctggcacgtttcgatttctatcggcagcgagcttgcatacgtttcgatgtacatctctcctggctttagctggtgagatttgttccagcctggttaagctatagaaaagataaccctggctagccgttagattttagtagccattaattcctgcttatatatgccaaactatcgacggccaagaaacgggggcaaaaaatttgtgaacatccataccactataattttcttgcaacactggcttggcccaaaattaacattgatgatttggaatttaataaattttttggtagatttgaactaaattcgacttaacagactataaaagggagggaggaaaagaagcaagagagtgggggatgcactcggatagaaagaggaacatgcaaacgctttaaaatatattcgcaaaaaaaatcacttatttaggacgtgatgcaaggtttgtttgtatttctatatgcagtgagctggtacgtttcaatttctatcggtagtgagcttgcacatttcgatttctatcgacagtgagcttgtgtacgtttcgatatatatctctcatggctttagacggcgagattcgttccagcctggttaagctacaacaatgataaaccttgctagtcgttagatttcagtagcagttaattcgtgcctatgttcgccaaactatcgaaatgggagcaaaatacttacggacatctatacccctacaattttctcgcaacgcaggcttgctagagatcaaaaaattaaaaccagtagatcaatcttactttaccaaatgcataatctttgtctaggaatttaagctaggctacaattgatctccacatcataactaatggattgtgaatgtagtagcatggttgcccaacttgtgtcaaagtaaatatgtctccaaaaaaagtgtgcgctccacgttagaggaacaagcaagcactgtaatacgtgcaggaattgagcatccactgcttgcctccccccttgggtccctcccatgcagtaacagctgtcgcatcctcggagaaggggcaggatcggcaacccaacctaagtacccaacccaacccccttctcctcccgttatcccgcccgctaacgccgtagcctggcggcggcgcctccccaaggccgtccactgacaggtgacagctacaccagtgatgaggcagtgagctgccgctgccgctgccgccgccgcaggcagatctgacacacgccgcgccactccaaagcctacttccgctgctgctgcacggcacagctgcagccagcaggcagcagcagcagcagcaagcgccggcccgcgcgcgtgacgagagagagcgcgcgcgcgtgcgaggcgaggccaaaaatcacccacaaaagcaagcgaaaaacaccgcggaaaaaaagggagcctctctcgcggaacaaggcattgcccgccccggtcaccgcatttcgggatggaggcggcggtgggggacggggaaggcggtggcggcggcggcgggcgggggaagcgtgggcggggaggaggaggaggggagatggtgga

SEQ ID NO: 56087 - DNA, 7869 bp, Oryza sativa
tcgtatgacaatatatgcagcaagccttgaatgaagcaagttactgttcaaatcacaagagttccttctaagaaaattatggaaaataagtgagatctttatacagtaagaaaaggtgtttcatttattatttgcattgcaatgcgtactcattactagaacttaccagttctagtagattattaaagcatgatgaacagtacttagccaagtagtaattggtttaattaggaagttagaaattgaagaaatgctctatatgtctaaaggaacagtgctttatgatatttttttttctgaagtgaaatgttgaaatgacactttggtacaaccacataaaagccaaattaaagaagtgaaaaactttatggtcatatatagcatataacatctcaaggtgggttgtggatcaaacaataaattttagtaaagtgagacccactttaggccctgtttagtttcaaagtttttttccaaacttccaactttccatcacatcaaacctttcatacacacacaacttttctatcacatcgtaccaatttcaaccaaacctccaaacttcagtgtgaactaaacacagccttagtttttaagaaggatgccataataaaagatttttcctagtactaacagaggtatgcctgctctgaatatgataatggaaacctggagtataaaagacattagatatttgaaagtgttgacagtaccataaagcatttctacctgtgcatgattagttagtagtacttgttctcctatctgaagaaaagatagagttagtacagctctgaatgatcaactttatgaaccttggtagtattagatagtcttctattgatatgttataattgtttggtgatcttatttattccatcatcacaattcacacttgttctatacaaattttctcaactaaagcttgatatatatgaaccaaagttcagctcaattttgctttggcattagagcctgtcaaaccagtgttagaaatgaaaatcaattaaaaaaaatcctgaaaagggtaggacttatgtatctcttgtgcttttcctttaattgggctttgcaagcttccaaagtgagctaggcaccttgcatcttatggatagaacgttgttttccttcaaatgttgcaaacttccaacttcgcactatctagtgcaggtccatttggaaaaatgttggctgatgggtagtgttcctggtgggggacctaaccaggtagtgtacacgattacatgtgcaaacctgaccattgttaagtattaaaacatcatactcaaatcttaaccagtactagtagtattgtttagaaaatcctagacagctgacctcctaatttgctagccaattaattaggagcatgttttgattcagtgtatgcatggacaccttcttgctgggcatctagattaaggtaatactctatttagtagaagtactagtagtacatttttctggcgtgactgctatgctcatcaacagggagtaaattgaagtagtctgagagacaaacagtcagggaggtagtacagtttcaggtcttgatggatgttccgttcctaactgtatgctggcatggttctcactgcaaccaacttccaaacatgaagaacgttttcaaaaattgaaaatgagttcatttttcttcagacacgagttgttcttttccccccgttcgttgtgtgcagtaaaagctgccggcaagtcactctacatcatctgttcaatattcttttttttagataattctgttaaatattctcatcttattatactagtatcccccaatggcatcctaatttctgttcacataatgcctgaggtgtcctcatatcactacacaagttgacatctacaagaaacatcttacaatacaattttcttaccagtagcatttgcagtacaaactacagtaattaattactacagaattttgcatctcatcaccatgtctgtcaacctgcaggaactgaagatatcatcatcagattaattgttgtcacctttccagcaagagctcaccgtggggagctgctacaagtttattgcgatgactgcccgtgttcttttagctgggtcatcgttctgctatgctgttttttggccatcatgaacaccctgccgctgctgctacctgccattgccatcactcagacaatcttgtgaatttccttctttttcctagatgaagctgctgtacaaatttttgtgggagacgtgagtttcgaacaagaataagcgtgtcccgtagccagcgttaaacctttcccttccagaaatatttttcgagtgaattgaaattcatatgtgcctctggttattggagtggcattattgtgttctctctgtctcgcggtttgcgctataaagttgagataaatctgatcatctcgtggttcgtcccgtttatttcctcaggattgaatttaaattccatacatacatggctacatactacatttgtcaaaagaaaatccaacctaggtaaggatgtagtccaagtttgattatttttttttaagacggagagagcagtccctctctttaaaatatactttgcgagggagtagacattttgcgtgatgcctggtctccaatattgttagaggtgtgttaggacatagtaaaatgtactttctccgtcccgcaaaaagacctaatctaggagatgaatcttgacatacactatattcatatttcatctttagaattagattcttttatgagtatggtgactgattagcttatggataggttctttgtagtggaactaggattcatcattcatgtactagacaggggtgtttgcatttacaagtaatatgtattttttcatactccctctgtccctaaaaaatctccctaaaaaatcaatctagtaccggatatgacacatcatagtactacgaatctgaacatatatatgtctagattcatcgtattataatatatctcatccggtgctagattcgtttttttatgaaacagagggagtatgtgtttataaggatagtcggtaagtggcagaagatgagtgtgcgcacatcacgctgtgactctaagtttgtaccgtgttttttcccaaagctttttcccttttagccttgcaccgtgtggacatggggccaaatctaagtgatggcctgctaggcagcaacaatatagcatgggcctcacggcccatataggcgtttggagtgtgtgtcctcttgcacgtgacaccttgagaaacacggagagaaaattcccgaattagtggctaaacaactaaacaagtactcgtactaacttaaatttctataatgcataagagtactcagcaatccgcataaccaaagccaactttttttagtttcaaaggacaaactttatttagtgacaatctcagagaatcggaggcaactctctgctgccaccaaccatcccacacacaagcactcaacggtaacaacaaactcacacacacttggccactgaaacaacggacgaatcgttcacgtagcgaacgcaaccgccaatcgatccctgcaacttcgcatccaccgatctactcgacgccgtacttcttcttgaggacgccgacgaagtcgtagaccttctccggcgaggggaggtgcttgacgacggagtcgatccggccgcaccgccgcgcccacgccgccagcctcggcgccacctcctccacgctgaacccgccgcacctctcgtagctgtagaaccacgccgtgaacggcacgagcgcgacgtcgacgaacccgagcctgccgccgccgccgccgccgaagaactcccggtcgccgagctccgcctccagcgtgcggaggatctccgccatctcgcgccccgccgccgcctgcggctcacccttgagcctccacagcctggacccgcagtcgtagagcttcctgtcgacgtagtccgcccagaacctcgccgtggcgcgcgcgtacgcggcgtcggcgtcgccggagttcgccggagggaggaggtggggggtgccggggaacgcgtcgtcgaggtactggaggatgacgagggactcggagacggggcggccggcgtggaggaggacggggatcttcctgtggacggggttggagcggaggaggaggtcgctcttgttgccgaggtcctcctcgcggtactcgaactccagccccttctccgccatggcgatccggcaccgctgcccgaacgggctcacccagaaatcgagcagcaccagctccttctcctccgccatggctatagcttttcaactagagaccgagttgtgtgttgttctttggtagtggagggcgatcagtgggttggtcgcttttataggtagcaatggatggattcctcagcattcgactgcatcgcgcctttatcacttgggactcatttaggacatgatacagtgacagcgaaggatctcaatccgtttatgatgtgtttagttcacgttaaaattaaaaatttggttgaaattgaaacgatgtgatgaaaaagtcgcaagtttgtgtgtaggaaagttttgatgtgatgaaaaatttgaaagtttgaagaaaaaatttggaactaaactcgacctccttatgttgtgtttagttcacgctaaaattagaagtttggttaaaattagaatgatgtgacggaaaagtttaaagtttatgaggctgtttggatccatcccatagaatgccgcacctcatgttagtcagctacaactgcttatcctttgtttgttttgcttctatagtttagcctgccaaagaaagttaggtagcttcttgctgctttgccacatatttttgagccaaagctatgttaagaatttcgttcgccacacttttggtatgtgctaacttgaggtgtggtaagttgaaatacccaaccaaatataccttatgtgtgtagaaaagttttaatgtaataaaaaagttagaagtttaaagaaaaaatttggatctaaacacggtgttagaagttgagcgtgagttcgggaatggtcgggtggtgacagcctgacaggtgctcggtaggtttgatggtgtgtgttgttgccgtatgtgatgagctcacaaatggtgcgagggtagggagcaaaacaactgaaacactaacccatgcccagtgcagcagctcaccggccggcgaattcgtgtgtcactgcttgcgtcagtgaagacgggcgccgtcatgtttattagtatactcaagtttatttttccttcgtgtcaaaagacaggggcgttcaaattataatcaaaataaaccttatcaaaatttatcaatagtactaaattagcaatattataaaaaatgataggatttcttatatatttactaaagttcggtaacaaactaaatataggtatatctttttggtatatctttttgcaattttaccaaaaatagtgtggttgaaaatggcatcaatcaaacaacccatttaatacatatatattattagatcaagatataattatttttctctttatctactcatagtatatttatatcaattattttacaaaactctaatacgaaatgattactgaaaagataaatttattttttgtactagaaaaatgcccgtgcgttgcaacgggtgaaggttattttaatcttattattattatacgttttactttaggtgaaatttactgtgagaaatcgtttgaatatatattttatccaacttcctttcatgttgatttggtgtttttcatcatcttaatttgaaaatttagagttctaatttgggaacttttgaaacgggggtttcatatttggcttgtgggtttgattgcttgcggttgtcggccttgcgtgttttacacaggatgcggaagacgcgcgttcgatgccaggtgatggaatcggacagcgtgagcgtgtgcgacgatggacgaaaaattctacagaaaccaaatttaaattcagtttaatttatttattgctacatccgtactaatcaaaacataaaaagttttatagttggacacaagtattaataataaaatttgtgaaattaaatgggaataaattctaaaggctaaaattattaaattttgagacggagaaaataccaaatagcatactctatagccaatcacaattagaagattagggcacccacaatggttatctataggctctctacaagagatctatgtcagcatatttttctacttggaatgtattaaatgaagagagagagcaaagctatctactaacttagagatagtctatagagaaaaacgaggcaatgcatgagagagctatagataccaatgtagacatactattaaggtggtttactattaatcgagtctattgctgagatgtacatgttttatagatagcaccttactttaccattgcgggtgctcttatgggctgatacgttacttgggctgaggcctaggtaggcattgaggacgtcagccccttcgctgtccgtctcacctgcaataccggtctaatccctttttttcttctcgctaataaacgaaacggctaaacagaataaacgaagccgcaaaacagaaacagaatcggattagaaagacgtacgaaaatttgtggcaaaaacatcttcaatttttataataggtaaagataaacgataaataggtaaagataaacgatagtggcaagaacaaacttgttataaaatgcagggagacagtaagtcgaatgcactaaaacaaagtgtactaactctcaacatcgtgcgggcctgcgactgcgagggaggtggacgggacggcgggtggtgggggcgtcgtggatgcgatgctaataacaaccggcgcacggcggcacgcggattggggatttcgcggggcggaagtgtgcgacatacgtacgggatgacgccgcggcggcggcggccgcccgcgctgccgctcctgtacgccgaagaagcaagaaagatcgcgatgtaattaagccaattaattgtgcaatttttgtatggagtatgttgctccgtataccatacaatttttttttgcctgtttctcggatctagatatactggattttgcaggaatcgacgtgcatcacatggatacgtctcgaactaccttcacaacgcaacagtaggtcagtagttggtggtgatcagtttcacacgtgaccgttttcgtgcgattccgtggcagtgactggctggcgtaaaaaaaaaataatgcactccataggctacgctaacccaatcacctccttctcttgttcttatctttaatgatatcgccctcagtgttttcgtgtatgttagtacatgtaggctggtacaaaatcacacggtaacttaacaacaaaagaaaacacttacgaattacgatactaccagaatgcgctatcgcgcgctatcagtgctatagactgaaataggctaaggccccgatcgagagtgagagacgggaaataattcctccggtacggaaaacgaagccgaccattagtacatgattaattaagtattaaatatttttttttgcaaaaatagatcaatatgaattttttaagcaacttttatatataaactttttttaaaaaaacacacacaccgtttaacagtttaggaagcgtgcgcgcgaaaaacgaggtggcgggagcggttgcccgcgggaacgagtgcaccctaagaaagaaaactggatatgaatgacatagtgacgaagccacctcccaaacatatcggacgatcgaccaggctccaccgatgtaatagatattaaaattagtcgatcataaaaaaacgcttttagtcattcgggcttgacgggcggcggtgactccaccactggaatgacatgacggtgcatgttagaaatatttctttctctttgtaaatcattatta

SEQ ID NO: 56088 - DNA, 4893 bp, Oryza sativa
  unsure (1)..(4893): unsure at all n locations
tgcggggatccttggggaaaagattgaatcactcttgttatatcgcttgatttactatataaaaatgtcccctctttttcgccccttttttttttgagaattatagcccagacatataactttaaaattcaataaaactaataaagaaggaaacattcagatacaaaagataagtcaataaaataaaaaagttagattttggttcatcacatagtatcgtaattttagatggctgatttattttttttaaaaaaatatttaggcggttgacaaatttcatggttttttctccccaagcccaccttagtactcctatgggcctcttcttattcctcgttaaaccgaaggccttggaccaaatacacagcccattaacacaagattaatgacccacaggaaggctagtcaacggtcaacgcttgaccgcccccaacgcgccaagacctgactcgagcccaactaggaaacggaaaaaaaaaagaaaaaaaaagaagaagaaaaggcccacgcgtgtagcgccacctgcaataatagcaagcggcttcgtctcctctcctcctccggcgacgcgatcgagaagcggcgccggattttgccgccggcgacgcgcggctgagggggcggcgggaagggggtgggggtggggaggagggattccgcaaccccgcgcccatggcaggttcgtcgcttgcttctgcgactcttcgcgctgtttctcccctctggaaccggttgggtgggtggttaggctgactcgatccgggggagaagggaaggaaggagggagggatcgatcgattcatgaggggttacgtctgctcggttcgtttctggagggggattttggttcctcgagttcctgatttatgttggggattttgtgactgtggttagggtaggaggctaggagctaatcagctaaacgatcatgaaacgtagaattgtcctttagggactaatcaattgtgaaccgtagaattggctattggatgtgtttgtgagcaatatgcgttcaatttctaaattattccaagatttcatgcagatgtgagcatatgctgaggtagtgccaacgaaactgcttcctttctcacaatgactacatgctagatcacctcagtaattttggggatcctaatgacagcatttgcatgattggttgggcactcaattgggtgcaggggagggtataaggtaatgaataggtatttgtaggacggggaacaaatccaattgggcccatgatccaggtgttaactgattccagtcggatttatttatgaactaattttttaaaaatggagtaatttgtgagaaacctaactatcgtggctcagttgtaaggaatgcaaatgcagtgttatcagaaattcggacggtgcggaatgaaggcttattatgtttatgctcatacggaaatatgcagtctatgtttaaatttgttcagttgacctataatcggatttgttgatcttaatcattcagagctcacaaattctgcatttgtgatattcttgtgtgtactagttatggacttagtaattgcaatgtacgcttccatgattacgaattatatcctactagaagtatttgttgcaaagtttttatcgggattgaattatttcctgcctgcctgctggtcccaattgcttacaatcaacattgtaatagcatccgtgactccaggttcttgcagtagatttatctttgcaagataactttatgagtttctcccctagtcttgcaagttatccactatcatttctctgttaatgcttccgagacgttgttttgtctgagtgcacacttcttgtagggaaacttatggtatattttacgtcaagttgaaatatcagtgttttagtatagataagtgtccatctgttttgccttttgagatttacaagaagagtaattgttctcctggtaggccttgggccaattccttaattcactagggaatgtgtttgcaggaagtaatccaccacccaaaccatgggaacgtgctggaacttcatctggtccagcgcctttcaagcccccatccgggggtagcactagtgatatcgtcgaagcttctggcacagcaaaacctggggaagttgtttctgccgcagagagcaatgttgcttccaatgtgaacagcaccatctctaggcctgtgcccccacggccttggcagcagcaaggatacggaaattcttatggaggtaatcattaattctgtaatcgcataatcagatacacttagtggctcagaatcttaacctctcgatcaaaatgcaggttatggctccagtatgtatagttcgcttggtgggtttggtggaccttatagtagcggcggactttacggaaataacatgtattcaagttatggaggaggttatgggggtatgtatggaagttctggaatgtacggtgggtccatgtataatagcgggatgggaggtccctatggtggctatggtatgggcatgggtgcttacaaccaaggtccaaattcatttgggccccagcaccaccccctggtttttggatgtccttcctgcgagtggtaatacacattttctaccaagtcactcctggatttgataccgattattgtttttaattgatctttaacaaactagagcatgattgccacgtttaaatttctgtggaacttaatttgcagccataacatgtatttgctatcaccatgttattgttacatatgaagttcatgatttttttttatttctattgtaggaagcctagtagatggaattcaaagtccatgtagcaattcttgtctaacttgtagttaatttattgcctcatatacattactaactctgttctcaaaaaaatgtcattttagaatgccgtagccatttcaaaaacattggcaacactttatatcattatatttttattaatgttgacgagcatataaaaaaaacagtggtcaaatgtgttgatcttgttgacattccaaatggcaagtaaaaaaagatcggttgtagtaaaaagtgaactttaccctgtgattggtatgctgggagtggagaacacagtttcctaaccttttctcattgattgcagatgcatggtgttgtgaatttttgtgggcgagttgctttcctttttagccagaacacacaggcattccacatgtttatctcagctcttttgcaggtatcttctgaatttgatttgaatttgatccaagtttatacttataaccttcctgatccaccgttgtcttcatcgtagctatgtgatcggactggaatgctttatggtgaacttgcgaggttcgttctacgcttgcttgggatcaaaacaaaagcaaagaagggtggggttcagggcgcagaaacttcttcgtttgaaggtccagggcatcattttgctgaggcaccaaaagctaacaactcctgggacagtgtctggactgatgatggtagtgggaagtaaggcaatgtttgtgcagagtgagtgttttgtgagagaatcatgatgagtttgtttatgggggagaaataatctgttgacatctgttcatatgctatttgcatttgaatgagagagaaaaaaaagaagtaatcactaatgctttttgtatgtaatgctcttccctagtaacatctgtagctctgtaaaaacaagctgttaaagcacctccctggaaatgccagagtgctagtaatatagcaatatctgtgtagtaaatatcaccgtcttaaaaaaggtagacagaaatataatgtattcctttaaactgaaaagtaaagagactttctttttttttaactgaaagttctaacacgggctttgcaatggtggtaccaagttgggttaactaattgttttgcaacaggcgaaccgatcaagagttcgctgcatgcacccccttgcaattgtttcagttcttgtagaaggtactcttggcaattgtaaagcctgtgtggtgcctggtatgaagtgagctaaagttgggaggcttggtcaaaaccttactgaataaacacattttccggtgacttcatctatcagatttacctgtctctccttattgagcgtggttcgtcccaggtgcatttcttttgcgttgtgtttgccctttgaaaaatggtgcaaagcctaaatatctcagagctcttgtgtattttgcccgtgtcgatttatatatggcatggtctgtaantgataatcttgtataactgtctgaatccccatctctgttggacgatgatctgtctggtctttaaaagtcatcatatctgcagtacagcctatgctatgccaacaaaattaccaaaattgccatcttatccccacctaataacagaaacccccctgctggcctactgttctcttctggcttctactcacccctatcctgctaaacaaggggagaacaatttatatatacatttttcttccctgactagggaaggagataatccactccaattcagctggagaaaaaaaatgacttctttgtgtgttcatctcctgaaaattaaataaagaaaaggagaaagaaatgttggatggcaggaggaggggagtggtgatgtcaagtggatgaggaagtagtgtaggaggagccatccttcatctcaacctccaaaagctcatccataacctcctcccttccctttctctcgcttctcccctaacaaatctccacgtctccccccctatctttgtcttcatgtgcagaaactcaaagatctctctccctcacctatattacctgcaccaacaccactgaccactccctcctcctgttcttgctccttcctcccagtgtctctcaaggtaagataagctacatgcatatcagtgtacagaatttgcttttctatcggtttgatttgagtcatcttttctttcgtgatt

SEQ ID NO: 56089 - DNA, 3023 bp, Oryza sativa
cttacatttagcccaaactcaaaaccaaaagtaatttcatccatcaacattagcatattatattgttttaaaaaaaagcatattactactacaaaaactgaaaataaactgaagttgttagcatgtaacaagcaagcacatgatctacattgatctttgcatagaattgggctaactaaaataccatatgtattcaggagagtatgcaacagccagggcagcttcagcagcaggaactataatggtatgctatctacatgttgtcatgttcaatagcaaacaacatttccttggatgcataacgaaaccaaaccaaaacagaaattcaaacttgcatgaacgccaatgttaatttggtatcgccttcatgtttcagacactgtcatcttgggctacttcaagtgttgaggaggtcgcctcaactggaccaggaatccgtttcttccagctatacgtaaaccatatcatatcactctgctcatgtagcatactttggctacattttattttcgtatctcattttcttgtatgatcttgcatacatctacaggtgtacaaggacaggaatgtggttgagcagcttgtcagaagagccgagagagctgggttcaaggcgatcgcactgaccgtggacactccgcgactgggacgcagggaagctgacatcaagaacaggtgagttcttaactagccacctgaatttggcacgatctagaaatgaatttcagcgagttgtcgtaaatgttaagtgatgtgatcaatggctgcgttgttgcaggttcgttctgccaccatacttgacactgaagaatttcgaaggcctggacctcgcagagatggacaaggtcggttaattcagccaaaaaaaaaaacagttattttctctgaagaaaaaatggtctgttctatgcagcaatttgaaccatttcgttggcatttgcagagcaacgattccgggctggcctcctacgtcgccgggcagatcgatcgcacgctcagctggaaggtaatgatcaatgctcatcgatgctacaacaaacttaccagcaaattaacttatcgaaattactgttcttgatgctaagatcgggagaaattctgacggtgtgtgttgttgatgatgatgcaggatgtgaagtggctgcagagcatcacgtcgctgccgatcctcgtcaagggcgtcatcaccgcggaggatggtaggatagcttcctgtttcttgcatttcttctgatttgactgatttgaaatccacaaaatcacaaaggaaactgatgcgtttatgcgcgcgtgcgcagcgaggctggccgtgcactccggcgcggcggggatcatcgtgtcgaaccacggcgcgcggcagctggactacgtcccggcgaccatcagcgccctggaggaggtggtcacggcggcggcggggcgcatcccggtgtacctcgacggcggcgtccgccgcggcaccgacgtcttcaaggcgctcgccctcggcgccgccggcgtcttcgtaagtccttcgatcgatagccgatgatctatggcgtgatacatgtcatcgtcgtcgtcgtcgtcttgatggattgaattgcgtttgcagatcgggaggccggtggtgttcgcgctggcggcggagggggaggccggggtgaggaacgtgctgcggatgatgcgggaggagttcgagctcaccatggcgctcagcggatgcacctcgctcgccgacatcacccgcgcccacatctacaccgacgccgaccgcctcgcccgccccttccccaggttgtgaggacctcgccgccgccgccgccggcgaactctagccaaacaataaacaatatcgacgacgccagagagcacgccgattaattaattaggtaatttttgcaaaagaatctcgtcgatccacacgcgcgcaagcaacacacgtactccgtgcacccctcgtaactgggtcgttcatgctcttaatcccaacgattaattatactggtataatctttgtaatttcgagtactgtacacctatttggcatctgtatatctcgccttaagatatttacggaaccggtttatatactcctttaatttttaattaacggagttcaacatatatataagttacttcatgaaagatatggatgtgaacaggaacgaaatagtgctactctctcactttactatgctttggatcgagtttaaactgatatagttgtctaagtttgcattgagaggacatatagtgaaaatagatgaactttaagtttatggatttcatttaatgttttaacgggtcggccaaaagttagccgaccaatttcattaagatttggggggaaaatacagtaaaatgttacaacgacttacaataccgtggttgccagggaaagaccccagccaaccaagaacgagaaaagaaagtagggctaaaccccgcagacagtcatggcgattactcgcgaaacagccaccctccagacagcaatttcctcttcaatatcctccgcaagttattccggtgtcttgggcacatgttgaaaaattcttgcattacgatccttccaaatcaaccaacaaattagcatgaatgcactgtcaaaatccgtcctgtagctcgtccggaaacagcatcttgttaaattttcagggtggtagatgcctaggctaatctaatctagcaaggcgatttagccgataccggcagaaaccctaaagcgagagacagccgatagagctaaattgatatgctaagactagattaacagagacatgataaataggtagcaaatatatcatccaaaccagagcaatccaagaggtcgaatgtactgatgcagccttgaacgacgccgacgtaaacgatacaattgcccgggccggcggaacattggacttaccctttagccagagatcgaacaccgatgcagccccgcgtcaagtgtcaagtcccgccggacgataaaataaagtagaaaaggtaaaaggtggcgatgcgccgaattgtattgatcgtgaagatagattacatag

SEQ ID NO: 56090 - DNA, 1598 bp, Oryza sativa
gataaaagaaaaagataaagtccttataagacactaaacacactttcctaaagataaaaggaaactaacaaactattcctaattaatagataacttgccacgccacattctctttgaactcggtctcttctggataagcttcctttagtagatcaatttccttaaccgaatatagcaagaatccgacaactgacgacttgacaactctcatcggctaatctcaggacttcgaagccgatgctgactctaagccgatgactactccgagcttaccaaatttcactgttaacagccgccgagcgaaatatggtctccacatcattcccaggcctgaaaagtcgccatcgtccagggcctatccttctgttccagtgatttcgcatgcccacttcaaccttagggcttgaccaaatgaccaaagaaattcaggtggtctcggtgtgaaggacatgaatttcatttaatgttgacaaaaagattggggatatatagtggacttatttctattttaccctacagttagcccatatttagcaatgggccaggccagctgcctgaaagcaaactaggctatccgtgattgatcgattagagtgtagttctcagcccaacgagataaccgcttttgtgagactgtggaatccggatatgatacacttttatactacgtttgacatcagaacagttaggggtcacttttacttcatttgacaccaggatagttaaactttgctctcctggtgtagctcagtgcagcaagcactaccgaatagcccctacttcagagagtaagctttcatagtcatagttaagggctccttcaaaacacaagaggtttattgaattttagtgggaaatctcattcaattctccgacatttcagctccattatcgggctcctttgaaacgcaggaacagaaaaaaaaaagcatgattgaagtgccctaacatctgaaatatatcctatggactgaaaaattataggaaaactgcatgaatgaccgtttggatgtagtgtaggaaaaacgtaggaattggataagagagagacaaacataaacggtttcttttaaagaggttgaagctcatgttagaattcctccaatttcctatgttttgagtcaatccagatgaatttcattggatttttggatagctatttctttcattcaaatcaccacataggagttttttcttcataagattcccaaaattcccatgaaacaagggaattatggaggaatttattagcattcaaatccttagtcctttgaaataaatgattggagcttctcaacttctgtgaaattcttagggattgacttgatgcaaatagattttggaggaaagttagttaaagctctaacctcttagaaatttccttaaagcctatttctcttattcgatctctacgttttttatggtctattcaaataatcattcatgtgtgttttgtgacttgcattcctactaaaatcattgttttcaatttctttttttctcaatcctgtgattgaaatgaacggttcaaagggaaattcctccattcaaaagaagtaaagccttactgtgcagtatgcactattactaggccccat

SEQ ID NO: 56091 - DNA, 802 bp, Oryza sativa
tggggtggcggcgtcgtcggcggggggtggcgccattggcaacggcgccgactgcgtgggcatcgcgcaccccgggaaaggaggcgcggagggggcgtccacgtacggcttctccgccgcctcgagcttcggcgacgcgccaccgatcggcatggtgccggcgccgccgttcaacttctccgcccccggcgccgacatggcggcgcactactcgctcgcccaggaccagctggcggcgcctccgcctcctgccggaggcgactacaacctcaacttctccatgtcctcgggtttcttgggtgccaatagggggacccttcagtccaattcgccgtcgaacatgtccggccaccaccaccaccaccatcagcagcagctccagaggctggacggctccaccatttccttcctgcttggccacgccgccgcggcggcgcacccggcggcgtccgagggccagatcaccagcaccgccgcgttgcagctgtgggatggattccgccactccggcatgaaggagaagagcaagaactgatcgatcccagcaacgcatcctccaaaggtaagagactagatttcgtaatctaagactaatgttcgcgcaatttcgtcatcttgattcgattgcaatcttcttggaagccgctcgaggtggcctcgttccctgaaaaatcccactaaaaactcttttgttgcattcgacgtgtgtccccaaaaactttcgaggcgggatacctgcattttgctttgcatggattcaggccaaacaggtgtcgattgctcatcgctgggggaaggattt

SEQ ID NO: 56092 - DNA, 4953 bp, Oryza sativa
ggtttgattacttgtagtgctcccaactggggtctgcaatttaatagctagcgcaaaatccaattgaaccacatccggtgaaccacaaaatagctgctttgacaaattttacaattcaaattaatctgatgaatttaatttaagccatcgaatcaacatccaagcatgtacatggcccttgaaaggtgaatatatttctcgatgcatgcatatatatggttcaccatcatcaaccagcaaataaggaatgacttggaattaagcagtggggatcacactatcacaaacaatatattggctgtgtttagatccaaactttcaatccaaacttccaactttaatttttccatcacatcaacctgtcatacacatacaacttttcagtcacatcgtaccaatttcaacccaaacttttaattttagaaggaactaaacacagccattgacgagaaaagtggactactgcttaagaaaggagtattcacgagcaggcgatccaaaaacaacgtagcatcaggcacagtggcccgtcccgtaaggcacgcagaccagtcggcgtgatttgatcaggatgctgcctctccgatgggacgctcgcctcgcacccatgtgtgccccatcccatgcatacatgcttgctagccagcttaggctgtgtttagatccaaagtccaaacttcattccttttccatcacattaacatgtcatatatacacatacaacttttcagtcacatcatctctaatttcaaccaaaatctaaactttgcgttgaactaaacacagccttactcgtttgtccacccaaactgtctctgaaccctctttcaggccggagtaacagtgtgctaattggccggccattacatgcatgcatgctgcagctatctgacccggactaattttacatcgacggtaataatcaaagatagtactggagtactattgatatctttaagttattcgtcgagatggaagccagagagagagagagagaggcagagtgcagtactgagaaacatccaatccaatatcgtggacaggcaatctggcatctcttgagtttacgcaaacggcaaacgtatgaatcctcccgtggaatattataacaccggtcaactgtttgcgaatacggagagaacgttataatatgtggtcgcgtcgatcatcgcatccctcctgccttcgtctggtcttgtcgcgcgccacaggcgccggaacttggatcggaggagtactagctacgagtatcatatggttcgtgctcccatccatgcaccagagccacgcctgcccccggccggtaacatgcatgcactgccggaaaggctacgagtcaaacaccctctgctagctgctcgtactcgtagatcggtcagtacagcgacgacgtcgacgtacgtacatttttcaatggtactagtagaattctgcatgtctgcttcttcttcttcttctctctttagcaaccaatattacacagtttcacagtgtagaagaggggaaagatattgacttagtagccatgtcagataaaattgatgtcaaaactaccgaaggatctaaagtgaacggttttttaaattgagagatgttatatattttatggttgaatgacaattttgtaattcgatgacaagttgacggaccttcggttgtactttttcctgtccctcaacatataaaagggccatcctacttcgctgccgcacacgtaacaggccggtggagagttctacctggcccaacttgtgaggtcgtctgttcatgggctatgccacaccgtcccttgggccacaccgctgcctgactcattgcagcccaatccgaaacacagttcgcgactctgccaccaagtcagcgacagcccgcaaggccgcaagcgccaagagatcgtgaccgggtcacagcccgcacggcaggcgaggccgtcccgtccgttctctgccacgcggcccagttcagctcacgtcgaccgttgcgccggttcgccctcttttcgaaaggcaaagacgcaccgcaccccgtcaacctcgcggttaaccaaaaccactccatgacatgtgggctccatggtatcctcggacccaccaggcagtgactcagcctcgaaaccaacgcgtggcagaggcaaagatatggtgtctctgagagcaagtttaatagtttaactcactactagctccaattcatctatagccaatctaataactcatccatacaatagttatatactacactattaatatatggtcccacctgtcatacacatactgcgtcttggagtccgtgctacagctagctataaatctgtagaccgctgctcttttctctccttatttatctttttaaaatatatttgcagctgacttatattatgctattgtacctgctctgatgatacctttccctcctcccctcgcttggcacagattcccccatcgctgccaaaagcggacgcctccagcgtcctcccgccattactcacccagcaaccgactcgctcctccctttccgccgctgaccggtgggccatcccccccaccctcctcctctcagcttgtataccagcgcttccgcagagtcacgcactgcacagttgaagttggtggagtgtggagtggagtggagtggaatggcgggggtgtgtggctccgtcgcggcggcggcggcgatggtcgtggttgtgatggtgtcgtcgttgccgggcggcgtggaggcgaagacgacgatcgagccgtgcacggggtcggactcgtgctcggcgctgctgggctacacgctctacgccgacatgaaggtgtcggaggtggccgcgctgttcggcacggacccggcggcgctgctggccgccaacgcgctggactttggggcgccgggggcggcgcaccgcatcctcccgatgggcctcttcgtccgcgtccccacccgctgctcctgcaccgacggcgtccgcaagtcggtctccgtgcgctacgccgcgcgccccgccgacacgctcgccaccgtcgccgacggcgtcttcgcggggctcgccttcgccgaccagatccgcaacgccaacgccgtcgcatccgcggaccccgacgcgccgcttgaccccggccagaagctcgtcgtcccgctgccctgcgtctgcttcaactcctccgacaacaacctgcccgccgtgtacctctcctacgtcgtgcaggtcggggacaccgtgcccgccatcgccgccagctacgagaccaccgtcacggatgtcatgaatgtgaacgccatgggaagcccgatcgccgcgccgggcgacattctcgccatcccattgccaggtacatgttcatctcaaactttgcaaacgatatcgcagatgagccgtatggtttattgcattgagctaactgttttgagctaaaactttgcaaacgagcatattttctgcaggcaaattggttcgtcagtatgtttttgttctgaataaataataatcagacaatgcatcattggggatataaacagtatgcatgctagtggacattgcattggtgccttagctttaatatttgattgcttcataggctgcttatattctagggtttaattgattagtacagtaaagaaaatcacatcagtttaatgtcgggcttcaccatcttgctcgattttagtcttcctcatgttggtccgaactgaacatttgaaattatgaatctgtcgtcattacagtagcccaattactagctgcagtttgatgtttggtacttcctccgtttcataatataagtctttttagcattacacacattcatatagatgtttatcaatttaaacatatatgtgtgtctagattcattaacatctatatgaatgtggccaatgctagaaagtcttatattatgaaacggaaggagtatatgcgatgtttcaattcgctaacatcggagtcagataaatagaactttgtttaggcaatcgattactcttcaataggaattaggaagatactattggagagttatgcacgaactgttcagttttcctttctattcattcagtgagtttcagattgtgtatcctgtaagaaaacataagcatcatattatgatgagcctctgcgtttatggactctatcttttgttgattgctaattcttctgttctgccttctgtgacaacagttgggctgcatcatttatcttttctaaatatcagcattttctccctagttcttccagtgacaattgttgcttgtttctgtatcttagcatgtacatctgcatttcccaaatctgcttcagaccatggactaattgtggcaaatgggacttatgcacttactgctggaaactgtgtgcagtgtagttgcgggccagggaatctcaagtaattttcagattgtaccttttctgtttaacacgatattatatggaaccattatttgggtcgtaatgtctgtcttctcttctgtctcagtttatattgcacaccagcttcattgacagggtcatgtccaagcatgcagtgcagtaacagcaatgttctgctaggtaatgtaagcgctcgttccaccagtgcaggctgcaatgtttcttcttgtagctacggaggttttgttaatggaaccattaccacattgtaagtaacatgttgctcagagtctctgttttttctacttctactatcaagttgttacattctaccttcctttgcaggctgagcacaggtcttcaatccagatgtccaggtaattactgttgctgtgagcttgtggcctgcaactggcttacaatgcagcaatatcgtgcatttgaatttcaatctgcctcagatgttagtatttttcaggtttttgaactggaaaagcatgcatccttttttattaaaaaaaacagtagtaagttgcatcaacagaattaacatcccacctgaatagttgcaaaaattgcactttgtcactttgaattccaga

SEQ ID NO: 56093 - DNA, 4202 bp, Oryza sativa
catcagtgcaaggagggtctttcacactgcccaaagtatccactgcaaatggccctgccggaagcgtttcagaggctccttggatgaacaagccgcatcagatcctgtcaagtttcatcttgtgtctactacttctctactcgcagatgtgaattgcaatgtgtagtcaaggaccaattctgtagtaattgtaaacttgaagcctcatttaggcaaggggaggtggacagtatcatatcggcgatgtttttggagcttctttctatgggtatcaattcatgccatgaattgtggctttctttcatgacatcttccagctgtcgtcgtactcggtcgcatctctgaatatggccgagtttagttccaaactttttcttcaaacttccaacttttccattacatcaaaactttcctacacacacaaacttccaacttttccgtcacatcgttccaatttcaatcaaactttaaattttggcgtgaactaaacacaccctatatagctttgcaatctttgcatgaaaggagaggtttcaagtactctcttctctgacgactgtcaattctgtccatgttatcatacatgaccattggttggcttttctttactggggagccacggacaagctctttttcttcgacccctcatctgccggcgtcgaaaaagatctcgctagagtgttacgggtaaatttttttaactgcttggaatcagatctcgttgctgatctgtggtctacaaagcagttttgagccatgtgaagttagctttcacgctctctccttttcttctaattctctttggactttggcctcatctttggtacctttccgtccgcgcaatggtactttcgctttcagtctttcagttgaaactcattttcatcatgtaggagtagcttcttgcctaacgcaccacactgtttgatatgcagttctgcacatttccaatgctgaattccctgaccaaagtagggaagccagtccactaacacgatgcacacctcatatcccaaccaaccaacgcataggaccagcaggaccatgccactgtatcaggcagaagtgaaatgccattgctcttctctctgaaatgaattcagatgctcagctccagataacatttcgcctttcagaagcatctctgcaggttgcaacaagtgtctgctcctgtgccgaaaggacagtgaatagctccatgagtcatggcccgtggaaggatcaattggcgctgcaaatcggaataaaaatccaagaaatgcaggaatatccaacggcgccaggctttctgaagaatatagttctgctgctgctattgctgatgctataagctggtagctctcgccatttgctccgtgtaaatactgtcaagttaagagtgatacgcacgctttagcaagtgcttttatcggcttaagatgccaacctcacgtggtgattatccactttcggtaatgtagcaaactagcagcttatcttctttaatcaagaaggagagcagtgcctttcacattttccttttgtagattcctgaccaaccaaccaaatctatgatggtacggagttcaggattagtttttgttcactagttacttggatttatctcacatgagaatagctgtttttttttatgttgatcatgtgatttacagcacaaaaattgatcaataacaccacaaacatgcataaattgtgcctggtaacttagatgaagcgtagagcaggcaagttccatcgtcctaccatttattttcagatcagcataatttcatatttacaaaataacattttctttaatgtgtcacagttcatttagctaccgtagcatctctctatttcagctattgtacttatcgtcatattcaaatactaccaaatataagtcaccggtcatttcactcatttcactttggtaccatagcaattcaataaccccgctgtacacacctcataaacacacaaaagtctgatcttcagagtttttttttcgagtttctccagatcttcggagtttctttttccagtacatgaatggtactgacaggaccatagtataacacagagtcttgtctaaggttttctctaccgacgaaggatcgagtatttttcaaccagtccaatcaggccagattcaaaagaagttcacaaagctaaactctttttcacgtgaacacgcaaaaaaaattgcacgttaatatattgaaaggaaaaaaaaaattgtaacacaacgcaatccactgcccggaatccgcacaattctggtggattgtgatgaatgccattgggcgtccggatctcttccctgcctctcagaactccatctcttggtggtcggcagccaggaagggagtgacgaagcagctccgtcgtggtttcgatacagttgtggtcctagccgcttggttcatatggaaagagaggaacaatagggtttttaaccagaagcagtgagcgtgagaggaggttgctagggcagcagcagaggaggccgccctatggaggctagcaggtctactccccgagtagatcatggctgtcgtggttgcaaagttgatgtcatgagattatagcttagcctccttttcttgcctttctttttcggtttctctttcagttgcactgtaaagctgtcacaatttctccccaatcttaatacaaaagatgcgcaactcttttgcgcattctcgaaaaataaaagctactccaatcagcgagagggtagaggtggagccacactacactaaaaaaaacacaaaagcagcaacgccagtggaagaccacagacaatcctctgagaggatggactcgaaaaccacggagaccgaggagagcaccgagttgaaaaccctaaaattccgctcctttcacagctactaagagaccagaaggaccagagagtcgaagccgacacgaagatgttcaagtaatcaggccctagaagacggccaccggtcctgaagcgagctgccacgggcctcaaactctcaaagataatcccaaagaataatctgtgttcaccaactgcacacatcacctccaaacacgtacgtacggacgtaccatggccgccggcgacgtctaatccaaaatttccaaaccaatgaacaatagccggtttgacacgacgaagaagcgacagaaatgcagatagacgtgtcgaggccgattggctggcctcttggacaatttacgaggagtatctgtctagctgatggcctgttgctgcagaagtagcaattcgtgctctcccttttcgttgaaagagagagcgatcgagaggtagcaattacgtgctcaactgatcaattgacaaagcatactatacatttgtctcaaactgaaggattccgcgagaagatttgtggacttgttttcagagatgctaggcatcatatgaaacactgctcatgacgcagatctcagaaacttcagagttactagaggatcacattcacggtcatttttcgtcgccgttgtaaactagcttttactactacttccattgacaggcagggaaaacttcagagcgatccaatctgttcttttctgttaatggtactaaaatatttgcgaaaatctcatttggaaaagtgttctttgcactaataactagtactaacagaagcacttttattgcgagaataagacgagccatccaatggcaactcgttacgctggcacgagctctgaaattccgatctccacttgggcagcacatccaaataaacaagctgcttatgttgtcatctctgtccattactttgccctgcaattcttcgtgaatatcgttatctggaacatggatcagaacaatctagtggcagccagattagttgctgccattatctcttggttaattaaaggctaagacaagctcaggttaaagcgcaaaaggaagtggaaagaacaaatgagcgagctgaggattggttctgacttctgtaggagatgatagttgaagttaaaaaagattaaacttgagaccactcatgcatgcatcgaatgagctgaactgcactttgggtgatttttacggcagtagtatatctgatctgatatttgtttactctgaacaaagcagatcaactgcacaaatggagtgagatcacgcgcctctgctagccttgcagctggattagtacggcaactagtacaagttgacagtattgtcaatatatacagttacatctagtgcttctgtt

SEQ ID NO: 56094 - DNA, 11800 bp, Oryza sativa
aaatgaatgtaatcttacggtgttaattttcagctaaaagaaatgtcaaattttgactaattctagtgtataaatttataatttggatgtacactaatgtacaagtaagcctgtcataaagaccaccacttttagtgtataaatttataatttggatgtacactcatggtataagtaatgagtcttttacctttatgccattattaagaaagttggaggttacgcgtgtgccacaaaaaagttttgagttacatgtataccatgacacaaattttcgtttacctgtgtgccattccatccaccttctgttagagaatgagctctgacatgtgggacccacgtatgaaaataactaaattgcccctaaagcattttcatctccactactcctctcctccagtgcgccttgaaccctagccgccgctgccgccgtttgtcgctgtcgccggcacgctgctgcctcgcctcgttttccgtcgatggcacgccgccgccgccgccgccggtcgtcgccgtcgccggcacgccgctgtcgccgccttgcctcgccggcacgccgcagcgccaccaccgccgccgcaaaagtggatgaaatagaagggcaaaatagatctttcaaacctctgttagtctttgttagtgctaattccatccaaagtggcgcacaggtaaacgaaagtttgtgtcatgtcatacaggtgactcaaaattttttttgtagcacacacgtaacctccaacttttttaatggcataggggtaaaagactcacaagtaagcctgtcataaagaccaccactttttgttgactttgttaactcaagaacaccattcttccgtggctgttgggtgggcagggtgtaggtttggcaatgtgcccagagcctaagaagaagaaggaaaacgatgaactgctgaaagccttttcgggttaaaactgtttttgccataatatggggaggtacacaactgcgtctcttgcctaggcttagcctcaagtaccacctataaattcacgttaaaaatgaagtagtggagattttggttgtcaatttgatttgatgtatagtgcaaagaaaagaaggaaaagaaaaggaagagaaagagatcgagagacaagatgcactgaagatcaggtcctgagacgagtgctgtcacctcttcgcaaattgcctcaatgctgaacctatcctgattcagtgattcctgatggacacgacatggatgagtcgtccagaggaaaagaaacgccgcaccgagaaaaccaacaaaaattaaccctcatttgagatcatacatgcccttaattgaaacccatcgacagtcaaaagataacttttctcaagacacttattagtcaatcaagattcaagagcctggaaacaacagtcaaagtagatcttatacatactaatcaaactattttgcaacaaagaacatatagaaactaaccgatcgattgggttccaggagatcgccggagctccggcgagttcgggcattcggcaccagaaggaagagagtcgccggcctaactgataagagcaagtttaatagtatagcccactactagctccaaatcatctatagccaatgtaatagctaattcatacaatagttgcttactatactattaatatctggtctcacttgtcatagacaaattacgtcttggagtccattctgcagctggctacatatctgtagtttgctgctcttctctctcttactttatcttttgctcttctctctcttactttatctttttaaaatatatttataactagcttatagcccgctattgtatctgctctaatacgaacaaagaggagggttttatgaaaaacaagtcctactctctccaatgggattgatatcgaccgtcagatgataatcggacgatgaagagtgatccaagatggtcgcgatccaaactctcgggagtattctcaacgaaaacgtcctacctgcactcgagtccaaccaatctgaactgcagagtttgatcgaacggcgaagaggtattctagtcagatcgctaccattaatcgcgacccaattctcaggggttgtgaaagataattcgacgaaaacgagggtttcctgtgtaaatatacctccaccccctcaactcctctctctgacaggtgggctcactcgctgacccgcagtcaacggcggctttcacggtgagctaccgccgccgctgccgcgactcctcgccgtgccggcgttggtgagaggtgggcctcgccggcaggcggcagaagcaatcgcctcgacctcgagctcatgcctaatccgtcttgatcaatcagcggctaattaattcgtctggcttagcaatggacagagaagcaaatcgagctataaaatgtgtgaagagaatataatagctatgaactgtgagttcaactgataattatacatacataagtcgacctgtcaattctatcatacatgcgtctatacaagatcgatcaaaaagatcaagaagaagaaggggaaatcaagagaccaaaatcatgagatcgaaaacccggagcaaatcactaatcacctagctactgtatgccactccactctcctctcgtcgtgtactgtctctgctagctatagctaatcgctactgtacacgtacgcggggcgtcctcgccggcagatcgactccgccatggcgcacggaagcgagctcgatcgatcaggagctgactttggcgcgggtgcacggggagaaggagtagtggtggtggtggtgcgatccgccgccggcgtggacgcggtgcggcgacgacgagccgccgccgccgccgccggccgcgtgggtctcccgctccacgagcgagcggaggcggaggaactcgtcgacggagcaggggagccggagcgggccggccgagtcgtagccgtaggcgtcgcgcgccgcctcaagcaggcggcggaacaaggggtggtagaggtaggcgatcgggatgacgaaccgccggaacccgccgccgtcgccgccgtcggcgccctccaccccgaccctcaccgccagccaccctttcttcaccttcccggccttcttctcctccccctgcagcatggcggaagcaccaaccaccgaaacagacgccgtcctctcctccgcgacgacgacctcgccgccgttgcagctgattaacctcgctgcgcaagtgcaatcaagctacgcacactccacgagctggagctgatcgatctcgaattggggcgtggtgtgctctgccacgcgtggtgtgtcttttataggacgcggcccgtgcgggcgaggagtttggctttagcttagctagtggcagtggcgtacgtacgtcctttgctacggaagccggccgccactgtcatggcgtgctcgcgttccttccggctcccgtgtcgctgacacgcgggccccggggaatatcagggttcaggtgaaccgctgcagtgaacgagagagagattgttatgctcaaaaacgggaaactgttttgaaccctccctcagttgtctcctcctccatctaaaaacaattcaatcagttacaaaaaattctgaaaaaaatagatgatatttatgcagcgtatatatatatcgctccacaaaatcttaggtcgttaaaactcatcatatatattactaagatataaaaagtttcagttggtaaatagtagtggcactatatatttatatccaaatttgtctctttttcttctttaatacgtaggtcgaatttgatgttgattttcggttaagcgctagatttcactgtagtctatattgttattttctttaaatctttttcataactatttgcatagaatttagaaggaaaaaagtacacaagtctaaaaaaaaatccaaaatataacatgtgagcctgtttggcgcctacacgaatcgccgatgacccgggcggtggcgcccaccgggggatcgagtggggtggcaatagcttgtggtggaactgatccggccaagtgggggagggaatagcgtgtgttcgtgcagtgtgtgctgccccacgagagatggtggggattggcatgcagatcatgacggaatggttcgtcagattgttgttgctgctgctgctgctgttgttgagtactaatcactattggattttgttctttgtgcttctgcttctagctgtttcggttatcttttccagtgatggtgggggatgcgtgattaacccaatctcatctatggtgtgcgatcgatcgacatgactgcagatatgggcgttcctttaatttgatcgaggatgatacacatacatacgccacaataatctgtgtggttgcatgcagtgctattgattcagttcttctcgtcaatctttatctctgttgaaatatctctgttgtcgtcctcaatagttattctgaggttagtcttactgtagacagggaagttgtcacaggggaaatctcacatcattctagctccaaaccaaatgacaggtgctttgtcagggggtgtgatggattagcgatccaggattattccaggcagctagggccacaatgttttactaatttgtttctttgcacgagtgagagcaccatgcacacagatatctcgtactactactcttctactagtaatttggataaaatacgcaactactcctacctacgagttttctttttaaattttaacagatgcacgcgcctaatggttgtctttctcgaaaggatagatatcatatcacgatgagtagaccgacatcttggactgctggattgcttatctacatgtatgtcatgattattggttatgtcagccaactttgtggtcacaagatgtgttgtatgcttgtaaagttgtactaataaaactacccaaaattttcacgtaattctacgcaaatcgcaggttaaggttcatttacaagtagaattgcatctgctatacaatttcgttgtgtttcgacaaattaatatgtatattaattgagtgaattgtagcttagactactttctattgccaatgtttcaatttatactatcttttgactaatcctttcgctttgcattagttaaatacttaaatttactctctctctctcactctggaccaccccaattctcttatatacccatatctaactacgcctccgacaaagatatagcttggggagggagtttatcagtgtattggaaccaatattggttattgatgtgcttaaaaaagtggtttgggtggtttaaatctgttgacagaaaacacgaggcctgggagatctgcttaactccagtgcaggtccaaagctcgtcttcgaatgtatgagcgtgccagttgatttaatcctgtaatcaacaagaaatagagacaaagaatttgtggttaaatctataaatgatagccgatcggctaagtgccgatgacatatcatttatctttgagccgatgtcatttatgaatcgatcagtggttataaatagatagtaaggaactaaatctattcgataggctgtagatattaacgatatatagttcttatattaatatatacttcaatcaaatgattgggatagatcggtcaccatgccgagacagtataaatcacttaaatcgaaatatatattaataataggattatatatgtttatagcatagccgatcagatagatctagcatgtatcggttaatactccgatactactctatataaagatatcaaaacaagtataatataccaaacaaaagcttaatatacttaaatgcaataagatcttgatataaagggcatatttaacatgtcactgaagcatatagattgaatatggttaaatcagataagatcggctgaaactccgatattaccctaatcggtaaccagaggacatgctagagattgatattctaagcacgacttaatagatcaaactcaactaatacagcattaagtatgaaaagaagaacaatatctagacaacaaagccgctggatgtttcataaagtggtagatatcttatataatctaggacaacgtcgctatttaacctaatcggctgccttctattaacagatgttagccgattgtaggttagatgacgatattgccaaagattatgtaagatatataataactcgacgaattatatagacaagattagagtgtcataaagatggaagcactaatctcgagaacacaagtcgtcataacaagttttacctcttgttgaagatcgaaaccgatgcagctcaacccgaaagcaagaactcgtcgaaacaaaactaaagcaaaaaggtggcgatgcgccgaaattgtattgaatgtgtgtgttaaaaattacatagggctcggggtctatttatactcgagaattacaagatatgtccataccggacatgaccactatctttaacaaacactaagataccataagtctttgcggcagacttttgcccaaacatatctctaaggaagttacataaaacatcctaattaatagatacaattgccttcttgggactctatccatgtgcggaaatcatcttgaagcacctcaattcaacccgatgtcatacaccaaattatactgtcggaatcggctgcatcggcttacctagtccgactcagacccagccgatcctaatcgtagccgatctggacttcagccgattcttgctctgttctcggatcaatctccgccttcgactccacttcgatctaatctccttttctgatgctgatattaccaaatttggtcgttaacacatgccccccaagtccgggatatttgataatgttccggatttgccgtgtaccgactccgagcaagtttcgcactctgccgttttttgaccgttattctatcgctttaaataccaaccgttgccctcgagaaatctcacgccgtgacttccgttttcaccgctcaagcaaaactttgtcctttctctctccggcgattcctccgacgcaaaagcgatccccaggcgatttcgcttctgatcagatctccgcctgcggtgatgtcgtcttccactagcccgtctactgcgccatcagccgagtacgctgaggtaagttctcaccggctagatcccttttcctcgcatgaaatcgatttctccttttctcattatgttttctgcttcccgattcctttggatttgcagcacctttccaacctagttgcgattcccagcctatcgcacaaaaaccattattttcttggcccaatcggcaatcttgaccccactgatttcatcattggtgaaaccaacataatcccctttagactagctaaccctaacctgggtcactggaagaataccttcaagtcttggccatctctcgaaaggcctacccctgataagagctggaccacctggtaccatcgcatatcggctagtaagaaagtccactgggatgagattgggatcggccaagcgctttctctcaccatagccaattctgctaaggatgaacctctaatggctgccgctacctatttttggtccaacaccatcaatgccttcttatttaaccaagggccgatgactccaactttgatcgacatcatcatgattactggattagatgtaacttcatcggctaaccctatgagtatgaacaccaagaaccaatttgacttcaagaccaaaagcataggagggtggtctggttatgcagcggcatacatgggcaaaaggcctgtcactcctcgagagcacgtagctttcttgctaatgtggctagaaaagtttctcttttgtggatccagctgtggtctcacaaccaattggcaatttgtagccggagccttaggatcaaagaaacaattccccttgggcaaaatccttctcggctatctataccaaatgttgaacaatgcatcggctaagatagccgtcggctcaatagttggagcaggtggaccatggtggctactgcagacctggctaaacctggtagtcatgaaagttgtcaatcggccatatgtaacagaagctgaattcccaaggttggagccaattgtagaagacgatggagaagaacgcacccatcgcagatgcatgtcatatggagaatatgcatccacactagccgatgctggggtaaaactattggctgagctgctcaaagattggttctgcagcttttatgaaggcttccagaaagatgcccgggtttggtttctttatgaagacttagcagaccttgagctcccattagacttcagatttgaagacatcaatcatgaaagatatcaaacgtccagggaagtctttacagctgcaatcagcccatgcatcctacatgtcggtattcaccaaggaagaaatatccaagtctcctacgaattctatcaccctataagttcagctagacaacttggattagaccaactcccaatcggcttattctttgctgacaagatccaatgccgaggagaaatttcttcaactctaatgatggatcgactgcttaacctccaaggaccttccttaggcagtatcgacaatattgagttagcaggatttaggagtaggaactttgacagatggtggggtgaatggaagttgcatctatttcatcaatcggccacaatgtatatgacagatctattccctgacgtcataccccaggtaaactttgtcatcactaaatttcataacggttagccaattcattacttgactaatcttttgttcttgttttgcagacaacagaatcctcccctccacatcagagcaatagtggtaggaacattgaatatgccctaggtctgattcctaatggaggcagattgtctccccctgtcatcggctatcatgcccccttaggtctcaaccctcctccaaggcgccatcagggaaccaaccgatgtaaccaagaaaagaagaactagatcattggctgtgagcaccttgactctagctccaaagaaaaaggccaagtctaagaaaaccaagccaaccgatgacctgcctgctttggatccatccattgaacaagctctggatgaagaagatattgaggatgatgttgatcaggctgcagccgaagtaagtgatactgaaaaaacaccatcggcttcgcctaagcatatacctccaactccttctgcccccactccttcagagtaaaacgtctttccctgcaaacccttttataatcattatttttcagccgactactcataagctttgtaattgcataagaagaaaactgctataaagaagaaatcggcagcagcaattctcaaaccagctccaccagtaagatactctcaattttactagttgattccagccgatattgtctaacacttgtctttttacagcctcctcctcctcctccttcttcccctgtacaacaatcatcgagtgaccgaactccatcggccgtggggagtcatcatattgtggaagaagaacaaccagctgctcctgctatcccagtaagttttcctttgatgcaagaatttagatcggctatattggcttagctctcaaactgtctgaacttatacctgcaggttctagccgatctcttctcttttgatatcaaagattatcttgatgaggcagaagaagatacttcaagcaaagctctagctctcttatctaacaatgcaaagaaaacacttgaagatatctcgcgtcggctagaggcctcttctctggatagcttagtggtcgattgtagatcgattaggacacgattgcacgaagttcaagctctaattcctgaagaactggccgatgtcctaactccagccgcttatcttgagcaacatcaatttaaactagaaaaagccaagctaagattagccgaacgccgtgaacgcaaggagattgaagccacaatccaggtcaatcggcagcttgtgcatgaagaaaaagtcaaactcgatcacctatccgaaggtccgatcaaatccaataccgattggcttgaagcccgcaagatcgatctcttagcacagcttgaagaatgcaatgctgaattggatatggagcacaaaaagctagccgatctctcaaaatctgtcgaagagcaaaaagcaaggctcaaatcggctatcaagaatgttgctgacctaaccaagtccctgaaggtcatttctggaactgatgctcaagatgcccaagccattgaagaagtcgaacacattaggcaaagagctattttggctatccagcagtacttgtctcaataacttttgtgtaataggacttagaaattcctgtaatcggctaagataccttaataccctgctgttttaacaatcctttgtgccgaataacataacttctaattttcactttcattttttgtatatatgtgccccccaattttataatgtcaacagcattgataaaattagaaaaacaactaagggcgatataacaatatcggtcgttatatatcggcaaaccataaccgatgacaattggaaaaacgactaagggcgatataacaatatcggccgttatatatcggcaaaccataaccgattacaattagaaaaacgactaagggcgatataacaatatcggccatctcaagacgatgtaaaacacatcggctgtcatgcatcagcaacactagccgatcatgcgtcaacccaaacacttgggtaatacttcttcaagtatttgccattgagcgctcgtccataaacctcaccatcaagcccttgcaacatatatgcccctttagacacaaccttatagatttgaaacagtccttcccaatttggtgaccacttgccgaacttgttatcccgagttccaatcggcaaaatcaacttccatacaagttcacctttcgaaaaatccttggcactactttcttgttataatgcctagcaactcgttccttatctttggtaaccttagcaagggctcataaacgcgattgaaccaagtcctccctctcatcggccataaggttataatactcatcagctgtcaaactgtcttgcaattctatccttctagagccgattctaacttcccatggcaaaacagcttcatgtccaaaaacaagcttataaggaggaacttgaattgatccatggcaagccatccgataaaaccacaatgcttcggccaaccgggtatgccattaccgaggataatcagaaatcttccgcttaattaatttgatcaagctcttgttagatgcctcggcctgcccattagcttgtgcataatatggtgaagaattcaacaatttgatacccacgctatcggcaaactgaacaaactcatcggacacgaagattgaaccttgatcagatgtaatagtttgaggaataccaaatcggtagattatatgttcttgaacaaattgaattgcatccctagaatcaactttcttcaaaggaatggcctccgcccacttggtgaaataatcagtcgccaccaatataaacttatgccttttacttgatggtgggtttatcataccgatcatatcaattccccaacctctgaatggccacggtttaataataggattcatagccgacgtcggcactcgttgaattgtcccaaacttctgacaatcttgacaccccttataatatctgaagcaatcctctagcattgtcggccaaaaataccctgcacgccgaagtaaccaattcatcttatgggccgattggtgagtgccacaaattccttcatgaacttcgccgattgcaactttagcctgatcggcactcaaacacttaagtaacactccatcaatcatccgataataaagctcatcatccaatagagtgtacttcaacgccttatattttaatttcctagaagccgat

SEQ ID NO: 56095 - DNA, 1599 bp, Oryza sativa
ccccccaaataaattgttgatcggccttcaatctcaacaatggtgtaaaaggttctaattttccggacaaattagaaataaaccttcgaacaatattaatcttgccgatcatctcctgcaattcggtcttgtttcccgggggcttaatctttttgatcgcattgatacttctttgagttatctcaattcccctctcatggacaagaaatcccaggaactggctagccgatacaccaaaagcacactttatcggattcatcttcaagccatatttcctggtcctctcaaaaacttttcttaaatcggctatgtggtcttttatttccttagatttaacaaccatatcatcaatatagacctcaaccagccagccgattagatcatgataaatataattcatggcccgttgatatgtagctccagcactcttcaagccgaaagtcataacaacccattcaaataagccgattgcaccaggacatctaaaatctgtcttatggatatcttcatcagccataaaactttgattataccctgcgtttccatccataaaactcaaaattttgttccctgacgcagcatcaaccagctgatcggctactggcattggatattcatctttcggtgtagctttattcagatctctaaaatcaatgcataccctcaccttgccgttcttcttgatgacaggaactatgctagaaacccactcagcatatcggcaaggacgaataaaaccagcatcatataaacgcttaatctcagccttgataggttcaagcatatcggctttgcatctcctcggaggctgctggtgcggcctaacccctggtttgataggtagccgatgttctacaattgatcggctgagtccaggcatctcataatactcccaagcgaagcaatctctaaactcttttaagagctctatcagcttggttctaaattctggatacaaattcttactaataaatgtcggccttggccgatcacctggacgtatatctatttcttccaaatcatcggccgacataaaaccttgaccttgcttgtcatcgagatcatctaccgtatccttagtgtagacatttgaaccctccacgacaccctcaaaataatagcttgggttctccatcttcaactggctgtatatcagaatcggacacttttagaaaatctccatcccaaacttttccagataaacaatcaaggccatccatctcccaaagagctaaatcggcactggcaacattaactgacatgtcggctggtacgatctctattttgtcgccttgccactgaatcaagcattgatgcatagttgaaggaatacaacaattggcgtgaatccaatcccttccaagcaactagctgtaagaacccttcccatcaatgacaaaaaaacgtggtaggaatagtcttactgccgactgtcagctccacatttagaacacctttggtttccgatggattgccaccaaagtccttgagcaccatatttgtcttgatgagatcctcggcatttctacccaacttcctgaacgtagcataaggcatcaaatttaccgcggccccaccatcaaccatcattttagacat

SEQ ID NO: 56096 - DNA, 4545 bp, Oryza sativa
ccacctgaatctgttgtctaaaaaccttgcaatcgttagtagaatgggacctagaattatgccatttgcaatatctctttttgcctaattcctcagccgatggaatcgtatgaccaacagggagttgaatttgcttctctcggagtagcagatcaaaaatcttgtcagctttagtaatatcaaaatcatacttctctttctttccagaactctttacccattggcacggtatgacctttttacttctcacccatttggctgcagctatttcagaatcatcctcatcgtcatccgacccatacatgtaaggacaaacatgattaaccttcttagagctttttctagcctccgcagacctatgctcgtgcaaggttaccttttgtatcagatgtgacaagctatcaaagtcttcagacgagaatttctccctaatcggagcaatcataccctgaaaggccaaatcggctaactgagcgtcagttaaactcaagctaaagcatttgttcctcatctccctgaatctctgaatatactcgtgcacaggttcatcatgccgctgcttaatcgccgtcaagtcagataacttcatctcatgaaccccactgtagaaatagctgtggaattgcttctccaaatcggcccaactattgatcgacccatacggcagagaagaaaaccaagtaaaagccgatccagataaagataactggaacaacctaaccctcagagcgtccacagccgatgcttcaccacactgagctaaaaatcggctaatgtgctcataagttgacacaccatcttgtctcgaaaatttagagaagtccggaactttgaaccgattggggagaggaactctctcaaaccactcagtgtaaggctgccggtacaagcttccagtctcttttggtttaagcccaaaccgttccctcattacatcagcaatcacattggcccacggtcgttgctgagctgttccctgtgactgttgttgcatgggctcgaactgaccatactgagatgcaaactgaggttgagccagtccccctggctgatattgggcttgcggggaaggagactgatattgataattcaagttgccccccctggtaattatgaaggatcggttgaatattacgtgccaaatgctcgggaacaacttgaggcattactgtgtcatctggctatacgtggtgaaccaagtgttctgtgacgacttgatttaaaaattgttgtataggctgtccaccaggcgtcacaagcccggccgatgcgctcattgagccttggtgctgaatcggctgaccgatttgctgtcttaatggcgtctgctgaatcggccgcggaggctgttgccttggtaacgtttgctaaactgattgcacaacttgttgctggattggttgtacaacctgctaaattgggagtgtctgttgaatcggttgctgttgtattggatcaacagcaggttgaggcggcagaaacatggcagcaacctgatcttgcgtcagccgattcgcaacctgcccacatgctgtggttgctctctcattaacaaccgagagttcaccagctggcctagtgccaatgctgacggagcaggtaagggagtcgatgccggcgccgtcagctgagctgatggtgcgatgggggaaactgcctaaatagatggctgggcatcagtgatcaaaggccgataatttggaaagacacctccttgcaaataaactgggcctgcagcctaggagatctgcttagctccagtgcgggtccaaatatgatgagatgcgagcgtgccagtcagtttgatcctgcaactgacaagatatgcaaatagtatatcaaaatagccaatcgactgacaagccgatggagtagttccagcaaatagccgataatagccgatgccgataccagccgatagtgatagggtttaagcaatgggctatatgtcaaatgtagataatgatataacggcaatcgactgatgataataaaatacgacaacaatataatccggtataaaccaatcggctatcaatacaatatgatagaataagcattgatccgaaggttaaagcatacatcggctggaggtccaatgtcataaaatccacaagattggattaaacaatgaaacctttgttacgatcgactaaatccaatatgtatgcaatccttgtaagccgatgcaacgtccacataactcatcggctgaaaccccgatgaaacccttattggcaatcaagaagcaagctagagattatggttctaaacacgacttagtagatcaaacttaactgatgcagcactaagtatgaaaagaaacataatatctagacaatcaagccgttaactgatttttagggtggtagatatctaagctaatctaatctagcaacacgatttagccgataccggcagaaaccctaaagcgagaagcagccgatagaggtaaattgatatgctaagactagattaacagagacatatgataaataggtaggcaaatatatcatccaaatcagagcaatccaagaggtcgaatgtactgatgcagccttgaacgacgccgacgtagacgatacaattgctcggaccggcgaaacattggacttaccccttcgctggagatcgaacaccgatgcagccccgcgtcgggtgccaagtcccgccggatgataaaataaggtagaaaaggtaaaaggggtggcgatgcgccgaattgtattaatcgtggagatagattacatagaccccgggtgtacatatttatacccatgggttgatacaagtccttgtcggacaagaaagaaactaacctaaagataaaaggaaaatataaagtccttatcagacactaaacacactttcctaaagataaaaggaaactaacaaactattcctaattaatagataaactgtcatgccgcatcctctttaaactcggtcacttagggataagcttcctttagtagattgatttccttaaccgaatatagcaggaatccgactattggcgacttgataactcccatcggcgagatgctgcagccgataatgattctaacccgatgacgtcgttgccgattaccaaatttcactgttaacaaaatcacaacaaagataaaattactagtttaaagtgaaaatatggtataaatggtggttcaaaataaaaaacttgaaaaatataagtggtccagactataatttattcactaattaatttataatgttatatagtctagaccatcacaatatactgcgtacatatttctttttctaaagttaacatgataaattataggtcatcgatgcaaacgtgttgattctttttttttagttggccccttttcagaacataaactttataatgcaatacatggttttcgtatcagctccctttcatgaggatactggtctatatatgttaaactaacctttagctacaaaagtaacgtgtacctttttttactggtatcaactttagaagataaataatgaagcaatcgattaaaatacaagaaggcatgcatgcacgccttgcatgcttactgtaaaaccacggctaactgtggttttgatggcaaaacttcgaatatatgattggtgataacagcaagtttagtactagtatatacgtttctctttaaaaaagtatacttttgtaaaaaaagaaaaattgaaagtatatcttccaatatgagtatggacttctcttgtcgactcatgctatagatgctaatgttggatcttcatggtgggcatgtaagagtatgctacacaaaaacccacggtgaatttaacaatgtgcactatcaacaatcgtatttgtttttttcctgcttgtataggtcgaatttagatttgtagagtgatatatatcatatatctatcaattttttttcaatttttatggcgttttcgtgacatgtaaaaacaagggggcatcctctttgaaaaaatagcttattcacactacaaatatttcgaccaaactatcataaaactacatatttaaagtgttgtattataaaactatacattaagtagctaaattatcataaaactataaatttagtaccaagttaaccacaaaactacgccatttatagctccaacataaatgtagtgttatggatttaaactctaataaaggttataattttttgatgacttcttcgatattaaatctatacttttatgatactcaacattaaatttgtagttttattataaatttggtactaaatctatagttttgtgataaaataccttaaatttgtaattttacgatcgtttagttaaaatggttgtagttatgtaatcccttcatccaaaagtctaagggtgtatttggttggggtgagtttttatgagagattagaagtttaaaaggatgaggttattaactattctatttggttgagagacaaatgagttttcgtgggatgggatggggaattgagggaagatctccctcctttttaatatttgggtaggggctagtaattgataggaaatttctcctttacgttgcctaaa

SEQ ID NO: 56097 - DNA, 6000 bp, Oryza sativa
  unsure (1)..(6000): unsure at all n locations
cacaccctactcgctcgcctccctcgagctccaggcaagcagactagaccacgttcgtggctcttgcgctctctctcccttggggggtttcatcctgagaagttggggtttgtgtttcgatcaggagagggacatcacgacgaatccggattgggagcagatgtaccagtacgagatcccggtgctcgccaaggttcttcccgacggcagcgaggtgtggtgtcgtcctcccaatcgcgctcgctcctggccttcagtttaggtgttttgagtctagagtttgtgtcatcatagctcatatcaatgatcgttttgcaggaaaagcttcccagattatcgcctcgtctaagcgtggagctcgtgcagaagaaagtgttttctgcctttgatcagtaagatattttcacagtttctttcagaaggtgttttttttcttccagttttgagtcagcagctatgagaatgccgatggataatggatggcatatgtgatctttacttgttgtaatctttattaatctctatggatttgagaaattatacactaatttttctggatactctattcggttcagaataagttgtgcttgcttatataattgataatcatccgtatcgctataaaaatacagataagcgagcatctgagcacaagatgttacccatatactcacagaatggttctttgggacaagagcaatctatataactcatgcaaatgcacaagctgtttggatgaaaaatctctgaacgcattaaagaaacttatggttaaccacccgtagctggaggttttccatcttactgctaaagaacttaaccatttcccctacagtgtttttggtcaaaaagagaacttaaccatttcatatatacacttggttaagatttcttgagcattactctgcattagtgtaggactttcgctcagaagcacttcatgcaaccttggatgtaactgacaaaatcacattgaaggaacaagtgtagaatcaactgcagaagacagtaacaacagttatctgacctgaaggcactggcctgtagagtgcatggataacagataaaataaatcaacttgaggttcgaatactgaaacttgtgttcaactctttataactaagataaacatttatcatagaaataataatattcagatgataaaatgaaaacctaacatctgaatccctgtcttgctgtcatgtaaactaatttactcttgtttgtttgctctaatttacattaatgcatgtttcatagttataactctaagatgtaacaaaaacgtgcatcaatcttgctaaacaatataagaacacttaaggactagcttggtaattctataagcaacttacttattttgatggggatgctggcacaagggacattggttttgcaagtggagagcgatttttcctgtcagtgtgtacactccaactatcaaacctcgtcggtatttctggtggtaccatcatgggagatatcgtcgataacctgcgatgtacagagacagtttttcttctttccaaagccgggcatgaaaaacttccataaggcttggtggtagttggctgtggatgttcaggattggatggggatagtgatggtgctggagctggagctggattaggagcacatgatggaatataactttgtagacatggtgacagccacaaattctcaatcatgccaaatattgggtttaggtcaaggttttttggaattaatttaatgatgatttgggctagttgtttcagtctgtaggtttctagataattgctaggatagtttggggncaattaaaatggtggactgtaacgggcaaggttgatcgtcgcaaccattttcatattgttatctctacagattaagtccgtgcacaaaataaaatgttgtcacttgctgtcaaatacttcctccatttcacagtgtaagactttctagcattgcccacattcatttagatgttaatgaatctagacatacatatgtgtttagattcattaacatctatatgtatgtggataatggtagaaagtcttacattgtgaaagggagggagtaactgactatatcagatgagataagatgtatggacctcatatggtgtcagctgcaatataattctaagctcactctctagctccttgaggtgcacccttagttgttgtatagtcatgttgagtgtgacattgaaaagagctgttgggcatatattgccatcaggtggtggaggcaccgtgatccctcctgggaaccccaagatctccaagcaatgtggatctccaaagacagatgatgtcaaagataaattcgactgctcaagcgtaagttgtatcaagttttttctcagggcaataatggattgtgcacttatggaggaatttcttgggttcggtagaataccaaattttacataagtggaatccttatatttggatgtatgcatagaaaccgaaacctgcaaaattttcagcgatcatttcagtatagcttgagtgcaagacaaattcttttgtcaaagtggaataatggcataccgtagtattggggatccctatttctctgtatatgtccttttgtagccctctgacatgtggaatgagctgttgacgtttctttaacaagaagaagctagcctgaatttcacctggaggaatgataggcgttttcttttgagagatgcataagaggataaaggtaagcttgacacactttatcttcatatttgctgaaagcttagctagcatgagtagctggtatcttctaatctaccactatttgagatcatttggttacgaaatcttttgattctactgtctggattttggggataatgcatctgactttacaaacataattaaatcatgtagcttgtcaatttatatgatcagacggttaatcagtgctgaaagttgctgcagaaggaaagtgttcttaccaggaagtaccccagggtcatcatcagggatggtttctgatgcatggtcatggagaggaagaagcatgaagaggaccagcacgaagacgccgatggagaggaacagcacaaggacacacttggcatcgacagccccgccaatcgtggcggcgtaccggcggacggcggagccgtggccggccgccggcgcagtgctgtgcaccgcttgctcggcgtcaccggccttgcccatggtgagcgcatctgccactggtttttctcaggctcgccagcgtagaaatcatcagagctgagggcatctgcggctgcgtggcgtcgaggagcagctggaaagctggagatggtgctcgccgtcgtcgcaacggcgacgcggacatggtgatatcatcaagagcttgagagttatcagaatactagaatagggatggatacgtgttaggacttgggaattttgggatgtgaatgcttaagtcgttaacagcttaggccggctgtcattggttttctggtttagtttaagaacgtatgaaaattttaatagcaagttagccagcttatgccctctttgtttaggcttataagccaacttataagtcgaaaagtctaagccaaaacaaacaagcagctttttcatttggcttttttaaaccataagccactctaacactattaagccaaaaactaggttggagaagctttttttttggcttatatgagatagatgtataactctaccattaaacttaggacattaaatccactggcttataaatcatataagccaataagctgacttaaaagtctaggccaatcagtctaaagtctaaataaagagggccttagcctctttctgtgatcagatttctgacgatgttgctccggttgttttgactttgcatcattgtgcgtgattcatccgttaacgtgtatttgtcccatacagaaactgtaggttcaggacaaagacatgctagataattggccttctcatatcggtgtttccatctaagccggtttactggtacaaggatcggaccatactatgacacttacatgacatctgtaatagctaaagcaaatggaagaaaaaccaccgcccactaccacataagccacaatttttgcatcccattataagacgatgaatttcttgtaatctatgtcctgaaggcatcaaatattccagggagatttaagttatcacctatttgcaatcataatgcacaacacatctaaactgaaccatggttaaattacataaagtacaagcagctcctcgctagcgtgaagttcgaactaacatgacaaaactgttttccccaatgtaacaacatttgcaattttggagtcacggtacagctcaagcgagctaacctagatgagcttcttcttctggaagtacccttgaaggtgccacaattgcaaaattgaaaccacaatgcagacgcttagtgacaaaatactgaaccaggctaccctagcgtttgttttctcgctcactgttcgcatctctgcttccctgtatgaacaaatcaaataaatcattagatttgccgctaatttaaaatcctgtagggcggtaataaatgtcttcaagttcacataatctcatataacactatgatttcttaaccatataagggcaatgactgggttcaatcgcaacagatcttgaaatataaagtttctcaaagtagaaagcagatctggactgcagatcgtaagttttgtaaacaatgctcgctctttgtggttgaatgtatctagtgctgagaattgaagacaatatgattgtttcattaccacttccaagttccattggcaatctactgaaccctctattagtaccaccaatattcgttttaaagcctcaaccacagtaagtcaatcatgtggaagtaaaacttaccttgctttgagatatatcatgttctgatggatggattgtactgccacttcaagttttctaagctctagttctacaccctacaaaaggaattagattgcagcaattagagaagcagtgaattaaactggacatcagtgaaatatggtcatatggaccgtcagcagtttggctaagcctactcctacctcaattttttccttcttagcgataacatcccaatcctttgctgcaattccaatcttccaatcaagattaatagatattcctgaccctttctctgcgctatctatccagaagcatgcaagatagtttcctgcttctgaagttgtgaatgcgaactgaccaaccgtagcattttcattgtgatgtaaggtgttcccatatggtgatgtaacctgcaccaagcataagcatttgcagaactataacagcacaagtagatagtaattcattcaacaaatcatgtaaaagcaaattgctaagcttctcgaagaaatgctaagcttgagaggattggagtagcatcgtttactccattagtggactgcagtaactgcagattgatactcgcacagtaaaaaaaaaaaaccatattcttgattcgaaagctgcgaaaagaaaaaacataaggactgttcaaaatggagcaaacacaaatagtatgcttagtgtctaatctagccagtactaattcatggatgaaaatagatctcctaatgaattaatattatacttcacataaataaaattacaatcagtggacataaattggagtaaagactaaagaaactagtatatagcgagttgcatggccatttaaccctagtaacccttacaatctactccatccatttgccttggaattggaaattttagtcccatgaagttcctcttgtgcattttcaaggaaaataatattaagaaagagttgagatatcacctgctcacttaagtgggttctacaattaataatttatatgacattaccattatctcacctaagtctatctacttattcaatcttatacggcactcgcaatttatcaaccatatgtctacacgttagtctatttattcagtatgtccccttgtttggtcgaacgcaaaaagcatggcaacacactgtcatattcatgcaaatgattccgaa
